United States Patent 11,242,544 (MICROBIOMES AND METHODS FOR PRODUCING MEDIUM-CHAIN FATTY ACIDS FROM ORGANIC SUBSTRATES) - sequence listing, part 6

SEQ ID NO: 416 - DNA, 890470 bp, Unknown
  Metagenome-assembled genome
gggggtccgccctttggggcgggccccctccgctcgtatacgcggaagcacaggccgcgcgtccccccgccggggcgcgcggcctgccgcgtatcgggggggcgcccggtccgggccgagttggttcagctgtcacgggcttcgtttccccaatctcataaagtttggtaagttgatctacctcggatggttgaataccctcgaccctcatttcaggcgtttttcttgggctaagctatgtcccataaacgtggtcgaggtgtgtcacagaaggcttttcggataattgcgcgggacccctaccgagacatgtggcatcggagtgcctagtggatcaggagctccgaagcattgattgttcttccgcataccgatgggggcgtcaacggttgaacagtccttgctggcggtaatcgagtcctgaataactcccctgcatgcgatgactctgggccaatcgtggtttgctaacggtgtctggggccaggtcctgtttttgctgacggggagagacagggacgagttgtaccagcctttgtagtggtatggcaaccagcaagggatgcggttcctaggtttcctccggagcggcaatacaatgagatcgcctcgtttcgtctcctggcctcaacttatttgcgcaccctggcatgccggtagctatccgatgattcccatctaaattctttgtgaatacttctgcagaataatggttgccacttgcagaaaacaggctgaaaagacttttataatttaaaaaaacctccgagaattgatgtggctcatttcaatattgaagccaaacagccatcatttcagagaagggggacctacgagatgctttatgaacctgctgagtgtgctgccgttctggaccgcagggggccttttgtgcgcgttgagcgtgcaaacgaatcatcggagaggatcgttcttcccctgtctgggacacgacggatcaccttcctttgcgccgaagcggggatgggaaaaactaatctaatgtgtcatattctcgacaacgaggaagctcgaggcgctgtcgtaagaatctatgacctctcgcgcccctgcagcgttgatgctgcggagaaggtgtatcggatttctcgggaagtcgtctcgctcgcaaacatcaactcccgtgtcatcgtgggcattgatggtcttcctcccgacagcgagcacgccacccaccgagaggcgcgggcaattcgcaagatggcggctgccggggcatatgttcttgtggcaatccggcccgaggcaagggccatcatcgagcttctccccgaagccaaggtggtgggcaccaaggacctcctctgtggggaggggatggcagacgagccggtgcgttggggctttacccatgggatccccgctcttgagcatgcgtttacgggaccggctgcctcccgtgtcatcggttgccacgatgccgttaccgctaagtacgtagaggctcttgcccgcctttcctccgagtatcttcgggatggccttgacgaggaggagagggtcctccgtgcaacgctgatgcttctgggcagcggggaacttgcaagcgttcgtgagattcttccgcgagcggatgacgaggcccttctctggctgagggtcagcgctcccctgtttgatgtcaatctggtcgactctggcttctccgttgcggggcttcgcgacgactcgctgctagagaggtgcctcccaatactgcggggaacttgcagcaagtggaatgacttggtccttggcgtggtatgggcgctctcgagacgcggcgactatgcacgtgcgtcaattgttggctctatggtcgacgacccggaggagctgagcgccataggctgccgctggggcgaggggcttctgttctccggacagagggaattcctcaaccgttgccttgcggcggcggatgattcgggggttcgcgcctctcccgggtacctgaagtccaggcaactcatcctcgaggtagacggaaggctttccgaggcaaataggggccgcatggagtgcgccgaccttcttgcggaatcgggacgccatgcctttgactgggaggtctgccgcctggtggccgattgcagggatagggtcgtgtccgtctgtggcgacattgcccaatcgggcgggaagtcctgtgcaaccgatgccgctctcgtcctccacggcaaggtcatgggccttttggcggagggtgagctgaagcgcgcgtttgccctcatgctcgactcgccgctccgcagggagccgaagacgctgcccgccgcgctgctgtgcgacgactttgcccttgtgagtgcgctattgggtgagaggctcacggcagaggagagaagggacctggctaccgcaggaaggatcgtcgagggagcctcccctcgcaggcttggcgtttaccgccggaccgtcagtcgggcgcttggggtcgtgatgggccgcgccgcttctatcaggggcatcgagagggcaatcaaccgggcgggtgagaatggcgacgtactggtcgagacgtcgttcctgctggcggcggcagttgcggacctacgggctggagggtgcacccgtgcgcacgtgagggcctcgagggcaatctgccttgccgagaggggaggttcagcctaccttggggacgttgccaagttgatggacgccgcgattctcctctcccttggggagggcgtggcgactgtcgcaaagaacgccgacctcagcaagccggcgctcagggacctcgtacggctgcttctgcacgccgtcggaggaagcccctcaccccacaagccgtttgagcgcctctcaaaggcgcgctgcgatagggaggtcctctgggtcgtgtcgttcctcgcgaacgactgcggcgaggtctcgcgcgccttcaggtcggtcgctccacacgcctggacggagctgatcgacgaggagccgccagcccgcgagtatgcgcaagaccccctcgaggacaatccgtccgaggaggaggggctcttggtcctggaggagccgacggacaagacctataggatcaacgttctcggcgggttttccgtctacagcgagggaaagctgatggacccgctcaagtttggcgcgaggagggcgcgcgacctgctgatcgcgctggcgctcacgcccgggcacgagctcaggcggcacgaggccctgcgtgcgatatggggcgagaccgactacgccgacgggatgcagaagctctacgaggcggttgccgccgcgaggaaggtccttcgctcccaggagctgggggtggacccctttagaaacatccgtggcagtgggatcatcgcgctcaacccggagtgcgtgggaacggacgtcgacgtgttcctctcagaggtggagagcgttctcgcggacggggccggggatagggcggcaatggaccatgcgcgactggtgagaagggccttctcgactggcccctgcgggttagggaacgaccccatcggcgtgtggggggacgcgactcgcgccctgggagcctcgttcgccgacagcatggcgtcggggatatcggcggcgctccgactggggaggcccctgcttgcctgccagtttgccgagtcggccttggaggttgccccggggagggaggacctgctcgtggggcttgtgaggtcccttgcggagctggggaggatggtggagatcgagcagctgaggaaggactatcgcgcaaaggtcaagaagggcgagatggtcccctgcccagagctggaggaggcgttccgggaggcgatgaggcgcagggacgacgagagcctgggcgagtgaagcaacgtcaatgccgttttgatgacagagattctcagctggcggtcagagtggcccaacgggtacattggtacgcgttgagaactatggaaaagaaccctctgtcatgacaaaggatgcatatgcctaacctattttctcgcctcatgtcgaagggcgcagacaagcagctcaaggagttcaggaagatcgccgaccaggtgaatgaccaggagcagaccttccatgccatggacgacgaggagctgaggtcgcagaccgcacgcttcagagagcgctacgacaacggagagcccctcgacgacctgctgccagaggcgtttgccgccatgagggaggcctcgagcaggacccttggcatgcgtcacttcgacgtgcaggtgataggcggcatcgcgctccaccgcggcatgatcgcagagatgaagaccggcgagggcaagacgctcgtctcgaccctcgccggctatctcaacgcgatctcgggcaagggcgtccacatcgtcaccgtgaacgactatcttgcgaagcgcgacagccagtggatggggcaggtctatcgcttcatggggatggacgtgggtctccttcagaacggcatgcggcttcccgacaagaagcccgcctacgccgcggacgtgacctacggcaccaactccgagtttggctttgactaccttcgagacaacatggtcacgagggcggacatgcgcgtgcagcgtgggcacaacttcgccatcgtcgacgaggtagactccatcctcatcgacgaggcgaggaccccgctcatcatctctggtgcgggcaccaagtcggcgagcacgtacaaggacttcgcacgtgccgtccgcggcctcaagcccgatgtcgacttcgagatggatgaggcaaagcacaccatcgccgcgactgataccggcctcaagaagatcgagcgcgccctgggaatcgacgacatctacgccgacatgagtgggcagctcgtcaaccacctgcagcaggcgctcaaggcccagtacatgttccaccgcgaccagcagtacgttgtcgcggacggcgaggtgaagatcgtcgacgagttcaccggccgcatcatggagggaaggcgctactccgaggggctgcaccaggcgatcgaggcaaaggagggcgtgctcatccgcgaggagaaccagaccctcgcaaccatcacgctccagaactacttccgcctctacgacaagctcagcggcatgacgggtaccgccatgaccgaggacgcagagttcagggagatctacaaccttccggtccaggcgattccgcccaacaagccggtcatccgcgtcgatcacgacgacctcgtgtacaagaccgtggacgcgaagttcaacgccgtcgccgacgacgtcgtcgcgcgccacgaagaggggcagccggtcctggtgggcaccgtctccatcgagaactcggagaagctctcccgcatcctcgacaagaggggcataaagcaccaggtcctcaacgccaagttccacgagcgcgaggcacagatcgtcgcgcaggcaggccgcgagggggccgtcaccatcgcgaccaacatggccggccgcggcacggacatcctgctgggtggcaacccacagttcctggcgtccgaccttctcgcccgcgacgggattgacccggaggaggcgactcccgagcagagggaggaggcgctggacgaggccaaggagacctgcgaacgggagaaggagcacgtgcttgccgcaggtggcctctgcgtcatcggcaccgagcgccacgagagccgccgaatcgacaaccagctgaggggtcgctccggccgtcagggggacccgggcgagacgcagttctacctctcgctggaggacaatctgatgcgcctcttcggcggcgagcgcatggaccgcatcgcgagcatgatggacaagtacgacatgcccgatgacatgcccatccaggccaagatcgtcaccaaggcggtggagagcgcgcagcgcaaggtcgagcagatcaacttctccatgcgaaagaacgtcctcgactacgacgacgtcatgaacaagcagcgccaggtcatctacgaggagcgcaacaagattctggacggcaaggacctcgtggctcacgtcgaggaggtcacgctcgacaccgtgcagcgcagggtcgcggagttctgccccgaggacagcgacccggagtcgtgggacctcaagggcctctcgaagtggatgcaggaactcaccgggcgtaccgacggtccggaggtcgacgaggacatggagcagggcgacattgtcgacgcgatcgacgagtacgtcgtctcctgctaccacgagaagtccgagaggctctcggacgagatcatgcagcagctctcggcgcaggtgatgcttcgcgtcatcgacacccgctggatggcctacctgcaggagatggactacctcaagaccggcatcggcctgcgcggctttggccagcgcgatcccctcgtggagtacaagacggaggccttcgccgcgttcaccgagctcgtcaacacgatgtacgaggacttcctgcgcacgattctgcgcatcgagctcgccgtggcgccccagcagcctgaggacgatgggctgaggggcgcgcgctactccggtcccgaggaggtcgacggggaccatgggaacaggaccgctcccgcacacctgaaggcggcggggcagggtggtgacaccccggcaccctcaaagcccgcgacgtaccgcaagtccgaggatcccgacccgtacgtcggcgttggccgcaacgatccctgcccctgcggaagcggaaagaagttcaagaactgccacggcaggaatcgctaggcgatgcccgtggagaagactgacattgaggcgctggccgaacgtctcgaccaggtcgagggctacctgcacgtggaggagaagcgcggcctggtctcggagctcgaggcccagagcgcgagtgcgggattctgggacgacaccgcggcggccacggccgtcatggcgaggctgaactccgcgaaggacgacgtccgcgcggtggacgaggcgcgctccaagctcgatgacctcgagacggcgttcgagctgggcgaggagatgcaggaccaggacatgctctcggaggcggagggcatgcgctccgagctcgaggggtatctgggagagctggagctttcgagctggttcgtcgacgacctcgaccacggtgacgcgatcgtgaccgtcacccccggtcagggtgggcttgaggcccaggactggacggacatgctcttccacatgtatctcgcctactgcgcgagaagaggttggaaggtcgtcgtgaacgatgctcccgccgcagagggcatcggcatcgacagggcgacgttcacggtctcgggcaagaacgcgtacgggatgctgagggcggaacagggggttcaccggcttgtgaggatctctcccaccgacgcgaagaagcgccgccagacgaccttcgccggcgtggaggtcctgcccgtcctccccgatgacatcgaggtgaagattgaccccggtgacctgaggatcgacgtgtaccatgcgtccggtcccggcgggcagggcgtcaacaccacggactccgcggtgcgcatcacgcacatcccgaccgggatagtggtcacctgccagaacgagcgaagccagcttcagaacaaggctgccgcgatgcagatcctcaaaagtcgcctgtacgagctcgagaaggcgcgcagggacgcggagatcgacgagctgagggggcccaagcacgagatctcgttcggcaaccagatcaggagctacgtgctgtacccgtatcagctcgtgaaggacctcaggacgggggtcgagacgagcaacgtcgactcggtgctctcggacggggacctcgacaggttcatcatcgcctaccatcgttgggtggtcgggggcggtgaggccaagtgatgccgcgcggcgggatcagggcggcggttcgcgacaccgccctcatcgtcgtcggctctttcgtctatgcggtcggcatcgactgcttcgagatcccaaacggccttgcggcaggcgggctcacgggtgtggctacgatcacgtccgccatcgcgtccaacgcggggataacccttcccgtcggcatccagaccatcgccatgaacgcggtccttctggggtacgtctacgcgacgacccatgatggcgggtacgtgacgcagagcatattcggaatgatcgtgtcgggcctcttcaccgacctgctcgccccggttctgcccgttcccgtccacaacgacctgctgctctcggcaatctggggtggcgtgatagccggggcgggcattggcatcgtcttcctgtcgggagggaatacgggcgggaccgacatcgtctgccagctcatcgccaggcggacggggatgccgctcgggaccctcgccatcatcgtcgacggcgcgatcgtcgccgcgtcaatcccggtgttctccctgaccaacgccctctacgcaggcgtcgcgatgtacatcagcggcagggtcatagacgccatcgtcgatggccccctgactgcgcgcgtggcgttcgtgatctcgtcggagcacgacaggataggaaaccagatcctgtacaccctcggcaggggatgcaccgagctgcaggcgcgcggcctctggagcggcagcaacaggcctgtcctgatgtgcgtactcggcaggacggagacccatcgcctcaaggagatcgtcgcggggattgacccggatgccgtcgtcatcgtcaccgaggtccacgaggcgtttggcgagggcttcacgcagataggctcgggttcctaggggagaggtcccttgcgacgggtccgcgcgcgattcccctgggatgtggagcagctgtgggggagccccatctggcgaacgcatggagtcacgtacggaaaaccggcggcgaccaacgtgcgtctgcgttagcatcagcagccacggggcatgtcaggctacctgcccccgtcgccgctggcgacgcaatgcgcaacaggaagagggggacacatgaagttcttcatcgacaccgccgacctcgacgagatcagggaggccatgagctggggcgtgctctcgggcgtgaccaccaacccgtcgctgtacgccaggaccggcgggagggaggctcgcactattcgagggcacacatgccgagatctgccgcgtctgcgagggcctgcccgtctccgccgagtcccaggccaagaccaccgaggcatggtggaggacgccaggagctcgccgcgctggcccccaacgtcgtcgggaagctgcccatctgcgaggagagcatccggcgaacccacaccagctgcctccgagtgcatccgctcaacatgacgctggtgttctccgcccgcaggcgctggctggcccgcacctcgccggcggcgctacgtgagccccttcgtcgccgtttcgacgaacatcggcgacgacggcccgctcccagctcgagaccgtggtgcgcgcgtcaagaacatcctacgctactggacgcggagggcggccccgagatcatcacgctcgggtgcgcacccccaaccagtgtgacccagccgccctcatgggcgccgacatcgccaccgtgcccttcgcggcgctcaggaagtgcgtgaggcacccgctcaccgccgagggcagggcgaagttcgacgccgactgggagaaggtctccgccggggcgtaggaatcgcgtaggtcccattcccacaattcagcaatcctgcagacaggctccccgcggatagagggtccgtggggagcctctggtttatctgtgcccagatgggggcctaggggcgctatcctcggtctttgctagaatgccaacgaatctgtcatgtatcgctatgtagaaaaaggagctctagtggccaaccactttcgcagcagcgagcgacagggggacgagggtgcgcagcagcccctcgacagccaggaggcgcagggcggcgaggtgacggaccgggagcaggctgacttcgtgccgcgccactcggcccagcacgttgcggcttcatccgtccctgatgcgcagccagagccggaggctccccagcaggagcagccggcaggctcgatgacggtcgcgacccagacggaggacgacatcacgtcccagcccgggtacacgagcgtcttcgcacccctgaacgatgcgggcgcaccggcggtctctcgcacgggcacccccaccatctcgctcaaaaacgcaacactcatctacccggcccagcccaacaagccagcactggaagacgtgagcctggacatctaccccggcgagttcgtgttcgtcgtggggcactccggctcgggcaagtcgacgttcctcaagctcctcacgcgcgagcttcgcgccaccaaggggcaggtcatcgtggcggggagggatctcaccaagctccgcaacagcagggtcccgtacctccgccgccagattggcaccgtgtaccaggacttcaagctccttcccgacaagacggtctacgagaacgtctcgtttgccctggagtgcatcggcaagtcccgagcggtcatcaaggcgcaggtccccgaggtgctcaggctcgtcggccttgccgagaagatggacaactaccccgaccagctctccggaggagagcagcagcgcgtctcggtcgcgagggcaatggtcaaccgtccgcccctcctggtgtgcgacgagccgaccggcaacctcgaccccgcgatctcgctgggcatcatgaagctcctggaccgaatcaaccgcaccggaaccaccgtggtcatggcgactcacgaccgcgagatggtcgactccatgcgcaagcgcgtcatcgcactcgaggcgggtcacgtggtccgcgaccaagagagaggaggctacggctactatggtgccctctaacctaggctattcgctccgcgaggccggacgccacttccgaaggaactggtccaccgtcctgggggccatcgtcaccatcttcctctcgctcttcgtgatcggcctcttcgtgatggggtcggtcatgattggcaacctcgtgggcaacgtcgagaactccgtcaccattcaggcgttcctctccgacgatgccgacagcaacgccgtccaggccctccagaccaagatcgagggatgggacgacgtcgagtccgtcaagtacaagagcaaggacgaggcactcgaggagtacaagcagtccatgagcaaccgcaacgcctccgacgtcgttgccgcgcttgatggcgagaaccccgtccctgcctcctacgtgatcaccctcaaggaccctcagaaggtcgaggaggttgccaacaagcttatccaggactccgacttccagtcggtcgccgatgggtcggatgcctcctccgcggtctcgtatgggcgcgagacggtcgagcgtctcttcagcgtgacgtactacctgcgcatgggcgcaatcgtcctcgtcgtgctcctgtcgttcatcgcgttcgtcttcatcaacaacaccatccgcctctccatcgccgcgcgtcgccgcgagatcgcgatcatgaggctcgtgggcgcctcgaacggcttcattcgcgggccgttccttaccgagggcgtgctcgaggcgctcatcggctcgctcctcgccatcggtatgctgcaggcgggctcccaggtcgtgcttcccaagctccagcagagcctgtcgttcctctcgttcaacctccccacccaggtggtcgcggcaacgtatggagcgctcgtggtcataggcatcctgctcggcctgtttggctccgccatcgcgatgaggcggtacctcagggtataaggtctgcgaagtcagaagactttgccgatggggcggtgcggttgcatgaccgtgccgcccccgttgttttttggaggggtatggcaagaaggcatcctggcggcggccgcaggcgcggaggcatgccgaggaaggcgcacaagccccgtcagaccgtgacggggtctatcagggtcactcgccccggggtcgccacggtcgacacggcggaggggcgctttgccgtggggcgcggcggcatccgcgaggccatgaacggcgatgaggtgcaggtctccctgagcacgaggaggggaggggagcggtttgcctacgtgcaggccgtcctcatgagggcaaccacgacctttgtgggaacctacgcaaacgccgcgccgctcggcatcgtcgtgcccctcgacggcaggatcaggagggacttcttcgtccttcccgaggacgattccgccagccggctgggcgtcagcgacggggatgtggtatcggcaaggatcctcgaataccccgcgcgccactcctcgggcgtggtgacgctcgaacgcaggcttggtgacgcggatgacctggacctggacatcgagtcggtcatcgcatcgtatgacctcgcgacggactttcccgaggagtgcgacgaacaggtggggtccgtgcgggtcgacgtggagcccgcgctcgtgggcgacccgtgccgacgcgacctcaggggccgctcgtgcatgacggtcgaccccaccgacgctcgtgacttcgacgacgcggtcggagcccggagggtgggggacggatacgaggtggacgtccacatcgccgacgtgacccactacgttccctggggctcgccggtcgaccgcgaggcgcgccgaaggacctgctccgtctaccttgccgaccgcgtccttccgatgctgcccgagaggctctgcaacgacgtgtgctcgctggtccccggcagcgaccgcctgtgcatgagcgtcctcatgcgccttgacgcccatggcagcgtgacctcgtatgaggttgccccgtcggtcatcaggtcgcgggcgagacttgactacgacaccgttgatgcgctgctcgaggggcgcgtcgaggaggcctcccttcccgccgtcgagggtggccccgaggaggttgccgggcagctccgcatcctggacgaggtcgcttcgctcaggcaagaggtgaggagccgtcgcggcgcgatcgacttcgagacccgggaggcgaaggtcatcctggacgagaggggcaagccccagggcgtgtccgtgagggagcgcacccgggcgacggggctcatcgaggaggccatgctcatggccaacgagtgcgtcgcgtcgcttctctcccagtctgacgtgcccgttgcctacagagttcacgagcgcccctctcccgaggacctcaaggagacgctcccggtcctgggcgagctggggctcctgcacggggacctcgccgagcggctggtgagcggggaccccatggcaacgcaggaggtgctgcgcgcggcacgtgggacgcaggcggagtacctggcgagctcggtgctcctgagggcgcagaagagggcggtctaccttccgcacaacgatggacactatgcgctgggggcgcaggcatattgtcacttcacgtctcccatcaggcgctatcccgacgacacggtccatcgcgccctcaaggcgctgcttcacggggagttggggtccagggagcaggcgcacgtggcggaggccctcccgcagctctgcagggactgcagcgatagggagagggtcgcagactccgccgcccgggcgtcgcagaaggtgaagatggcggagctcttctccgagcgcgtgggtgaggacttctcgggtatggtcgtgggggtggagcgctatggtctgttcgtcgcgctcgacgacacctgcgccgaggggctcctcccggtgagggcgctcggtgacgagtggtttgcctacgacgagaggctcctctccctcacgggggaggagagcggcaagaggtggaggccgggccagcgagtcgcggtcaccgtgacgggcactgaccccgcgcacggacgcatcgacttcgcgctcgcgggctccgcgtcgagggagcgggcgcaacggggtaggctacaggcatagcgacgagacgcggcggtgccgcgatgggggacagatggaacagacggacatgacggaacggctccagaccgccgagggcctgctcgtgcagggccagtcggagcaggcgcaggagctgctgcgaaagctcgccgaggactgcgaggagtacgtggacaagaactgcctcaccaccgacgaggtgcagtggttcagcttccccacgctcttcgagcgccttgcctacaggcgggtggagaacgacccccgcgagctcagggacgttggcgagccgtttgacaggctgtacaacgacctcgccctcgcgagcgtccacgagggggactacaccaccgccaagcaggccctgagccaggcggtccgctggaaccccatggggtgcgagtatcgcctgaaccttgcggacctgtatcgcatagacggcgacccgcaggagtacctcgcgctcacctactccgtgttcgagcgtgcgagcgatgcccgccacctggagcgcgccttcgcgaactttgcggagtactttgaggtccaggacaagccgcgggcctcggcggcggcgctcagggcgggccgtcggcttgggacggaggaccccacgctcgccgcggcgctcgaccaggccagcgggaccgagcgcgaccccgactccgtgacggatgacgaggcgcgcgacctcctcgcccaggaggggctgcccgacggcgccaacgccgagatcgcggtgtgcctgctcatgtgcgccaccgacgcggccgccatgggccagcgcgacgttgccaccaacctcacggtccgcgcccgcgacctcgtgggagaggacgcggcgatgacgctgcttgggctcatccgttccgccgacgaggaggacgggggtgcgacggatgcccgctagcaggaacgcgcgcgggaagaagacgatctccagaaaccgcgtcgcccgacacgactacctcatcgaggacacgtgggaggcgggcatcgagctcacgggttcggaggtcaagagcctgcgcgagaggcccgcccagatatccgactcgttctgcatcatcagagggggccagctcttcctggtgggggtccacatccatccgtactccaacggaggggtgtggaacgtggaccccgaccgcaggcgcaggctcctgatgcaccgccggcagattgactaccttgacggcaagctacgcggcaagggcctggcggtcgtccccctcgagctctactttgacgagcacaaccgcgtgaagctgcagattggcctgggcaagggcaagaagctctacgacaagcgcgccgacatggcacgccggcaggttgaccgcgacatccagcgcgcactcaaggagcgcagccgcgggtagcggctctggaactaaggaggaaaaggcatggacgcgaaggcgctgttcaagttctcttcgggactctacgtggtctcggcaaggtccggggacgatgtgggtgcctgtctcgtgaacacggggcttcagctcaccagtgagccgctccaggttgccgtggtggtgaacaagcagaaccacacgcacgacgtcatcagatccgcgggccactttgcgctctgcccgctcacccagggggccgacatgcccttcgtgggaaggtttgggttcaggacctcgaccgagttcgacaagttttccgggattgagacgcgcgtcacctgcctgggggaccccttcaccccgcagaacgcggcgagcgtcattgcctgccaggtcgtccagaccctggacgtgggaacccacaccgtcttcgttggagaggtgcgcgacgccgaagtcctggacgatgccccgctcctgacctacgagtactatcacaccgtcctcaaggggaagacgccgcccaaggcgtcttcctaccttggcaatcagtaggcaatatcaggcgtcacccttggataaaatgatattatccaaggtacatttaggggtggcccatgggagggccgccacgtggagaggagtcaccatggccgacgaagagaagaagacctacaccttccgttgcaccgtctgtggctacgaggtcaccgttgacacgcccgagctccccgaggactacgtgtgccccgtctgcggcgttggtcccgacatgttcgagctcgtcgaggactaggcgagagggtcaaaggaaccattgccggcggggcggtgccttcgggtgccgccccgccgcctgtctgccggtggaagatgcccctgccctaatgccagcacctctcaccccatgatacacgccgtttgcagaagacgggttgactgtagtagcttcgttctcgtttggcatgagggagaaggagcggatggaactactacgaaagcgggcgtcgcagacctccgagtccgtttggctggcactggtcctcgcctgctcgggcgggctcatggacgcgtactcgtttctgggcaggggaaaggtcttcgccaacgcgcagacggggaacctgctgttgcttggggtcaacatctccgagggaaactggggcaacgtgagccactacctgtttcccgtcatcggctttgccctggggtgcgcgctcgcgcacgagatcaagcttcaccttagccatggcatgcactggcgccagtacgtggttgcctgcgaggtcgtcctgcttggcgtggtcgcgttcatgccggcggcctcgaacctggtggcgaacagcctcacgtcgctcgcgtgcggcatgcaggtgcaggcgttccgcaagctccacgggcgcccgttcgccacgaccatgtgcatcggcaacctgcgcagtggcacgcaggcgctcgtgagctacatccatgggggcgttcggagggacctcaggaccgccttcctctattacgtggtcatcgtgaccttcgtcctaggggccatcctcggcaacttcctcctgtccgccttcgccctcagggcgatactcgcaagctgtgtgctgctgctcatcgcgtttgcgctcatgttcgaggaccgcgagaagcgtcagctccttgccggccaggtggattcgccgtctcgggggtaaggcgtgcgggcgggtatgggtatactcatacggtcccgatggggaagcgtacgttgacagctcgcatggtggcagcagccccattcccacgtgggggtgactggtttcgacagggtaggtctgaggtgggcagcaagccgtggtctcctcgccacgtaaaacaggggtaccgtcaaattgaattgacgacaactcttatcagggctcttacgccctcgccgcttaatctaatttagcggccgtcaaaccgggggtctctcccgcccctggggcgacgtcattttagggagacgctcgcgcggacgtggtcggtatgccgcgcgctaagctcgaaccggctgggacgccaagcgcgagtcgctgggcgtgaggcgtccgagacccaacaagcgactgagcttggagacacctgccaggggtttgccttggaccggagttcgattctccgcacctccaccatgacaagcgaagggccgtcccgttggggcggccccattttcgtaacgggcgcgtctcgccgaggcgctgctccgcccggtgcctcccgcggataagatggttgcggttagagatgggcgcatgccatggatgcgcgcccgcgtcgttcgaccctccgggcgacgcgacgacagggggttgcgatggaaggtaccaaggggtctggcaacgcgctggtgctcgagggcggtggcttcaggtcgatgttcaccgccggcgtcctcgacgtgctgcaggagcacggcgtctacgacttcgacagcgtgtggggcgtctcggccggcgcgatcaacgccgcgagcttcaagagcaggcagatcggtcgcaccatgcgcatcatgctggcattcagggacgacaggcgcttcatgagcctgtggtcgctcgccaggacgggcgacctcgcgggcggaaagttcatgtacgacgagatccagaaccacctggaccccggggatgacgagaccttcaactccaatcccctcaggatgtttgccgtggcctcggacgtggtcttcggcacccccgcctacctcgagtgcaagaggttccccgacgacctcccctacgtccgcgcatctgcctctatgccgctcgtgagccggctcgtggatgtgggcgggcaccgctacctcgacgggggcacgaccgactccatccctttcgaggtcgccctgggcaggcccggtgcgccaagggtcgaggggtacgagccggcgagcagggcgctcgtcgtggtcacccagcaccgctcctacgtcaagtccggtgccaacgagcgcgcggtcgtcagaagccaccgctacgacgggttcccctactacctggaggcgacctcgacccgggcggagcgctacaacgcaaagagggagcggctcttctcgcttgcggaggaagacggaagccccgtcctcgtcctcgagcccaagaggcccgtggaggtcggcgccacggagcatgacggcgagaagctcctgagcctctacctcgagggcagggcggtggccgaggagcgtttgggggacaccacctcgttcctcgcgcctgagcggggctgagggcatcccgggagcgttcctcccaccgctatagtggtcaacttctgtgttgtctttttgaggacggcagcagggccgcctgagttgtatacttctaaagcttttccactgagccccgtaatctctaggaaatagcgttccgtcaagttgcatctggaggagtcaagtgactaagtcgactcaatacgccaagccgggcgaggtcgagcgcaagtgggtgctcatcgacgctgagggcgctaccctcggccgtcttgccaccaaggctgcgatgatcctgcgcggcaagaacaagccccagtacaccccccacaccgacaccggcgacttcgttgtcatcatcaacgccgacaaggtggtgctcaccggtaacaaggccgagcacaagagctactggcgctactctggctggctgggcggtctcaagaccgagagcttcaaggaggccatggagaagcaccccgagcgcgttgtcgagcacgccgtgaagggcatgctgcccaagaccaccctcggccgcaagcagggcaccaagctcaaggtctacgcaggccccgagcacccgcatgccgcccagaaccccgtcaagatcgattggagggcctaaccgatggctgacaacagcgctgtttacaccggcaccggccgtcgcaaggaggctaccgcccgcgtgcgcctcgttcccggcaccggaaagattaccgtcaacggccgcgacgccgcccagtactttggccgtcagcagctcgtcgacaacgcctgcgcgcccttccgcgtaactgacaccatgggtcgcttcgacgtcctggccaactgcgccggtggcggcatcaacggccagtccggcgctctgcgcctgggcatcgcccgcgccctcctcgaggccggcgagtatcgcgccgacctcaagaaggctggcttcctcacgcgtgacgcccgtgcggtcgagcgcaagaagtacggcctgaagaaggctcgcaagcgcccgcagttctcgaagcgctagtccttcgagacccgagcacctcgtcaggggtctgccgcaatgggtcggcaggcccctttctcgtatacaggcaggcgtcgccctttcagcgacgcatcaggcgatacaaaaaggggacgaccatgaagtacttcgggaccgatgggttcaggggagtggccaacgagggcctcaacgtggagcacgcctacaagatcggacggttcgtgggctggtactacggcgcccgggtgggcaagaaggcgcgcgtggtgctgggcaaggacacccgccgctcgagctacatgttcgagtccgccctcacctcaggcctggtcgcctccggggccgacgtgtacatgctgcacgtcatccccacgcccggcgtgagctacgagacggtggacgggtgctttgactgcggcatcatgatcaccgcctcgcacaacccctacaccgacaacggcatcaagctggtcaacggcgagggctacaagatggacgaggacgtcctccagcagatcgaggactacatcgacggcaaggtcgaggtcccccttgccaccggagaggcgatcggccagaccgtcgactacatgcaggggcgcaaccgctacatcgcctacctcatcgcaagcgccaacttctccctccagggcgtcaaggtcggcatcgactgcgccaacggcgccgcctcgagcgtcgccaagcccgtgttcgacgccctgggcgccgacgtcagggtgatcaacaacgcgcccaacggcttcaacatcaacgtgagctgcggctccacccacatcgaggcgctgcagcgccacgtggtggagcagggcctggacgtgggctttgcctacgacggcgacgcagaccgctgcattgccgtggacgagcgcgggcacgtggtcgacggcgacctgatcctgtacgtgtgcggcaagtacctctcaaagcacggtcgcctcgcggcggggacggtcgttcccacggtcatgtccaactacgggctgttcaaggcctttgaccaggcaaagctcagctacgagaccaccgcggtgggcgacaagaacgtttatgcctgcatgcgcaagaacggctactcccttggcggcgagcagtccggccacatcatcttcggcgacatcgagtgcaccggcgacggcatcatgaccagcctgcgcatcatggaggtcatgcgcgcggagcgcgagcccctctccgccctcaccaggcccgtcaagctgtacccgcagctcctcgtcaacgtcaaggtcaccgacaaggaggccgcgatggccgcccagcccgtgctcgacgcggtcaaggaggccgagggattcctcgccggcaacggcagggtgctcgtgagggcgagcgggaccgagcccctggtgcgcgtcctcgccgaggcgcccgagaaggagctctgccgccaggcggacgacatcgtgatcaaggcgctcgagcccttcagggcatagcccccgcgatagaattcacaggagtgacgagagaccgtgacgaccggaggagactgacacatgtgtggaatcgttggctacacgggaaagaagcaggcgcaggactacctgctcgccggccttgccgcccttgagtaccgcggctatgactcggcggggatcgacgtcctctccggtgacggcgagctgcacggcgtgaagtgcgccggcagggttgccgccctggtggagaggtgccgtaccgccaacctggtgggcaacaccggcatcgcgcacacgcgttgggccacgcacggcgccccgaccgacaggaacgctcacccccacctggattgcagcggccgcatcgccatcgtccacaacggcatcatcgagaacttccaggagctgcgcgcctatctcgcccgctccggccacacgctgaggagcgacaccgactccgaggtcatcgcccacctggtcgaggacgcctggaacgggcccgcgaagggtgacctcgtgagcgccgtgcgctacgcgtgcaagaggctccaggggacctgggcgctcgccgtggtgtgcgcggacgcccccgggcaggtcgtcgtcgcgcgcaagggctccccgctcgtcgtggcctccacgccggacggtgcctacgccgcctccgacgtgactccgcttgcaaccgtgacctcccacgtcatccagctcgacgacgaccagttcgcgcgcctctcccaggacggcggcgtggtcgtgtatgacgccgacggcagcgtggtcgagcacccctcgaccctggacatcgactgggacgcctccgcggcgaccctgggcggctatcccgacttcatggccaaggagatcaacgagcagcccgaggccatcgagcgcctcctccacgaccgcctgggcgagcacggcatcgagatggacgagctcaacatgaccgccgaggagctggcatccgtcgaccgcatctacctcgtggcctgcggtacctcctaccacgtgtgcctcatcgcccgcgcgatgatcgaggactgggcaaagatccccgtcttctgcgagtacgcctcagagctcaactacaaggagcccctcgtcaccgaccacaccctctgcgtcatcgtcacgcagtcgggcgagacggcagacacgctcaccgcggcccgcaggatgagggggcttggctgcaaggtgttcgcggtgaccaacgtcctgggctccaccgccgcgcgcgagagcgacggcaccctctacgtgcaggccggtcccgagatctgcgtgtgctcgaccaaggcctacaccgcccagatggtggcgtgctgcctcctcgcgctcaggcttgcgctggccaacggccagatggaccagacggaggtggagaggcacttccgcaacctgcaggcgatgcccgccctcatcagggaggtcatctcgcgcaggtggcaggaccaggaggcgtcccgcctgttcaggagcgcccattccgcgctgttcctgggccgcggcgttaactccaccactgcctacgagggcgcgctcaagctcaaggaggtcagctacctgcacgccgaggcgtaccccgccggcgagatgaagcatggccccatcgccctgctcgagcccgggttcccggtggtcgccatcgtgcccgccgaccacgtgcacgacaagacggtctccaacatccaggaggtcatcgcgcgcggcgcgacctgcatcgcggtcgcgacggacggcgacgagaagatcgccaagctctgcgacaacgtgctttggatcccgcccgtccccgaggagtacctggtgcccatcgtcgccatcgtgcacctgcagatgctcgcgcgctacgttgcgatcgcccgcggctgcgacgtggacaagccccgcaacctcgccaagtccgtgacggtggagtaggcaacgtggagcttgccggcataggggtggacatgctcgagatcgagcgcatgaggcgtgccctcgagcgccaccccagcctcgcccgtcgcacgttcacggaggaggagcgcctctactgcgagtcgacggcgcgtcccgccgagcactatgcggcgcgcttcgccgcgagggaggcggtcctcaaggcgctggggacggggtttggaaacgggatcggcctcaaggacgtctgggtgtcgaggggcgagcacgggcgcccctcggccgtcctcgagggccgggcggcggaggtcgcccgggagcagggggtgagggaggtcgctctctcgctctccctcacgcgcgaggtcgcggtcgccaatgccgtcgcggtgacggatgccgtgcgtcccaaggtggacgagacgcccacccccgcccaggagatgcaggcttcgttcaagcgggcgcggtcggtgatcgacgagctcgagatgcttcaggatggaatagcggacacgctcgagggcggggcagagggtccctccgacgggagcgcgaccgacgagacgggggagtgactccaacagatgcagccagtacttaacgtggaggacgtccgacgcgtggaggcggcgctcaccgaggtgggcgtgagcgtctccgagctcatgcaccgagccggtgcggccgcggcgagcgaggttgcgcgcatggagggcgtcgacaccgtcacggtgctcacgggccttggcaacaacggcggagacggctgggttgcggccgagaacctgcatggcaaggggttcgacgtcacggtggtgacgcccgtcgagccggacgacctcaggggcgacatcgcgagggtcgtcgcgaagagcgcgcaggacagcggcgtcaaggtcgtggtgggccccccgcgcgagaccctcgacgtcctgctcatggggtcggacgtggtggtcgacgccatgctgggcacgggcttccacggcgagccccgcgccccgttcgacatctggatcgacagcgtcaacgcctcgggctcccacgtcatcgcggtcgacgtcccgtccgggctctccgcccagaccgggcttgccagcggcaagtacgtggtcgccgacctcacggtgaccatgctgtcgctcaagccggggctcctcttcgaccgcgggcgcgacgcctgcggcgcaatcgtggtggctcccctcgccgagcagaccgagcgcctggtgcgcgaggcggaccccgtggcatggcgtgccgacctggacgactacgtggacctcctggagcccccctcaaacgcggtggacaagttcacccgcgggtcggtgctggtggttggcggatcctcccgcttccccggcgccccgatgatggcggctatggcggcggcgcgcgcgggggcgggttacgtcacactcgcggtgcccgcgcagatcgcgcccatcgtgcagtcgcagatgctcgagatcccggtggtcgcgcttccctgcgaggcggacgggaccttctccctcaaggcggcggacctcgtcgccgagctggcggagaagcgctccgcgaccctcgtggggccgggcatgcgggtgacctcggggaccgtcgggatcgtgtcgaccctgctcgcgggcaagcgcccgctggtggtcgacgcggatggcctcaactgcatctctcgtctgacctccaaccgcgtggacgacttccccgagctgctccgtcgagacgcgcccctgatcatgaccccgcaccgcatggagctggcgcgtctcgtcggcctgcaggacactccgcccacctcgctcacgtctgcgatggaggcggcgaggcgcatcgtgtggtccgatggcggcagcgaggtgtgcgtggtcgccaagggctctgccacggcgtgcgtgagcgtggacgtggcgatcctccccaagccgggccccgcggcgctagccacagctggctcgggggacgtcctgggcggcgtcatggcggcgcttctcgcccgcaccggggtcgagaacgaggacctgccgctcctggcggccatggcatgcgagatgcacggctatgccgggaccatcgctgcggagcgctatggctctcggggggtcatggcgcgcgacatcatcgacgcgctggggcttgccgaggacgcctttgaggaggaggtcgcgtttcccgacgcgacgaagtcgggtcgcgagggaaggcgcgaagacgatgcggatggcaagggtgacgagtagcgaccgaggaggatcgatgccgagcttcaagaatcccgcggacaggtgggcctggatagaggtcgacctcaacgcgattcgcaagaacaccagggcgttcaagtcgctccttgcccctggcgtccagatgatgtgtgcggtcaaggcggatgcctacggccacggcgcggtcgagtgcaccaaggtcatgcactccgccggggccgaccaatttgcggtcgccacggtcaaggagggcgtcgagctccgcaaggcgggcatcgagtggcccatcctgatgctcaacgagtgcccgctcgaggcgctggacacgctcctggagtacgacatcatccccgccgtgtacgatacggagttcgcgcttgcctacggcgagagggccgtggccgccaacaaggtgggcaagtaccacctggccatcgacacggggatgagccgcatcggcgtcatgccccaggacgtcgtggaattcaggcacgtgatcgacttccaccgtggcctcgaatgtgcgggcaccttcacgcacttcgcgaccgctgacgtgatcggcgactgggacttcaagcagcagagcaagcgattcatggactccgtgggcgcgctgcgcgatgccgggtacgaggtcggcctcgtgcactgcgacaacaccccgggcaccgtgctgcaccccgagctccacaacgacatgtgccgcgtgggcatcggcctctacggcctgcagccgtccgagacgaccgcgccgcgcattgccctgacccccgcgatgagcgtgcgcgcccgcgtcatgcgcgttgccacccccggcgtgggcgagggcgtgggatacgggatgacctatcgcatcccgcggcccaacacccagattgccaccgtccccattgggtacgcggatggtctcgcccgctccctctccaacaacatggacgtgatcgtgaacggctccaggacccgccaggtcggtcgcatctgcatggaccagttcatgttcgcggtcgaccccaacatgcgcgcctaccgccagacccaggaggtgaaggtgggcgacctggtcacggtcatgggccgcgacggcgacgaggagatcacggcggacgagatcgcgaggcgccgcgacaccatcaactacgaggtcacctgcaactttggcagcatgcgcctggaccgcgtgtttgtgtaggaggttggccatgtcggtgatgcacattcccggccacgagcaccaggggccgcgcgaggtgaccctggaggaggttcgtgccaccctgggcaactgcgagctgtgcccgctatgggagacgaggaacaacatcgtctttggcgtcggcgacccgcacgcgcgggtgatgttcgtgggcgagggtcccggcaagaacgaggacctgcagggagagcccttcgtgggggccgcggggaagaacctggaccagctcctggggctcgcgggcctcaagcgcgaggaggtctacatcgccaacgtggtgaagtgccgcccaccgggaaaccgcaacccgcggcccgaggagatcgaggcgtgctcgccgttcctgcgcgagcagatcaggtccatctggcccgacgtgatcgtgtgcctgggcaactttgccgcgcacttcgtgctccgcaccgaccagggcatcacgaccctgcgcggtcgcttccaccagacggggcacttctacgtgctcccggtgttccatcccgccgccgccctctaccacagggagtggcagcagtacctggacgacgacttccgcctgctcggccaatggctccaagaccatcccagggaggcgtaggcgatgggaacgctacctagcatcgaggcgcgcgggacgtacctctcccgcgaccgcgactccaccatcgcgctcggggaggtcctgggcaccctgctcggggagggcgacgtgctggtcctcacgggggacctgggcgcgggcaagacccagctcaccaagggcatcgcgcgggggatgggcgtgacggacgacgtcacgagtcctaccttcaccatcgagatggtctaccagggctccgagctgcccctctatcactttgacctctatcgcctcgacgacccggaccagctggacgacacggggctcttcgacgtcctcggctccgacggtccctgcgtcatcgagtggggcgagcagtttgccgagcagataggggacgagcgcgtggacgtgttcctctcccgtctggacgacgaggtgggcgcgggggtggagccgccccggcgcatcaggcttcaaacgcatgaccggcgtggcgaggagctggtcaacgccctggatgctgcggtggccgccaggcgctagactggatgggttggctcccagacgtcgagaaggggcgcagagatgacccagacaaccagccagagcgcaaacggggcggacgagaggaccatcctggccatcgacacctcgacggacatgctcgcgtgcggggtcgcccgcgtgcgtgacgggcacatcgagatgctcgcgagtggagaccacctctgccgtcggcaggcaaacgtcgagctggcgcagaccgccctcgactgcctggggcgggcgggcctctcgatgtccgacgtggacgaggtgctcgtgggccgtggccccggatcgttcaccggggtgcgcataggcatcgccaccgccaagggcatctcctgcggcatcggctgcccgctccgcgggggttcgacgctcgactcggtcgcctggggcgtctggaaggacggctaccgcggcaggctcgccgtcatcggagacgccatgcgcggcgaggtgtatcccggcgtgtatcgcgtggacgatgcgggggcgcatagggagttcgaggcggaggtcgtgctgaaggctggcgcagcggtggagtcgctgcgcgcgcgggcggactccgcatccctcctcctcgccggtgacggcctcaagaagtaccgtgaccgcttcgaagcggcggggtttgaccactttgcggaggagcgcctgtggcaccccggctcggagggactcgtgaggtccgcggaggcgcccgactggcagtcgcccgtgggggacggtgaccccgccctggtgctgcccgtgtacacgaggctctcggatgccgaggagaacgagcgcaagaggctgggcatgagcgagcccgccagcgtggaggtcacgggcgtcgcggatgcgctcgccgaccggcacctgcagctgcggccgatgtcggtgaacgaccttcccgccgtcgccgccctcgaggcggaggcctacgcgtccgccggccacacgccctggaccgaggggatgttctacgacgagctgtcgcagccgcagcgcagctggtgggtcgcccacgaccagggagaggtgatcgcgttcgcggggggcatgctcgccggctcggacttcgaggtgagcgaggtggtcgtctccccaagccgtcgccgccaggggattgccacaaggctcctctcccgcatcgcatatgacggccagacgctgggggcctcgaccgtgtctctcgaggtctcggagggcaacgcgcccgcccgcgccctctacgaggggcttggcttcaggcgggtcgggatgaggccggactactacggcaagggggacgacgcgctcgtgatgcgcgccgacctccccctgcgcgcgtccgaggggcttgccctggagcacgtcgagccccacgcctccatccgcccctggcccatcgtcccgcgtccccggagccaggcggagcgagacgcgatcaaggcggcgggccccctcgtcctctccatcgagtcctcctgcgacgaaactgccatcgcggtcatcgacggcaggggcgagatctgcgcaaacgtggtggcgacctcggtggacttccacgcgcgctttggcggcgtcgtccccgagatcgcgagccgaaagcacgtcgaggccatcgtgggcgtgtacgaggaggtcatggcccaggcgggggcccaccttggggtggacacgcttgccccctcggacctctcgtgcgtcggcgtgacggcgggtcccggcctcgtgggcgccctcgtggtgggcgtcgcgtttgccaaggggctgtgcgcctccacggggctgcccctcacgccggtcaaccacctggaggggcacctcatggcaaacctcttccagacccccgacctgcagccgccgttcgtcgccagcctggtctcgggcggcaacacgatgctcgtccacgtgaggggctggggagactatcaggttctgggggccacgatcgacgacgcggtgggggaggcgttcgacaaggtcgcgaaggccctcgggctgggctatcccggcggcccggtcatctccaagctcgcagcaagggggaacaagaaggcaatccacttcccccgcgcgatgatgcacagccatgactacagcttctcgctctccggcctcaagaccgccgtgatcacgtacatcgagggcgagaaccgggcgggacggcccatcaacctgcccgacctcgcggcctccttcgaggcggcggtgattgacgtgcaggttgcgaaggcggtgaccgcggtggaggagacgggcgtctccgacttctgcgttggcggcggcgtggcggcaaacccccagctccgcgaggcctatcgcaagaggttcgggcgcatgggcgtgagggtgaccgtgccgcccatggtggtctgcggcgacaacggggcgatgatcgcggtcgtcgcgctcaggaactatcgtgccggcgtcctcgcggacctctcgctcgacgccaaccccaacgctcaccttggctgctggtcgagcgaggtcgccccgatggtctccggcgagtggccgcaggcaaagaggtcgtagcgtctcaatcgatttacgacgggcgcgtgccgggccggccattccactacggagtggccggccttttttgcgtaatcgatacacgtattctcaataaaatgaaattcaatatgataaacctcggaaacatgaagacaaaaccgtatattctcggttgctagaggatttcgatggcgaggacagctgaaccttttccgaacgaagccctagagtgtcctgacaacgcacggagctttctcgcatctggttgcaagggggaggggaatgggtcccctccggttgcgtgcgcgaagggagacggaagaggacttcgagggaaagagggctcgcatggaaggcacatctcgacatcgcacggaaccccagacgtcaatccacggaagcggcggagtctcccgccgcgaattcctcaggctctcgggactcacggccttcagcgtggcgggcgtgggcttcctcgcggcgtgcggccccgcctcgcagggtacgagctcgggctccgatggttccgactcgagcggctccggcagcgaggtgctgggcgacggcaagaccatgcgcgttggcatggaggcggcatacgccccctacaactggcaggcaacggagtcatccgacaccaccatccccatccagaacgtcgacggcgcctacgcggacggctacgacgtccaaatagccaagaagatcgccgacaagcttggcatggaccccgtggccgtgaagatgaacttctcgggcctcatcgacgccctcaacaacggccagatcgacatcatctgcgccggcatgagcgccaccgaagagagaaggaagtccatcgacttctccgacgcctacttcacgggtggctttggcctactggtccagaaggggtcgaagtacgcaagcgcaactagcctggaggacttctccggcgcctcggttctgggccagaaggacaccaacctcgactacatcatcgacgacatcccgggcgtcaaccacctcacgcccgtcgactccgtccccgcgcagttctcgcagctcactcaagggacctgcgatgccatcaccttcaacaccgagaacaccaagggcatcctcaaggcgtaccccgacctcgtcgtcgtgccgtttgccgaggggaaggggttcacggaggtggccaccgtcaacgcggggctcaagaaggggcaggacaagatcctcgccaaggtcaacgaggtcatcgacgccatctcggacgacgagaagcagaagctctggaacgactgcatggatcgccagccctcgtagggaccacggttggccgtggggaggggcccacgttgcggatgccggatcgcacggtggagccgctcgccgaatcctcctcgtcccgcacaaaacttggtcgatggcatatcttggctcgttaaatagttgaattctcactttgatgaaatttttgacgaataaattcgaaaacgagagaacggaactgtatatttccgatttccggagcatttcggtgacaaaagaagctgaaccctcgcccgacaaagtcctagactgtgctctcagcgtacgggactttctcgcatttggttgcaagggggaggggaatgggtcccctccggttgcgtgcgcggaagggaaaccagggagcgttttgcaggaaagaggattcgcatggaagacaactctctacatcgcacgggcgcaaaggcgccaaatggcaacggcagcgggatctcccgccgcgaattcctcaggctctctggcctcacggccttcagcgtggcgggcgtgagcttcctcaccgcgtgcggccccgcggcgcagggcacgacctcaagctccacgagctcggactccgactcgagcagctccggcagcgaggtgctgggcgacggcaagaccatgcgcgtgggcatggaggcggcatatgcgccgtacaactggcaggtgtccgaggcctctgacaccaccatccccatccagaacgtcgacggcgcctacgcggacggctacgacgtccagatcgccaagaagatcgcgaatgcgctcaacatggagcccgtcgccgtcaagatgagcttctcgggcctcatcgacgccctcaacaacggccagatcgacatcatctgcgccggcatgagcgccaccgacgagcgcaagcagtccatcgacttctccgacccctacttcgtgggcgggttcggcctcctcgtgaagaaggactccaagtacgccaacgccaccagcctggacgacttctccggcgcctcggtgctcggccagaaggacacgctgctcgacaccgtgatcgacgagatccccaacgtcaaccacctcacccccgtggactccgtcccctcccagctgtcccagctcaaccaggggacctgcgacgcaatcacctacaacacggagaacaccaagggattcctcaacgccaaccccgacctcgtggcaatccagttcaaggacggcaagggcttcaaggagaccgtcccctgcaacgcgggcatcaagaagggccagaaggcgattctcgccaagatcaacaagtgcgtcgacgccatctccgacgacgaacgccagaagatcttcgacgactgcgtggaccgtcagccctcgtaggcggcttcctccaatcacgtatccatgcgatgtgccccgcgcgagcggggcccattgcttacggacgggtcattctgaccagggccgagggtctgcatccgtccgcccatcacctcggcaggcaacgacgagaggggtcttatggggtccacgaccaagggtggcctaaagggcttcctggcggcagaccaccgctatgtgttcctcgggacgagcgttatcgcgctcatgggcatgtggctctccatgcagccaaggagcacctggagcttcctcgcgggggtgtacaccctcgaggtggtcatgtactacgttctgctcgcatgggtggtggtctcgctggtcgccctggtgaacaagctcgtgaggtggcgtgactacgcaggcgcctcgccgttcaccaagccggtcgcaaagagggcggagaggatcgcctcctacgtggtgtgggcgatctcggccgtgctcttcgcggatcgtgcgatcatgggcttctgcgcgctcgtgtcgtcgagcatcgcgtcggactccaaccccagggacttcctctcgagcatggtctacatggcctacgagggcaggggcgtgttcgcccgaggcatcgcgagcaccatcgagctggccatattcggcaccgcgatcgccttcttcctcgccatcctgctcgtgttcctcaggatccagcagatcgaccgtcccgacaacgacttcgtgcgcttcctcaaggtcgttggctgcggctttgccaaggtctactccgcggtgctgcgcggcacccccatgatggtccaggcgatgatcttctacttcgccggcttcgccgccttcaggagcacgggcatgagcacgggagaggtcagcgccatctggagcaccttcgtcgccggcctggtgaccatctccctcaactccaccgcctacatgatggaggtcctgcgcggtggcatcgagtcggtcgaccccggccaggcggaggcggctcgctcgctcggcctgtcccagtggcaggcgatgaccaaggtcgtcttcccgcagggcatcaagaacgccatcccggcgctctccaacgagctggtcatcaacatcaaggactcctcggtcctctcggtcatcggcgtcttcgacctcatgttcgccaccaccacggtcgcgggcatctactaccgccagctcgagtgctacgtcttcgcggcaatctgctacctgatcctcacgatgatcgcgtccaagatcctctccgcgctgtccaagcgcctcgaggtccgcaacccgggccccgtgctggggacgtctgacgtggcggcgacgaccggcgtggcgggcgacaaggcggacccccagagggtctctgccctgcacgaccagaagcgcgacgggacgaaggggtaggtggcacagatggcagaggataccaaggcgcagcccgtcatcagggtcgaggggctacgcaagtcgtttggcgcacacgaggtcctgaagggcatcgacttcgaggtcatgccgggcgaggtcgtcacgatcatcggggcatccggctcgggcaagtccacgctcctgaggtgcatcaacctgctcgagactcccgactccgggcatgtgtggtttcacggggaggacctggcggcagagcacgtggacgtgaacaggctgcgcgagaagatcggcatggtgttccagggcttcaacctgttcaacaacatggatgtcctggacaactgcacccttgcccccgtcacgctcaagaagatggggaaggcggaggccgccgaggtcgcgctctcgcacctggaggaggtcggtctcgccgacttcgcccatgcggacgtcaactcgctctcgggcgggcagaagcagcgcgtcgccatcgcccgcgccctgtgcatgaagcccgacctcatgctgttcgacgagcctacgagtgccctcgaccccgagatcgtgggcgaggtcctggaggtcatgcgctccctggcacacgacggcatgaccatggtggtcgtgacgcacgagatggcatttgccaagaacgtctcggacaaggtcgtgttcatggacaacggggtgatcgccgagcagggctcgcccaagcagatgttctccaaccccaggttgccgaggacgagggagttcctctccaggtacctggacgacccagagaactagccagcgggccccggcggcgacgtcggggccctcctctacccatggccgcggcgcgtgcgtgcgtcgcggcggagcataggagatggtcgcatggcagacgtgtggagctactttgcgaacgagggcgactacccggacctgggggagggtgccctggcggaacggcttgccgcggcgctcgccatccccacggtggacgggaggacggcggacgagacggactggacccagttcgagcggctcgtcttgctgtttcgggagaactacccgcgtgtgttcgcggcggcaagcgaggagcgggtggaccactccctcgtcctgacgatcccggggagcgacccgtccctcgaccccgtggtcttcatggggcacatggacgtggttcctgtggtcgagggaaccgagggcgactgggaccacggccccttctcgggcgacatcgcggacgggtacgtgtggggcaggggtgccctggacatgaaggatcaggtcgtgggggagctcgaggcggccgagtacgcgctctcgcacggctgggagctgcgccggaccctcatgctctgccttggccaggacgaggagtcgttgcagaccggggcacgggccatcggcaggatgctcaaggagcgcggtaccagggtcgagttcctggtggacgagggcgactacctggttgccgacaccgccccgtatggcgtccccggccaccatgggctccgcgtcaacctcgcggagaagggctatgcggacgtgcggctgaccgttcggggggagggcggccactcctccaacccctttggggggaccaccctcgccatcctcgcggaggcgatctcgcgcgtcgccaacgattcctggccggtcgagctgacggagctcgaccgccagatgctcgccgccgtggcgccgtggatcacctcgggcccgctcgctccgctcgtgtcgccccgcccgggcgagacgcaccgcgacgccatcgaccgcaatgccgacgggatcgcccaggcgtttctccgcgacgccgacctgttcccgtttgtgaccaccaccgtcgcccccaccatgatcgagggcgggtcgcagcaggcaaacgtgatgccgcaggacatgaccgccaccatcaacttcaggatgctgcccggcgtggggtgcgaccgggtgctctcccgcgtccgcgagctcgtggcagacctgcccgtggaggtggagcttttggaggacgtgagcaacgacccgtccaagacctcgcgctccgacggctggggcttcagggtgctggagagggtcgcggcgcgctacttccgcgagccggggggaggggagcccctggcgctgatccccgccatggtgtgcggtgcgtccgacgcccgcatgtacgagggggtgtgcgactcgtgcctgcgcttctccgcgttcgtggcggacgacgaggaggtcgcgcgcggggtccacggcaccaacgagaggatcacgacccgcgcatacgcgcagggggtccgcttcatgatcggcgtcatccgggaggcgctcctgtaggggcgttcccgggactatagtgtggccggacggcaacttagtggaagggttgggcacatggcacgttccgtcgtcagctcaaggcacgtctatctcgacctcgcacaccccgacgtggcggcggacgtcgtcatccagggggaccacgtggaggcggtcctcccgtacggccgggccgatcgctcccaggcgggcgaggtccgcgactttggcgacgacttcgtgtgcccgggattccacgacgcccaccagcacgtgctccacaccgccctgttcccctcgtcgctcgcggaccgctatcccggcacaagcgaggcggactgcgtggagaggctccgcgccttcgcactcgcgcatcccggcgacggctggctcatctcccagggctggcgctcggctctctgggaccccgccgtgccccctacccgcgactcgctggacgctgcgttccccgagcggccggtcgcgatgtgctccggcgacctccacaccctctggctcaacaccgccggcctccgcgccctgggcatcgcggaggatgcggagccgccggcgggaggcatcttcgaccgcgacgccaacgggcgtctcaccggcgtgctccgcgaggcggcgggcatggtctacaccgcacgggtgttctcgcagatacctcgcggggagctcctgtccatctacggcgactacttccagcgcatgctcgcccagggcgtcacgagcgtctgcgacatggccctctccgccgcccccggggcggacaatgtgagggaggacgtgtacgagggtctgttggcagacggcaggcttcccatgcgcgtgaacatgtttccgcagctcgtggggaacttcgatcgcattcagtcgctccaggcgcgccttacggggccggtcctgcgcgccccgggcatgaagcagttcttcgatggcgtctcgagcgcgcatacggcctggctcacggagccctacgccaacccgtacttccccggcgactgcggcaggcccacggtcgaccccgagcgcatgcgcgagctggtgctgggtgcggcgagccgcggaatagccgtccgcatccataccatcggcgaccgcgccatccacacggcgatcggcatcttcagggaggcgtacgagcgctacggagccccccgccagggcgccaactcgctggagcaccttgagaacctgcttcccggcgacgtccaggccctccgcgacgcccacctggtggcgtcggtccagccgcagcacatcgtgatcgacgtgacgcagcccgaccgcgacctgggaccggagcgcgcaagcctgatgtggcccttcgcgagctatcgcaaggcgggcgtgaccatggcgtttgggaccgactcgccctgcgtggacccgctctccatggaggtgctgggctgcgccgtcacgcgcgaggacccgcgcacgggggagccgcgcgggggctggctgcccagcgagcgcatccccatggacgtcgcgatcgacgcgtacacgcgggggagcgccgtggtcgccgggcgcgccgacgagctgggcacgctcgcgccgggcatgctggccgacctcgcggtgttcgaccacgacctcatgtccacccccgccgagcggctgggggacgtccaggcggtcgcaacgtacgtcggcggcgccctggcctgggagcgatagccgggcgggggtgcccgcgcccctctcgctggcatatgattgcagtcgtcgcccagctaaggaggagccatgcaagacggattcgtcaaggtcgcagcacgcacgcccgaggtcagggtcgccgacgtgacctttaacgtggacgcctgcgccaaggcggtgaggcacgcctgcgccatcgacggcgccaaggtcgtggccctccccgagcttgcggtgtgcggctacacctgcgaggacctcctgtggcaggacgagctgctcgacgcctccgagcgcggcgtcgccgagctcgcgcgccgctgtgccccctacgacgccctcgtgctggtgggcgccccggtgcgcgtcgcctccaagctctacaactgcgcggtcgccctctgcggcggcagggtcctgggcatcgtgcccaagcagcgcatccccaactacaacgagttctacgaggcacgtcacttctcgcccggcccctcgcgctgcgtgcggatgtcgtttgcgggggagacggacgtgccgtttggggccgacctcctcctcgcctgccgtcagctccccgagctcgtggtcgccgccgaggtgtgcgaggacctttgggtcgccaacccgccctcgacccgtcatgcgatggcaggggcgacgctggtgtgcaacctctccgcgtccaacgccatcgtgggcaaggcggactaccgccgctccctcgtggtggggcagagcgggcgccttgcctgcggctacgtgtacgtgagtgccgggtggggcgagtccacgcaggacctcgtgttctcgggtcacgacatggtggccgagaatggcgcgctgctggcggaggggcgtccctttggggcggggagcgccacgagcgaggtcgacgtgaggatgctcgccgcggagcgccggcgcctctcgacctttgcggtggatgcctcgccggaggagtccggccacgtggtcgtgccctttgacctgcaggcggagcagaccgacctcaccaggttcgtcgacccgcatcccttcgttccctcggacgtcgcccgcagggaggagaggtgcgaggacgtgctctcgatccagaccttcggcctcgccaagcgcctgcgtcacaccggctcgcagtgcgtggtgatcggcgtctcgggcgggctcgactccacgcttgccctcctggtctgcgcccgcgccttcgacgtgctggggatggaccatacgggcatcctcgcggtgaccatgccgggctttggcaccacggaccgcacgcatggcaacgcaaccgtgctggcggacgccctgggggccacgctgcgcgaggtgcccatcgccgccgccgtgaggcagcactttgcggacatcggccacgacgagcgcgaccactccgtgacgtacgagaacgcacaggcgcgcgagaggacccagatcctcatggacctcgccaaccaggcaggcgggctcgtcgtgggaacgggcgacctctccgagctcgcgctgggctgggcaacctacaacgccgaccacatgtcgatgtacggggtcaacgcgggcgtgcccaagacgctggtgcgccacctcgtgcgctatgtcgcggacaccaccgactcctccgagctcgcagaggtgctgggcgacgtcctcgacacgcccgtctcgcccgagctcctccccgcgacgggggacggcaccatctcgcagcgcaccgaggacctcgttggtccctacgagctgcacgacttcttcctctaccaggtgctgcgccgcggcttccctccccgcaaggtgtaccgtctggcccgccatgccctgggcgagaagtacgacgaccagacgatcctgcggtggctcaagacgttctaccgccgcttcttctcccagcagttcaagcgcagctgcctgcccgacggccccaaggtgggctcggtcgccgtgtcgccgcgcggcgacctccgcatgccgtctgacgcctgtgccacgctctggctcagcgagctggaggacctgtagggttgtttcacccccacggggatgcaacgcagacgctcatcttctctactaggggatgggtgagaaaatctaacttgaacgactaagattttttctctcccgttgtttaagtccttcgttctgggtaatattcacaacgttggctgagcgagcggggcgcaagccccgtcctgcgaaatcaggcaccagcgtggtgccccagaaggaggtacttacctatgacactgaagccactgggcgatcgagtcctcgtcaagcccgcccccaaggaggagaagacctctaccggcctgtacatctcctcgggtgcccaggagaagccgcagcgcggcgaggttatcgccgtcggcgccggcaagctcaacgacaagggcgagcgcgttgcccccgacgtcaaggttggcgaccaggtgtactacggcaagttcggcggcaacgaggtcaagatcgacggggagacctacctgctcctccgtgccgacgacatctacgcgatcattgccgagtaagcaaggttattggatataggtacctcgcgtacccatttggaggaagcagacaatggctaaggacattacttttggcaccgacgcccgcgccaagctggccaagggcgttaacacgcttgccgacgccgtgaccaccaccctcggccccaagggccgctacgtggcgctcgagcgctcctacggcgcccccaccatcaccaacgacggcgtctccgtggccaaggagatcgagctcaaggaccccgtcgagaacatgggtgcccagctggtgaaggaggtcgccaccaagaccaacgacaccgtgggtgatggcaccaccaccgcgaccctgctcgcccaggtcatcgtgaacgagggcctgcgcaacgtcgccgccggcgccaaccccatcgccatccgtcgcggcgtcgacaaggcagtcaaggccgccgtcgaccagatgaagtcctctgcgcaggacgtctcgaccaaggaccagattgccgccgtgggcaccatctcggccggcgatcccgagatcggccagaagatctctgacgccatggaggtcgtgggcaaggacggcgtcatcaccgtcgacgagtccaacacctttggcatcgacatcgacaccgtcgagggcatgcagtttgacaagggctacatctccccgtacttcgccaccaacaacgacaccatgacggccgagctgcagaacccctacatcctgatgaccgaccagaagatcagcaacatccaggacatcctgcccgtcctcgaggccatccagaagagcggctcgccgctgctgatcatcgccgaggacgttgacggcgaggccctggcaaccctgatcctcaacaagctccgtggcacgctgcaggtcgcggccgtcaaggcccccggctacggcgatcgccgcaagcgcatgctcgaggacatcgcaatcctcaccggcggtcaggttgccatgaaggagcttggcgtcgagctcagcgacgtcaccgccgagatgctcggccgcgccaagtccgtcaagatcaccaaggacaacaccacgatcgtcgacggcgccggcgccaaggatgccatcgaggagcgcatcgcccagatcaagagcgagatcgagcacaccgactccgacttcgacaaggagaagctcaacgagcgtatggccaagctctccggcggcgtcgcggtcatcaaggtcggcgcggccaccgaggtcgagctcaaggagatcaagcaccgcatcgaggatgccctgcaggcaacccgcgctgccgttgaggagggcatcgtcgccggtggcggcgtggcgttcctcgaggccgccaaggcgctcgatggcgtcgagaccgtcgacaacgacgagaagatcggcgtcgacatcgtccgcaaggcgctgcaggcccctgtgaagaccatcgcctccaacgctggctacgagggctccgtcgtggtcgagaagatcaagaccctacccgagggcgagggcctcaactccgccaacggcgagtggggcaacatgatcgagatgggcgtcctcgaccccgtcaaggtcacccgcaccacgctccagaacgccgcgtccgtcgcgtccctgatcctcatcaccgaggccaccgtctcggacgagcccaaggacacctccatcgaggacgccatctcccgtgcggccgctgccggcggccagggtggcggcatgtactaagccgtcaggcgatgcgagagaccatcgcgcacaggctggaccccgcgacccatctgggctgcggggtccttctcgtatggcggggcgtgaagccgcgggggtacgtgcggctccgctggcgaggcgtagtagaatgggtgactgcacgcgcggcgcaaaagaggggagagggaccttggcagagcgacgcgacatgatcgatgacctcatcgacatccagaacgacttccaggcgatccagaaccccctcgggggcatcgccaacacgctttcgaccgacccatcccaggtgaaggtgtacaacccggcggactacaaggagaagccccggcccaactccgtgtactgcctgcgtgtctcggccaagagcgatgccgcgtgctccaagtgcttcgacgtgtgccccgtggacgccatctccatccaggggtcctcggtctcgatcatggactcgtgccgcaagtgcggcctctgcaccatggtctgccccaccgagaccatgctggcgcagaagatcatgtcgcagcagctctacgacaaggtcgcgcgcatcgcctcggcatacgagaagtgctacgtaacgtgcacgcgcgccctggggaggcttcccaaggacaacgaggtgcttctcccctgcgttggcgccgtcccgtacgaggcatggttcgcgctcctcaccgagtttgacaacctgagcgtgtaccttccgctgggcatctgcgaccgctgccgcacgaccaccggcgaggaggcgtacgttgaccagatcggccaagccgaggagctgagcggcggcgccgtggacctggaggtcgacgagtcggccatgacccacgagcagacccgcgcctacaagcgcagccagttcatgagcaacgtggcgcaggcgggacaacagctcgtgacgcggtcaaaccccaccctggcaggtgcccaggcggtcgccaaccgcatccgtgcgcactcgaggcagctcaccgagatgcagcgctcgctcgagcacgaggttggcgtcaagacgcagctcaaccgcaggcgcatcctcacgcagaagcgcaaggtgatgctcgtggctattcagcagcagcccaagctcgccaagggcttccacctggacgtcccggtgtgcgactcgtccaagtgcaccaactgcggcgactgcgtgcgggcgtgcgtccaaaacgcctgcgacctggacgcgtcggggcacttctccgttgcctccgcgtactgcgtgaactgcgcggcgtgcgtggtcgcctgtcccgagggggcgctccacatggaggagtgcgacagcgcggacctggtcgttcgcgacgaggagaaggagcgtcgcgagcgtgaggccaaggcgcagcgcgaggcgctgaagaaggccaaggagcagggcaagcgcgcactgaacaaggggcttgacgccatagagcgcctggccgacgagtaggaccggcggaggctccgccacaagacacaggagttgaggacgtggcactttccattggcatcgtgggacttcccaacgtgggcaagtcgaccctctttaccgctctcacccgcaagggcgggctggcggcgaactatcccttcgccaccatcgaccccaacgtgggcatcgtggacgtgcccgacgagcgcctgcagaagctcgccgacatcgtgcaccccgcccgcatcgtccccgcaacagttgagttcgtggacatagcaggcctggtgcgcggcgccaacgagggagagggccttggcaaccagttcctctccaacatccgcaacaccgatgccatctgcgaggtcgtgaggtacttctccgaccccgacgtggtgcacgtggacggcagggtggaccccgcgtccgacgtcgacaccatccagaccgagctcgtgctcgccgacctcggcaccctggagcgcgccatccccaagctggagaaggaggccaagcgcgacaaggagaaggcccccaacctcgccatcgccaagcgcctgcaggagtggctcaacgagggcaacagagctgccgaccttgacatgaccgacgacgagcgtgcggcggcgcacgacctcttccttctcaccatgaagccgatcctctatgtggccaacgtggacgaggacgcccttggcaagcccgtggcgcaggtcgcgggacaggaccccatccccatctgcgccgaggtcgaggcggagctcgccgacctcgaccccgaggaggcccgcgagtacctggactccctcgggctggagcacagcggcctcgagaccctggcgcaggcggcctaccgcctgctggggctgcagagcttcttcaccgctggcgagaaggaggtcaaggcctggacggtccgcatcggtgccaaggcacccgaggcggccggcgtcatccactccgacttcgagaggggcttcatcaaggccgagaccatcagctacgaggactacgtgtctctcggcggcgagcagggcgcccgcgaggcgggcaggctccgcatggagggcaaggactacgtggtccaggacggcgacgtgatggtcttccgcttcaacgtgtaggatgccattcgctccgcgcgaaaccacatgcacgaaccaataggggagagggccaacgcaaccagcgccggccctctctcgtatcgcatgaaggtgtgatgctagttgccgctcgaatagctgccgtagccgcttcccgaaccggagcccgaccccgaggagcccgaaccagacgaggccgggccagactcgctcgagctccagccgctgcccaggaccacgatgatgtcggcgcccgtggagtagctcccgtcgtttgcctggacgctggtgatccccagcttgtccgctaccgcctgcgcctttgtctgggcgtcgctcccgttgtagacgaccgttgaggtctgcgtcacgtaaccgcccgtcttgggggttgcggtgaagcccatcgaggcgaggttgttagaggcgctggtggctgagccgtcggcggcgccggcgttgagcacgaccacggtgcccgtgtaggtctcgctcgtgctgctcgacgacgagctgtcgctgccatcgctgctgctggagtcgtagctcttgcccacggagcccgcgacgccgctggtggtgtcttggctggagtcggtgtagggcgtctcgccggcgtccacgcgcttcatgatctgttcccactcgctggtgttgacgacctcgtaccaggtgttgttgacgtactcggaggtggtggggagctggccggagtacacgtcgctgtcaacgtccatgcccgagaactgcgtggccaggctcacgatggaggccacgtccatgtcggtggtgacgtagctggccatggtcgagaccgtggacgccatggtcacggggtcgctggcaaggaccttcttgatgatggctccgatgaccatgcgctggttggcagcacggtagaagtcaccgccgccgtagttgtcgtaggcgtggcgcgcgcggcagagcagggctgccgtggtgccgtccagggtctgctcgcccgcggggaggtccaggcccgtgtagttggggtcggacacggcgacgggaaggttcacggtgacgccgccgaccttgtccacgatggaggcaaagccgtccatgtccacctcggcatagtgcgagatgtcaacgccggcgagcttggagacgatctgggtcacgtacgccgcgccgccgatggagtaggctgcgttgatcttctgcgtgccgttctcgcccatgtcaaccatggtatccctggggatggagatcagcgtgaccttcttgttggaggggtcgatgcgggccaggatgatcgtgtcgctgcggtaggcgctgtcgctcgtgccgtactcgccctcctcgcgctcgctgtccttgtcggtgcccaggaggagcatgtagaacggctcgttgtagctcgtctcggtgagcgtgtcgcgaaggctgctgtcgacgccgctcgagagcttgctgttgatgctgtggatgtaggcggccacggcgatggtcccgctcgcggcgaccgccaggaccgtgatcaggacgaccttcagcacgcggcgggcaccgtgcgacttcctcttgctcgcatagtgctctgcgccgtgggcgcgcgagagctcctggaagttaggctcgctcgacttgccggaggcactgcggccctgctcgtcttccttgttgcgtctatgcatgggtaagctcccgccgttccgttcgatttcgccttattcgtagtcggagcccactatgaccaccacgtccgtgctcgtggggagggccccgtcgtttttctcgtatcctaccttctcgcccagcgtctttgccacgccggtggcctctgcctcgttatctccgttataggcgacgtaggtgaggtccgacttgtgcgtggcggtgttggcgctggcggtgaagccggcgtcgcccagggtctgcgcaacggtgccggccagcccatccgtcgacgttgcgttgtacaccgcaacggttccggtgtaggccgcctcgacgttggagtcgctgggcagggtgaggttcttctccgtggaggatgatgcggagctgccgtcggtcgacgccgagaccccggacgacgggtcgtcgctcgagctctcgtagggcgagaggcccttgtcgacgcggtccatcatcgccttccaggcatcctggttcacgatctcgtaccaggtgtcgttgatgtacttggacgtggtgggctccatgcccgtcatcacgtccttgctggtgtccatgccggcgaacttgccggcaaggctcacgatggagttgacgtccatgtcggtggtgacgtagcccgccatggtcgagaccgtggacgccatggtcacggggtcgctcgagaggaccttcttcagcacggcggtgatcacggcgcgctggttggccgcgcggtacaggtcgccgtcgccgtagctgtcgtaggcgtggcgggcgcggcagaggagggccgcggtcttgccgtccagggtctgcttgcccgccttgaggtcgagtccggtgtagtcggggtcgtagacgtcgatgggcaggtcgatggtcacgccgcccaccttgtccacgacggcggcgaggccgtccatgtccacctcggcgtaatgcgagatgggcacgcctgcaaagtccgagatcacctgggtggcgtaggaggcgccgccgatggcgtaggccgcgttgatcttctgggtgccgtacgaccccaggtcgaccatggtgtctcggtggatcgacaccagcgtgaccttcttgttggtggggtcgatgcgggcgagcatgatggagtcgctgcgatacgagctgtcactcgagccgtactccgagcttgcggcgcgcgcctcgtccttgtcggttcccaggaggagcatgtagaacggctcgtctcccgaactctttgagagcaccccaaagagcccgctgtccagcccgctcttgagcttggagttgatgtcgtggacgtatgcgaaggcgcctcccgcgaccacggcaactgccacgaggattcccacgacgacgttgcgtatccgcgacctgcgccggatgcggttcttgataacataacgggccgcagagccgtctcgagagagttcccgggcgtcgacccccctggcctcgggatctgtgctcttcctcttacggaacaagagcgctcctttggtggcgcggcgtgacgtgcctgttcgttaagcccaaccagaatatggtagacgcggagcagggcgaacgcatgaagtacataaatgcaagcgtgcctttacggcaagtcggcttcgtgccgtagaatggctgcggacactagtggaggccgcctccaccgggggtgatggcccccggcggcccggccataggaacgggagcatccatgcaggcaaacaggcccgcccagttcgttgccgtgttcgacttcggagcccagtacgggcagctgatcgcgcgtcgcgtgcgcgacctgcacgtgtactccgagatcgtcccgtgcgacaccagcgcggaggagctcagggcaatggcgccctccgcaatcatcctctccggcggtcccgcctcggtgtatgccgacgacgcgcccgacatggacgccgcggtcttcgagcttggcatccccgtgctcggcttctgctatggtcagcagatcatggcggtcaagctgggcggcaaggtcggtcacaccgagaagggcgagtacggcccggcccacctcgtccgcaggggcgagagccgcgtcctcgaggggacgccgcaggagcagaccgtgtggatgagccaccgcgacgccgtgagcgaggtgccccagggcttctccgtcacctccgtcaccgacacctgccccgtcgcctccatggaggacgcctcgcgcaacctctatgccacccagttccaccccgaggtgcgccacaccgagtgcggcaaggcgattctcagcaacttcctcttcaacgtctgcgggctcgagcccagttggaccatggagggcatcatcgaccagaaggtggaccagatccgccgcgaggtcggctcccgcaaggtcatcctggccctctcgggcggcgtcgactcctcggttgtggcggcgctggtccatcgcgctatcggcgaccagcttacctgcgtgttcgtgaaccacggcatgctccgcaagggcgagcccgagatggtcgaggaagtcttccgcgagcagttccacatgccgctcgtgcacgtgcacgccgaggagcgctatgccaagatgctcgccggcgtcaccgaccccgagaggaagcgccgcctcatcggcaccgagttctggaaggtgttcttcgacgaggcccagaagatcggtgacgtggagatgctcgcccagggcaccatctaccccgacatcatcgagtccggcgcgcgcaagacgggcggcaaggcggcgaccatcaagagccaccataacctcatcccgttcccggagggcgtgcacttcgatctcatcgagcctctggaccacttcttcaaggatgaggtgcgcgagctgggcatcgcgttggggttgccggccaagatggtgtggcgccagccgttccccggccccggtcttgccatccgcatcatcggcgaggtgacgcccgagaagctcgcgatcctcaagaacgccgacgccatcgtgcgagaggagctggacgcctacaaccagcgcctcttcgaggagacgggcgaccgcaactccgagcacgcgtgctggcagtactttgccgtgctgcccgacatcaagtccgtgggcgtcatgggagacgagcgcacctaccagcgtcccgtcatcgtccgtgcggtggagtccaccgatgccatgaccgccgactgggcgaagctgccctacgacgtgatcgggcgcatctccagtcgcatcgtggacgaggtcgagggtgtcaaccgcgtggtgtacgacgtcacgcccaagcctcctgcgacgatcgagtgggagtaaattccgcctgattttctccaaaactggctctattacggccttattttcgccatcttgtgcgaaaataaggccgtaacctttttaggggaggagcttgcatggaacgattcctcatggacgagtttgttgcctggaaggacgggccccgccgcaagccgctcatcctcaacggcgcgcgccaggttggaaagacgtggctgctcaaggagttcggcaggacgcagttcgagaacgtcgcgtacgtgaacctagacgacaacccaaggatgcgcgagcagttcgagctgggctacgacatcccgcgcatcgtctcggccatccagttcgagacaggggaggtcgtgtccgagggaggcaccctcatcgtcctcgacgagatccaggcgtgcccgaaggcgctcacctccctcaagtacttctgcgaggacgcgcccgggtacgcggtggccgcagccggctcgcttctgggcatcaccgtgcacgaggggagcgggtaccccgtggggaaggtgaacacgttcgatctccatcccctgagctttcgggagttcctcgccgcgacggggaatcggccgctctgcgacctcatcgacacgggagacacgagtctcatcaacggcttctcaagcaagtttgttccgctccttcgccagtactactacgtcggggggatgccggaggcggtgagcgtcttccttgagcgaggcctcttggaggatgcgcgcgaggtgcagcttgagatcctgcgcggctacgagcgcgacatctcgaagcacctgagcagggccgagaccgagtacgcgctcgccgcgtggcgctcaatcccgtcgcatctcggtcgcgagaataagaagttcgtgttcagccacatcgcgcagggcgcgcgggcacggaactatcagacgggcatcacgtggctcacgcaggccggcatcacgaccctcgtccgcaggatctcgaagcccggcatccccttggcgccctacgcctacgacgctgcgttcaagcttttcctggtggatgtcggcctgcttggggcgatggcgcagttggacaaggagacggtcgtcgggggtagcgagatcttcgaggaattcaagggctccctcaccgagcagtacgtctgccagcagctcgtctccgactgcgggctcacgccgtactactggtcggccgagaactcatcgggcgagattgacttcctggtacagggcgcgaacagcgtctacgccatcgaggtgaaggcagaggagaacctgcgcgccaagagtctcagggcgttcaaggagtcccatccggagattaagtccgttcgcttcagcctgtcaggctatcgcgagcaggactggatgaggaacgtcccgctgtacgcgatgtcgaacatgggactgtgggggtaggtgcggggtcaagcgagtgaactggtgaagagtgaggacgatagacggtgtcttcatatttctagcacgctatgtgggaaaacaggggacgcaaacagaaagaataattcgaggaaggggccatatttcatttctacaaaagccttgccaacgccaaattgtaaatataggagcatgcttttatcgacaccttaattatcctaaacgcctctggttgtgcctcgtgttgatgggggtactccccgaaactgaacaatgaattctataattatacgtaaacccatttcccattcttctcaataggggtgtgcgtgaacttgctggattccattggagcggaactactttcccggtcaattgattggggcaggacgcaaatcaaaggcctggcaaatagaaagaaggtggccgaattaattgaacaggctacaacgtgggcttccatgattccttcgtgcgttgatctgggcgcaaagttcaaaaacacctatcttctagaggagctgctagcccatcgagcccttattgatattggaaaagacgaggccatacgcacgtttctcggtgaaggttacgacgattccgcatacaaattcgttgcagaattctgggattctttagacattgtcacgtcgacgggagaggaatcgctagcagccagaaaagcagtcgagggaacagaagctgcaaacagaaagcttgatgctttgctcaaggtttccggaatcgctcagaaagacggggaatcccaaagagagagactaacaagttactgcagctctctcatcaaatgctataacacggcggctatccccagacacatcaaaatgaaaggttcggttgagtctctaccacagtcggcacttccgaaagatggacaatccgtactcatctatgccaatcccggtatgggtaagagcgaattgatgaggttcgccgcggccagtcttgcaaggtcttggatagatggaaagaccgatagggttccggtgctcctcgaagcgcgtggatggtcgcgtcagtactcaagtttgattgaaggcgtcactagagcattattcggctgtgcgaccgaagcgtcaatgtgtttcataagggacaatccttcgctcttttgtctcatcgtggacggtctcgacgaagcccggagcgatagagaccttctcctctcggagctagcacattatgcgcgctttgagaaaagccggctcatctgttcctcgcgctttgaaaaagacggtgagcgaatagggattaacagcgcatccttgcagggcttcaccgaagaagaggccatctcgtatcttagcaataggggtgtaaattcgcctcagagcgtattgagaaggttcagtgaagccgggcgcgagctgatgcataacccattgcatcttagatgcctggctgaatatctccgtaccgaagggggcgattcagcgcctcgaaatctcgcgacaatttacggcgtatgtatagcctccatgatcgagtcgaagaccgattccaacgggaatctggatgccgactatcttcagcaatgcttgggatcctacgcattagaatgtttagtcgctcaagacatccctccgtgcagaagcttcttgctcgaaagatgtgaacccaaagaagctgagaggatagaaggggccggcaaggattccggccttctcgtcgttgttaacggagcagtcgagttttcacatgtagttctccaagaatacctggcggctatcttccttgccggccggcaaaatgatgaaatcgaatcattctgcgaacgccatgcgagaaaccccctgctggaaaacttcttcaagattctgtgtggtgttgctgccaaagcggagaagcaggcattggttctcgactgcctcgagaacagaaacttggctctattcatggaatgtttgcgagagagaatgaacctctctgacaaaatggaggagcggctatgtaaagacgatatcgatggaattgccaagcaggcctttgtaacctacctaaatattacgaatcgttatttggttaaaacgaagtctcatattccgttttggaaaacgctctcttctcccgatgcgccaattcgtatggaggcgagctatagcgtttcgaccacagttatgcgaatcgtgctaaaagagcgtcatcctggagaggattccgtcgccgtcgaactttctaatgatggtcggggaccagtaatggtgggccctgacggttccgttgccccgatattatcaatgaggatatcgaatcggcccgaaacccatatctatcgaataggtgccggtagtgcgcatagacgtggtgtaagagctggcggggagcggggcctcgtgcccccgacccgacagcttgtggccaagggcagatgagggacatcgcctacaatccgtcgttgcttcaggtaacggatgaaaggaatacgtgtcccgcgatgagagttggaatgccgatgggcctcgaggaagccataatctccatgcgctctggaacgagtgcgacgacgcccgcgagttcgcatgcattgggtccctgtcgcggcattaccgcggtgatggacgagcaggcccagctcgcctgcgggctgccaggggcgactcacgcaggccgcccaacgcaggaacggctacaggccgcgcaccctgaggacccgccacgggggactcgcttagggaatcccagctgctggatgggctccgtactttcgccctaggatatgctcacccgctggtcgagggtggactgtcgcggtggccgcgctcgtgcaggagatgtaggtctcgggggtctcgaaccaaagttggagaggtgtcagccgaaagctcggcatctcctccctgtcgagctctgaggtctcgagggctgtgccaggagctggacctcgaggtggagccctgagaccgcgacctcatcaccggatgccctgcttctaccaacccaccaccttctgtctggacttccacctacatgaagctgcagggagactccgtcgtctcctcccacgccgtggtgacggccatcgggctgggcgcggacgggggcgcaagccgtcctggcgttgaggccattgacaaccggagcggaggaggcttgaacggcttcctggcggcctcaaggcgctgggactcgcgggcgtcaggctcgccatctccgacggccccatgcggggctcgtggcggccctatcgcgccatctggcgggatgccctggcacgctgcatcacccccaccctgcagaggacccctcctgtccgccatggctgggaggccccgagcctccaagggtgcggtgtactaggctcgtgcactcggcctgctacgagatggacctcgagctctcagggccatcttttaggaggccgagccctgggtcaggagggccatccccaaaggcgcgagatcttcccgcggccggacctcggccctcgccttccatgcgttcccgaggccccacgggggcgaagctcatgaccaacaacgtccctccgaaatcgaagaagaggccctggggggcgacagccgttcgtccctggtctatggtcgttccggcgcggcttggtgaccccacaattggatgacgtcccgtccgggggctgtcctcctcttgatatgtcccgcccgcgccggcgtgccgcgcgctgcctgctgtgacctgatagaagcctgggcgcggcggctcttgcggagggcgccgctcacccatcggagccctgtccggcggcgcgggggcaattcgaatcataccggtgccgaaagacccgcgattggacgtgagtgggcatggaggtgcagatgggggacggcgcgtcccttcgggacgctgccgtttgtgggccccgacgagtcgaacgcaacgcgaccacgaacctggtgaagctttgtcgaccgcctcggcggccaagagctttctctgtgcgcgaggttccccaccggcgcggcagggatacgtgaggctcaatcgcgagcgcacaccgcgcgctaggacgctgtggaggccggcgcgcgctggctgctacgggccaacccttcggtggcgggctcgctcggagtggagatttcctcctaggtgcgtccgctgctacgagttcttggccccgacaggagccgcagaggcgcagcgccggcaaggacgacgcggcggacgcgccaagcggccgcaggcaggtggctcgaccggggctatgacctggcttggtaccgaatgtaccaggacgcatgggtcgaggatgtgagggcccttctacgtctccagggaagggcctcgtgagtcgtgcaacttcgtgcgccaacatcgcctgcgacagtgaggaaggcccctgacgcatcctgagggcccgcccttgagccgctcgggaccgaccggcaatcagcgcgcgtggcgcgtgtgggagaccgatggctcggaccgcctcgtcgagagggcggccatggtctcgtaggcgcgtggggacggcctgggtcgaccagcgctctccgtcgagactcgaagggggcggatcgccgagccgtgggctaaagggaaaccgcgctcccagccgcgatgtacgggtgcggcgcgcactctcgccggcgcttcgcgatggcccgccgcgacaacccagggaggatggcctcggaggcctcgttcgccgccctctgcggtccatcgcctaagaggcctgagcggcaaggtcaggcgccatcggctaaccgcggcggcgacaggcgggcgaacagggcccgcacggtgatcgcgatgcacaggatgcgcaccgaccccaggccatcgcctcgtggagaggcgaagggccgaggggctcccgaccgagagatagccgctgcctcaagcgctacatcgcgcgcgagcgtaccggctcctgacgaatccgaggacgtgccacgccgatgggaaaacgggcccgggctgagtggaggccagatggcgcgggaggcgatgcgaagacgcggcgaaggcgctgggggtccacggcctcgaccctctgcgacctcgacttggcacccccagtttagagacctcgcgctccgttacagaaagtgggtggacgtattggcttcccgatggatgcggaagaccccgccgacggcgcttgacaccaatagaagcatcaggagagggcgaccgggagatcaagcgtcgctacaggtcgtcagtcctttccctcggtcgagtcgatggtgcgcctgagcgtggcctccatactctcggaggaggggcctgggccacccagcgcgtcttcagcgaagattccgccgccctcggcttcagggaccccggacccagggaggccccctcgaggggaggaggtaggcactcgagaggagggccgcacagatagtctcggagatagccgagagctgcggcctcaagaaggagtaggattctggcagcgtcggcagcaggtgatgtgccttcttacaccacgctcgtgcgcgcgatctaggtgccgtttacgaagggattgattgcgccagagagatggcgatatcgatgataaacgacgatctcaaaggattcttcgattctgcagagcctattctcagcgagccgataggaatgaagaccgctttcacggaggaagcgctttggcgcagtcgtatatggcgtgtggacgagaaaggtgggcggcagcatattagtcttcgcaattgcactgctaaaggattggctcaaacgctcggcgggaaaccggaatataacatcagtgtcggcggggtggatattccggcaggattactcccctttcttgtcaggatgatcgaaatcgcaccggaagaccacctgcaatatctgcctccagctccagataataggggcgaaggatgccgtcgggtctgggaggcgtacacagacgatactttcgaatcttggtgcaaggtcgtgttgcccgaatgcgagaaatcatacagacagttcattcgcaccttcatggaagggattggagaataccttcctgcctatgccggcgggccctatgccttgaaggcaaccgttgaacctgccgacgaaagtgagatccttcctgacagatgccttcacgtaaccaggtttccggtcgaaagtgaagaggagattcagcttgaattcgacgatgaattcttctcaaggggcttcacctcagctggattcaaggagcgagctcaaggttatatccgggcggcaaggcttttgggaagaccgacgggcggctactgtgaatcgtcatttggtggatcacctttgttaaccgaaagaatctatatacataatgaggtgcgcaagcgtatccagaaagaagtcaaagcgctatttaagctacgctagacactgtgtgctaaaaaccgtttatgcttgagatacgttgtgttggcggtggtccccgtatgtgtcgtgcgaggattcccgctcgtatcgcacttcgcggacagataggcttcgctctcccgcactcgccccgcaccatcacctttgggctatgattctgctcgcgcgttcgatttactgctctgcctaactttgactttaaaggatttttctaaagctattcctctatgggatgaatagggactggcgaccgtcagaaagcagccgtctgtctcgaagcttttctttgctttggagaaagcgctaatccggtcacgacgggatatggggcggtgcagaaatctgaaaaagacgacttgctcaaacaatatacgctgcccgatggctccaattattcaaagcaaggaaggacttctcagcgttcttgattcgatttttttcgctgatgtctttagagccacaccctctgctattgagaaaaaatgccgcatgcggcaaaattactcaatagaagtcgatcgggaatcaaggcgaggcacacatggaaatcaggcgggaccgatacctcaacaggctcatcgaccgcatgcacaacggcatggtcaaggtggttacgggcattcgtcgctgcgggaagacatacctgctcttcaacctcttcggcgactacctgcgttcggagggggtcgacgacgagcacatcatcgaggttgcgctcgacgtcgaggagaacgccgccctccgcgatcccgctactctgtccgcccacctacgctcaaagatcgcgagcaggcacgagcaatactacgtttttctcgacgaggtccagtacgccatttcgcgcgaggagcttaagaacccggacgtttcgccgcagctctacggtgtgcttaacgggcttctgcgcatgcgcaacgtcgacgtgtacgtgacgggaagcaactcgaagctcctctcgcatgacgtcatgacggagttccgggggcgcggggacgaggttcgcgtgcggccgctgtccttctccgagttcatgcagggcttcgatggcgatcgctaccaaggctgggccgagtacacggtgtacggcggcatgccgcttgtggcatcaatgcgcacggacgagcagaaggcgcgctacctcgagcggctcttcgaggagacgtatctgagggacgtcgtggacagatatggcgtcaggaggcgaggagagctcgatgatctcgtgaacgtgcttgcctccggtatcggaacgcttacgaatccgagcaagctcgagaacacgttcaggagcgtgcttcattccaagatctcctcgaacacgatttccagctatataggctaccttgaggacgccttcgtcatcgaggaggcgcggcgctacgacgtgaaggggaggggctacatcggcagtcccctgaaatactacttcgaggacgtggggctccgaaacgcgcggctcggcttccgtcaggtcgaggagagccacatcatggagaacgtggtctacaacgagctcagggcgcgcgggtactccgtggacgttggcgtggtcgagaagcgcgtccgtgaggagggcagggacgttcgcaagcagcttgaggtcgactttgtcgccaacagaggctccgaccgcgtctacatccaatcggcattggagatgaggactcccgagaaggccgcacaggagaaggcctccctgctcggcatcaatgacagctttaagaaggttgtacttgtgcgcgacgtggtgaagcccctgcgtgacgagcggggcgtggtcacgatgagcgtgttcgacttcctgctcgacgagaacagccttgctgggatttaggttggggtgtgccacgttgagttcacttttgagttcaactcgggtgcttaagaaccggccgattccgatgaatggggcgacgacggtacaccacgtagacgagaggccacgaaaatgcgcgatttaattactgagtgggaataaaattctcaacctgacgcttctcggaactccccgatacaagacggtgtttccgcaggtagaatatcagatttgtgaaaacgctgccaggcacatccagagccttcaaggcactccttgctgcatcctttgtccatgaatttgtccatggattgcagcgggggtgccttgcttttgctaccggttttgatgaaaagagaagcgtcataatcaacgacgagaagtgggaagagctcaagcagaacgaggacatggcatacttccgcgcagacctctgcctgtactcacccgagagctacagcctcgacgagaagaaggacatctgcaacggaatgatggagaccagcaaggcgatgctcgatgccatgcgcgaggatttcgagagcatgccacccgagcttcgcagcaagctccccgacatgctctgcgcctccggcgtcgagagcccgcagtggtggtgggatgtgctcgtgggcgacggagacccgctctgccgagagctggagccgcttagctagaacggggcccataagaagccaggaaggccgtctatcacgttgataggcggccttccgccgtctcacccgttggtctccacgcgcgtcgtctttccgagcagaaaagcgagcccgatgccgacgaaggccatgaacggggtccacatgatggccgccgtcccgccgaggagcttgcacacgccgtagaccgagaacacgcccaggtgctgcaccacgccgctcgcgatggcggctgccatacccctgcccgaaagcaatccgtccctgcgacatgcgtacacgaaccatacgaacagcgggatgaagcagaagagccccgtcacgttgccggggttgcccagcaagtctccgccaagcgcgatggtgccgccgatgtgcgtgagcccgttcaccagcatgaacccgtagctcatgagtcccacgacgggcctcttcctgcccagtgccgccgctatggggaacgccacgaagatgatcattatgttgatctcggggaacacgacgagcggcagctgcccgaacatgtcccagaggccgcgctccatgaaggcggtcaccaggtcgaaccggcctcccgtcacgtgcagcccgtactcctcgaacacgtgacacaggtacaccggcaccggcagccacgcgagccaggcggcgtcgcgccagcgccccacgtccgcgcgcgagcgcatgacgtccgtcgagaacaggaggatgaacaggacgattgccccgcccagaccgacccacggccaggcgaggtacgcgacctccgagaaacccatatgaagcctttccctcgtatattctctgcctgcattataattagccgcatgtgccaaataaacggccacatgagtgccaacgtgccaattacgagggggttcatccatggcgaggccgaggtaccagcgcgacgagcagacggcccgcgagaagattgtggaggccttctggcggatggtggaggacggtccctacgacaaggtgagcgtgcgcggactcgtgcgcgagagcggcgtgaacaagaacacgttctactaccacttcgaggatgtggatgacctcgcgcggcaggcgaccagggacgtccttgagcccgcgctcctcctggagctgctctcgatgatgcagggcggggccgcgcacgttcaggcccgattccatgaccccggtttcgcgaagcggattcgaagggtccgaaccatcgcgcgcgccaagggcacgcccgagcttcaggacaagctgaagcaagccatcgccgacgcatgggccacggcgcgcgggttcgccttctccgatctcgacgagccacagcgcatcgccctggagttcgcgctcggcggtatcatgtcggtgctcgcccacacgaacgaggacggctcggagacgactccggatcaggtgatcgaatccggtgtgccccaagccgccctggtcgtgttcgacaggttcccggccgtcaggccgcagccctagccttcctcgtgcagccgccgtatctcgtcgtacatctcgaacagcggaaccagcggcagcagcaccagcatcagcagcagacacccgacgatcccgaggagccaacccgcctgctcgccgagccaggcgagtctctgcctcatgacagcatctcgttcacgcgggaatgcacgatcgagtagtaggacccgagcctgcgcctccgctcgtctccgttgccgtagtcgccacggatgaccgcgcgggccatcgcgtccacgccaacgctcgtcttcgccgtggcggcagcgccaaggatctcgttcaccctcttctgcacggctgagtacttgtctcccaggcgccgcttcctctcgtcgccgtttccgaactcgcccacgatgacgcgtcgcgcgagcgtgtccgcgtcgtaggaggcagaggagccaccagagaggatccggttgacctccgcctacacctcgtcgtaccggctgcccagcgcggccctgcgagcatcgccattgccgaaatcgcctgcgatgaccctcgccgcaagctctgacacgttgccggagggcgcaccagagccggtagggccgaggccgtgccggtgtcggccttgcggttgtagtggagctcgccgtcccagctgccacggtagtagtcctggatgcggctctcgcggcccgtctggtcgccgggagcgccgtcgatgccgccggtccagttgtagcgcgtgatgagcccgtcgtagggcgtgccggcgagcgcgagctcccacgcctcgcacaccgcgctggagcagtcccggtcgccctccttcacctcgatggttccagtgtcggtgaccacgctgcagtaaccgcttgtgccgtgacgccctggctggctgcagccgcactcagggcagttgcaaaggtgctccattgctccgccacgttggcgcgcgatatagccacttccttcaccgcctcggcggtgtttgagccgacagccttgcatcgcgctttccgatcggccttggtgccatagaacaggtcgaggtccaggtgccccgcgtagccgggaatgcgccccgtgctcgcgtattggaagatcagcggtgagtcccacgcaccgaagtcccagtcgtccgtccagggttcagacttgaaccccgtctcctcgtagttcgggtactgtgccacccatagcgggtaagccttggccacgctggtccagtcgtaggagaacaaaactgacttgctcgtgtagatgccgggcttcacgccggtcttctcgcgcacgcggtcgagacacttcttcgcccatgtgggccccagggccagcgcgtccgcctcccagtccaggaatgggatcgccttgccgacgtagggcttgaacgccgcgatgaagtggtccgcctcggcctccgacgagccctcgtacccctcggtcccgcgcgtagtggtagcagccgagcagcttgcccgccgccagcgtctcgtccgcgtgcctcttgaagcaggcgttggtgtagcccttgccgcccgttgccttcacgatcacgaagtcgcacgtcgtcatcttcgagacgaccaaatcctcctaccaggagctgatgtcgatgccgttgagccccattgccgccacccttcgggatcacaatctcctcgccgccgccgagcgccgccatgaccggcgagagcaccgccatcacgaacgccacggcgagcgcccggatcgtcgggtcgagcaccccgaacccgatgatcaggtcgatgttggcgacgaagacgccgagcacaccctgcacgatcgtgcgggccaggcgctactgccactcgtttccagccaagaacttctccatctcatgccacctttcccttgatctcctctatgtcgtgcttggccgccgccatgtcctgttcaagcttgtaggtgcactccaggacctggttgtgcttctcgaccttggccgtgagggtgtccagcttgacctccatgacggccctcgacttggaattggagaggatcacgccgacaagcgttacgaccccggttatgcacgcgacgatgatcgattccataaagaactgcctcctgagctcgctgttacatcctcaggaggcagtgtccaaccgtgtcacaacctgctaggcagccgtgagatacccaggtgtgctcgccgtgtcgatgcggaagtacgtgtacgccgtcttgctgctggcccacacggtgccgttgccgcccacgagcgaggtcgagcagttgtagaagcactgcgacccgctgacgccgctcgaaggcagggcccaactcgcgtcggcatagaacgcggtcagcctcttgcagccggagaacgcgtagtacaggtcggtcagcgctgaggggtcgaacccgcggaagtccagcgtggccaccgatgcggaggcgaacttgaacctcgtcgagcgcacgcatccgcaggccagtcgtgtcactcttcggtcgggaaacgtcactctcgggtcggggtgcgcgcagcagcattcgggctgtctcggggcgtgtagtcagttgcgagcaaccgaacggcgtttccgcaggtcaagcgtgtccctcttcggtcggaggaaaatactcttcgaaagtgactacacgcagtgtagtcactttcgactacacggtgactacacgttttttcgagaatgcagagtgacagaaaccgcaagtcaggcaccgtgttgactacacggattggggggttgtgtcccctgagtgggagtgagctgggccttcgttccatctagttgcaagccgcccgcctgttggcagtggttagcatctattggcacgactaggacgaagccacccggactttccgagagtgaaacgtaggaatcagccccgaaacaagaccgtttcggggctgattctataggcgttaacctggggaaatactctcgacaacccttcaagaggacgacgtgatgacactccttgctaagaggggcgaacggatgccaaaacatgccaacgcggtgatggaagatttcatcgcgttttcaagccagggggggcatctggcgccgtgccatgtagtcaccttgtagtcaccccgcttttttgctctccgttttgcaaaatcgcaggtaggagtgaggagtgacaaatcgcgaaactcggcgatttccgatgaattcgggccgttttcaagccttccgaaagagcgtttgtcactctcaacactgtgttgcaatagacgattctaggcccattttggcccccgaaaaccggcaatagtaatgcgagagtgtcgactcctccgcaatcgttgcacatcgcaccattgcgctatcatgctgaagttccacggatataaagcataaatgtacgagccgcaaatctatacccactatttgagcggcaggattattttcaaacactcgggaagctattcgcgaatctcttcctaaattgcttcctgaatgcgtgaatgcttcccgaatcatggtaaaatttcaacagaatttgaccctaaattggaacgagtaacccgcatggaagccgaactgttgttagagacgatcgcccagggtgaatctgtatcagtcgagtttaagaggtgcggagcacggcctgaacgggacacctttgagaccgtctgtgcattcgctaaccacatgggtggaagtgtctacctcggcgtggaagacaatgggactgttgctggcgttgcggaaggcgcggcaatagatatacagcgcaatatcgccaatgtcgtccgcaatcccaagctgttcgatcccgctgtgatgctcgagactgaaatggttgtcgtaaatggcaagaccgtcgtccgcatctgggtccccatgagtccggatgttcaccgctataagggcgtcgtatacgaccgcatcgctgatgccgatgtaaaggttagcgctggcagtcagatttctgccatgtatatccggaagagcaatctcgagactgagcggcgaatctttccatatttgacgctgagcgacttgcgtgcagatcttatacatcgtgcaaggcagatggctacggcacggcggccgggacatccttgggcagggttggatgacgagcagctcttgcggagcgcccagcttttggtcaaggactactcaacaggacaagaaggcctcactctcgccgccggcctgctgttcggtagcgacgagacgattggctcgctctgtcctacttacaaaaccgatgctgtggtcaggttgcgtgaccaggaccgctacgacgaccgcctaacggtgaagaccaatctcatcgatgcgtacgatgccctcatggggttctgcgagcgtaatctccccgatccctttgttattgagggagacgcaagggtaagcgtgcggggcatcgtatgccgtgagctcatctcgaacatgctcatccaccgggaattcacgagtccctatcctgcaaagctggagatcgaccgcgagggcttgcacacccagaacgccagcaggacattctttgaggggaatatcacgctcaatgactttaacccgatgccaaagaatccctcgattgccaatgtcttcactcagatagggcttgcggaggagttagggagcggcacacgcaacctcttcaagtatgcacgaagcttcatgggtggggatccgaccctcgtggacggaagcgtcttccgcgctacagtcccagacgcaggtggggttttgatcaccgagtcgacagttgccaagcagctgggggacactgaccaagccatactggagctcgctgcatcacgagtcagctttacgctggcagatgctgccgatgctgctggagtctcaaaacgcagcgccagcgctcacgtatccgcactcattgaatcgggcaaattggtcggggagggatcgacgaggaggcgccggttcaggaaggcatgacctcgcatttggtaggcgcggactcatttctagattgccgaagtggcccattttgtccgcgtactttgactttgtgtggaatctgatcgacgtctgactccccgatgagtattaatatgcgcacatggaaaatcttcgggttttgtaagggcggggcccactgggtttcgctctatttgttatgcaaagagcgcggccataggattcccgaacagatgtcgttgcccatggcgcggagcgtctcgcctcgctcgcctttcctgacagacagaagcctcccgatccttatggcggatatcttctgccgctcgatgggcttgcaggccgacgccttcgatacgcgcaggtaatccgcgacctgcggcacgtccacgaggcgtggggcgccacttggacatgaacgactaggtgccgaccagcaggtcgaggttggcgatggccacgccaagcacaccctgcgccaccgtgcgcgcgagcctccactaccactcgtttctgcaagagagctcgttcattatctccagcctttctcccaggccacagttgcttcggcaatgagcgcgacgagcgcagtatacgttccgttgccgacggtgccgactccgctagagcaaccgatgccgccccactgtgcagagaaatctccggcgccgtggggcgggcggcggagtgagccaacagcaaagccacgccgctagtagtagcctgtcaccagcaatctgcaagtcattagcaccccacagccgtgtcgcccgcatcccttggtcgccatatcagccacacggtataatctatccatcgatatattggttgaaccatggtgtctctgctgtgaccataaacctccgcaagacgccaggaccttgttctaaggagatctggtggagaaaggtcaagaggacccaccacaagaccaggcacttgcccatagagtcaggtgggctgacctcgacagcgtcttcgcgcacatgggcgacaatactagcgtcggagaggcaagtaacggcatccacctcataaatgaccgggagcacgtcgccgtgcgccaggaccacgaggttcgcattcccgatgaatacctgctggaatcatacgtcggacagcgcgacagcgacctgagaaaagcaagggagatgctccttcaggccaagcaggagcgcccttcctacaaacctgacaccctttttaggtctcgcgacaacattcctgggctggtttctcgggggtttgtcgtcatctgtcaatctcgcatctttgctcggtatcttaatgctctgcgtagcaccgtgtggcgcagtaggactctttgtcgcttttatctttatccgaaaagaagagaaccaaggcaaatctgatctggctgagcgcgttctagaacacctggcggatcccgatggcaaggagaccaagaccgatgaacattaatgatacgagcacgcagctgctctttaccacggtccccatcgtgggcataactaccgaaggcacgggcgtctcgggtacaggattcttcttttcctatgaccttgaggacgggcgcaacgtgcccctgctcattaccaatcaccatgtcctcaaggatgtgattcagggtcgcttcgtcatcaatctagccgaaggtgacgccccgtcacgcgagaccatcagcgtgaacttcgacaagtcattcatcgaggggaagaagctcggagagctcgacttggttgcgatgccggtggcccctgttctcagcatgctcgaacaaaacgggaagaggcccttctaccgctccatcgactctggactcatcccgaagaagagtgtgctggacaatttggcggcgctcgagcaaatcaccttcatcggataccccagcgggctctatgacgactacaacaagacccccctcatcagacaaggctggacttccacgcccgcttggaacgactacaagggcaagcgcgagttcctcgttgacgcatctgtattcgagggctccagcggcagtcccgccttcatcctcaaccagggcagctatcccacgaccgacggaattgccctcggctccaggctgctgttcatgggcgtaatcactcagacgattacgaaggaggagagtgagcacctcgatttaggtacagtcatcagaagcgacgcgatgctcgacaagctcaaacccttcgtggaaggtctgctgtagctaagagcgccgtcaaaagcggtgacacccctttgctcctttgcctaggacgagatgactgagctcggcgtgctggttgacatctggctccccaatggctcacaatacagacacatggaaaaccttcgggttttgtaagggcgggacccacagggcctcgctctagttttatgcgatgaagatatgccggaagttatgggatcaccgattagatgtcgttgtccatggtgcgcagcgcctcgtctagctcgcccttcctgacacgcagaagccccctgatccttatggtggggattttctgccgttcgatgaacttgcaggccgacgtcttcgacacgcgcaggtattctgcgacctgcggcacgtccatgaggccgtcgggcaggtcgtacgtttcggatgtcgaggaggcggcagatccccgtatctccgccccggcattctcgcggctcacggcatcattatccgatattccgatgggcgtcgggaacgcgtcacgtgttatctggaggatgtcgtctctcatggggtggcctacctcctcttcgtcttgcatctggtgcgtttgggttgcaacgagacccaaggagtctcgttccgtcttcgcgggcaagctgagagatacctgatgggaaatacgtacgcaacgttacaaagggcgctaggccacgctaagtcacgattcgtcttagatccgttggcccgcgaattaagggatgattacagcgcccgaatgtcggactctgtcactggcgataaaattgtcattgataatgcgaaggggcgtgtcgggtatgagtaacactgatgacattgtaaaaatcgtttactttgatgaaggctctgcaactgactatgttcagttgaaaacaggtgggtcattcatgtcggagattgccacgactgatgacaaatctgctgaaggtggagcagaaataaaaggttccatcggcgtgcgtgcttggttcgccaacctggtaaagggctcagtatctgccgaggggtcgctctcggcctcctttaaagatgacaccgtagtcaaaagcatcgtcactaacaccgtgcttaccgacttccttgctgcagtggatggagaggagagcgataagcgaattgaaaagttcgataactgcaaaatcgtgcaaaaaatcctctcttgcagaaagttggtaaacttctgagctgctagtcctccgagctggcacttctctcgtagtactccctgtagggcagcgaaatcgggacggtcatcgcccggtcgaggatcgcacgcgtcgaggaccatcgcggcctctccagccggtcctcgggtgggttgacgatgaccgagaacaggttgagccacgtcgtcgatgcggtctcgctcgaagcggaatggcggtgcatgaactccttcagcaggaagtgcatgtggttgacgcggggagagcgtggttgtggtgtcgtccagccccttgagggtcgccgacctgtaggcgacgctttgcgttgacgagcatggattgggagttctccatgtcgggacgaatcgtcgccccccctggcgatgtgggccgccgtagcgtttccccagcactcgacttgctgaagctgcccgagcccagcccgcacctgcgaggctcctgccggagtagtcgcatcccacggcgagcagatcctgtccctcgagtacggcgccgcatccgcggccctgcctccagccctgtccctggcggcgaggggtgcatcttctcgtcgactggacctcgcccgagagcacgacgccgtcctgaacgccctcagcacggcgaagaggcttggccatcaccagggcggggtggtgccgctcctcctgtcctcctgttatcgcctctagctctcgaagccgaacgccggcacatgaactcgaccgcagtcgcgcggggagcttgtggtcctccgaaactggtgccgttgccggcgtgaaggtcctgccgcaggacgcgcacctccagcggcgggcgccatcgctcgtggccccatcgtgatgtggccgctgccgcatctggggcagcggtccctctcgtacccgttcatgcagtccgcgccccgggtctccatcagcgaaacggtggcggaaatcgtaaacgctcctaggcgtcccctgacggcactgtggccgtcgtcagtcggcgtccgggacccgtcccaggtcgtcgccgaggcagacggggcgtgccactcgttgcccgctcatccggtttggctagtccctgctgcgcggtcgggggcggcgccggactaccaatcgccagatcgccgccacccaccgcggcattctggcggatggctatgtcctgtggtgattatagggccgcggagctagtcctggcggaagaccaactttctgcaaaagcggattttcgtgcaaatcccaggatccatctctagcctctctttgctcactccctatttgtcaatgcttcggagcggccagggcatagaagctggggaatttaacatctccttggacaagcttgattccacgttgacgaaggcaaaggggtacttcgaattcttcggcaacaacgacgatggctcaagaatcgttcttcgatttaacggtttgggcttcaagaacaactacaagcagggtaatctcctcaatatgaatttgaggctgtatgcagtaaacgttggcaagacacggattgctgagctagctgcagacaaggaacttagccttgaaggatttgcgtctgccaccaatccagattatgtcgagggcgccgagaatgaagaaagcgcagttggcgaagatgaaagcctggacatgtatgatgtaatccttgcgggagttgtttcaaatggctgatagcgcagtgatcttttttggaccgcgaaaagcatttgatgagatggtagaaagagaaaccgctgaagatgagcggagcgttacctatctcgaatccatccgcgtctataacgcccggataaagtcgagtgatctcatcactagggatctcgtcctcaaggctcccgagcgagttgatagctgcgtggtccacgccgatgacttcggttccgtcttgagccatgtcctaccaagctttgccaccatactcgagcagacgtttgatgtcggaaagctctacgtgcagaaccctccgaaacgagtcttcgactctctaaaggcgtcgcagccgcaaggaactcttgatgtcgtacactatgagtacccgctcattgagaaaaagagactcaatgacatatacgacaaactgcaatcggatgtcctcgggcaagacgaggggaaagagtcactgattgcatctctgtatcggcttgccgccatgaacgaggagcgtccctctgtaatcatgctctatggaccgtccggcgtcggcaagacggaaacggcgaggtgtttaagcaaggcagttggcggagagcttaccagagtgcagttctcgatgatgcaaacgcaagaggcttacgagtatctgtttggcgcggaacactcgaaagcaagtttcgcgcgcgatcttttggcgagggagtctaatgtcgttctaatagacgagttcgataaagtcgatccccgtctgtacaacatgttctaccagctctttgatgagggcagatatgtcgacacgaactatgatgtcgacatgagaaatgccctttttctcctaacgtctaatttcaattccgaagcgtccgctcgtcgagcaatgggccccgccatgttctcgcgcatcggcgcaagcgtacatttctgcgatctcggagtagacgagaaggtcacgataatcaacgagcacattgagttcgttctctcaaaacttgatgaggaagacagggcggcaatcgagcaaagcgatgttcaagcttggttcatcgagcatgctgcaaagtatgacaacatgcgtacgatgaagaacaagattgagatggccatatttaagaagctttctgctcccattattttgtccggaagaaagagcgtttaacgcaaagaaacgccgccttctcctcatgattcagctcagggatgggttgttttgcttggaggaccgatgtagtcacctactaggtagaaattcatattttcccagctcagcgcagtcactcttcactcgggatttgtcactcttaagttggggagcgccccaccccgttggctctgtttccgccatgtagtcagttgtgcacaatcgaactttgttttcgcaggtcagacatatcactcttcggtctggtgaaaatactctccccaggtgactacaccgcctgtagtcactgctgactacaggttgactacacggttttcgtgataggagagtagatggaatcccagctcatccatcccgctgactacacggaaacgatcgtgtcggaaatgttggtgtaagcgcaagagcgcgcaggcttgatcgatagccaaagcagagcggccatcgtcctagaatctgagatcgcgacaagtcggattcgtggaagggaacgatgaccgcatggaaagcatagcagaggcgccgttaacggcgcaggtgactccggggctccttccgaggttccaggatggggcggtgaacctgcaagagctgctcaggcagctcgcggagtccatcgtgaacgagatcatggacgcggaggccgaccagatgtgcggggagggcaacagccgaaacggctaccgcgagcgcaagcttctgacctgcgtgggcaccctcacgctcagggtccccaagctcaggcagggaagcttcttccccgaggacgtgctgacgcgctaccagagggtggacagggcgctcgtggcggcggtcgccgagatgtacgccaccggcaccagcaccaggaaggtgcagaagatcgcccagaagatgggcatcgacaggctttccagggaccaggtgagcgcgatggccaaagacctggatgccgacgtcgaggagctgctcgcgagggatctcggaagcgccaggatgccctacctgtggcttgacgccacttacgtgaagtgcaggagggaaggacgcgtggcctcgacggcggtcgtcaccgccataggtgccgacgagcacggatggcgccacgtgctcggcatatccgtcgtggacaccgagtcgtatgactcatggctcgcgttcctcaaggagatctgggcccgcggcatggagggcgtccagctcttcacctcagacgcccacgaggggctcaggcgggccatccgggaggtctttcagggagccgcctggcagaggtgcgtcgtgcacctgatgcgcgactgcgcgcgcgaggcctcctcccaggcgctcaggaagcgcgttgccaggatcgtggcgcccgtcttccgcgcaaaggaccccaaccaggtgagggcgatgtaccacctggcatgcgagatgcccgggggtgctgccccaaggccgcccgcgttctcgaggaagccgagcccgacgccctcgcctacctcgacttcccgaagtcgcactggaaacgcctgcgcaccaacaatgttcaggaaaggaccaacagggagatcaagcgccgctccagggtcgtgcaggtatttccctcggtcgagtccctcacgcggctcgtgggtgccgtgatgtgcgagcaggacgatgagtggtcagagtcacgctacttctcagagaagaagatttccgagctctacgaggagatacccaaaaccgcaccgctgaccaaggaagaggaagaggagctcatgctcgtatcggagcaagcgatcagggcgagcctcgagcttgcggacaggatggaggcagcataggatacaggacaaggtctcagatcctgcaggcgattcgctcgctcggccggggtaagcccagcgtcgctcacggatttacaccaacattcacgacgctaccacggaaacgggccattcaacgattgagtgggagtgatatacagtaaaaagtgtatcagctatcctgcttgatttgagttgccactaggtgctctgcaatggcactagcttttgcgggacaagggcaaacaagtggatttccgcagttcatataacaaaaacggctaggtagataagcggttctacctagccgtttctttgtttgcggtgtgcgcgagtacgcctgttacctcgtgatgttctcgatgggttaatctatttcggaaccgtttgggaaccaagtatgggaattgggaaccagaaaacaaggcgataggttctagacactacccgcaaagcttttcgtacgctttcttcacgatgtttgccatgagtactcttctttgggcgaggaagtcggggtactcgagcttctcgaaatcgagaggaagcgcattatccctgcaagattttgcgtatccctcttcacccagcttctccctgtaagcagatacgtattcggctggggccttgtcacttatctcgatattcgtgttgtagtcgaggtatgtgaagttggctatctgattccgctcgcgatcgttgtcgtacccgatcttcgtcaggtagttcttcgggaagatgtggtgcttgtcgattgcgttcttctttccgcttgttccgatggcgaagtactgggcaagcggcgacgtgctgaacagcgtgggcgtgcccaggacgatgagcgaggcaacgtagccgaaccatgatggagagcttgcagaagagccctcgaggctgctcggcaggttgaaggcaaagaagtcgtcggtgaacctggtcgcgatggtcgattcgaggtaggacacgaatccctctgccgtcttgacctctcttaggtctgcgaactgtttttcgacctccgactccgtcgacccggtgtaaaagccggtgatggtgaccatgaagatccatttggtgatgatcttgttcaactcgaaagccggcactttgtagtcgtacttgccgatgaggtacagcacgtagctgaacaccactgcgttggtcgaggcgacgatgcttcctttcaggtaccccgccttgccgaacaggttgagaaaggcgtgcaagttgttgaggttgagagcgaggtcgagagcatccttgaactttcctaggttctcctcgcgcgtctctgccgaaatgatcccggtcgtcagatccttgcctctcaggagcatgtaggcgtacttgagacgggcgcgcctgaagccgaccccgacggcgatcctgatgaggtgcgacgggtcgacttcgatgatctggttgtaggcggtcccgtccttcggcacgcgagattccgcgcagaatctgtctatgcgcgcgtgcacttcgttgtcgaacacggctaggagcgtctcgatgaagttcttctcggtgagcttggtcccgccggagttgacgcggacgaagatctccgccacgtcctcctcgtcggccttcgagttgatcttcagcgtcgggagtgtatatatccctaggttgaggaggtcgttgaggttctcctcgatcaggtcctcctcctcgtcggtcagcgccggcctaccgttcctctctcgtccctcgttggcctgcctgatgaaggccttgcggaacttcgacacggagtggccccagtctgcctcgaacaccgagctcacggagctgatccactccgtgttcttctcgtatgcctgcgtccagaccgcgaactccctggtgagcgggttgaacgatatccttatcgtccgctcctggtagttcttgtcccgaaccttcgtcccatggagcgccgccagcagggccgtaagcctctgctggccgtcgatgaccaggtcgtcgggctccttgtaggtcttctcgttgccgccgatctgcttggcgttgtcgtattcgtccggtgacgaccagagcatgatgtagccgatgggatatcccttgagcatcgtgatatggctgcccaaattcagacacgtttgaagccgagctaacgaaagccctaggatgtgccgaaaggcacggaagggctattgccatgagcaagacgacgagaaggaagtacgaccccaagttcccaagatgagggtcgccctcgaggtctacaagggcgagagaccttgagtcaggtggcaagcgagaacggcgtagcgccgtctgtcgccgcccagtggagggaccagctcctcgaggagggtgccgccgacgtgttcggcaagacccagaaggagcgcgagaggaaggccagggaggaagccgcggagaaggagcacgatgagctgctgaagacgatcggccagctcaccgtcgagcgcgacttcctccaaaggttttgcgacagccaaggctacgacccaggacaggtgccgggcagccgcaggtgagcatgacggcatcacccgcaagcgtgcctcagagcttctgggcgttgcccgctaagcacctattacgagcacaaggagaaggcagggacatcggaggacgacgagcgcctcatggccgagatagatgagatccacgtcggtaacccgcctacggggcacgcaagatcgcaaggcagctgagaaatgacggtgagggacgtcaccgtggcatgtgaccaggctcatgcacgagatgaacgtgaggccctgctgccctctgccctcgctgtctgcgccttccaagcactccaggaagtttccctacctgctccacggcaaggtcatccgttccccaaccaggtctggtcgaccgacatcacctatgtgcagctgggagacaccatatgtacctcacggccgtgatcgactgggcgagccgctacatcggggatggaggctctctgacaccatgagggcagaggaggtctcaagtggccgagcaggccttcaaggcacatggcacgccctcgatcatgaactccgaccagggctcggtcttcgggtccgatgcctacgtgaggctcctagccgacagccacggcgcccagagcatggacgggcgtgcccgatggagggacaacgtgctcatggaaaggtggttccgcacactcaagagcggcatctaaggagcacgagtactcgactcctgccgagcttaagagtctcatcgccgacttcgttgactactacaacaaccgccgcatgcaccaggcgcttggacgacacccagacgactggtactacacaggcatcaaccagagggcagcctagatgagaaggactacgatagggacaccatcaggcatgggctttcgctagccaacgctcgttcgtgtcgaaggatctcagccagttcaggagaagtacctggtcgcgactccctgaggcgccgccatgttcatcaggttctggcgcatcttgctcttagcgacctcgtcgttggccacgagcaggaggttcgcccccacggtgctcgtccactgcgtggcgacctgcccgtggatgaggcggttgtctactctcaccaacacgatgttcggctctgccatgaggctcaccaatcccttctcccaacccgtcggttgggcagctcgttacttgacgatctcctggattgcgtagcgggaaacctcgatcacggcaccagacttgaccttgatgtcgcacgtctcggtccccaggcgaacgatctctccgtacagccccccgccaaatgcgaccttctgtcccttcttgaggtctcggtgaaggtcctcgtagtactgcttctgcttcttggccttggacgagctgacggcaaagtagatgaccacgacgacggtcaggaggacgagaaggactattgacgaggcaaggatctgggagttgagggattccatcagattccatcctcctcttcgccgtcagcgccaaggtcctccgtcgggagctgggcgtgcgcgacgcccgtctgcccagcctcgactgcgaccccgcagatgtcctgggcggtggaggactcgtccctggacatgaccgcctcgagcagcatggggaggttggttccgctcaccacctggacgccgcccttctgggccgcctgcatcatgctctggttaaagggcgtcccccccatgaggtccgtgaacacaacgacctcgcccttggcaagaaggccatcgattgcggcggccagctttcccgggaagtcggctgcctcgtcctcgtggaagggaaccgcaaccagggcgtcctgtgggcccgcaatcatctcgaaggctccgagcattccctcggcaaaggtcccgtgtccggtgatgatgcaacctaccatgtgccgatcctctctcctggctctcctgtcgtggctccgatggtatgccggagcccgtggcccaaaggcacctcgttaaccacttgagtgcctcttgaaaatcccctgacacaaaaacgaccaccaacgagcatcgcttttcgaactcgtgtcccgacgtttgccctgtggtctccaactggttacaaccacagaccagtttcttcacgtggttgcatgatgtcacaaaagcgaaggttccgtgactgtcttttgtcttaggtaacgttcgccgccagtttgcatccattcacccgtcaaacatcctatttcagcatatcgaacggtctcaattaccctctattggatgcaaatcgctggtggccccaacgtattcttactatgatgctgtcttggctttacctcaattgtgacgcgtctttgtaattttcaggaactggtattagttgaccataacaaggtatgcctatttttgactttgggagacgcccttgtccgtcccaccccgggtcaggcgtcagagcaatcgagcattggaggactgatgatctgcaccgtcacgctcaacgcctctattgacaaggcctacaggatcgcgggccgcctggaggtcgggaccgtcatgcgtgtcctcgactgcacagacaccgcgggcggcaagggactcaatgccgcacgtgccgtcgcgacgtgtggggagagggtcgtggcaaccggattcgtgggaggcaacaacggtcgcctcctctgcgagctgctggagcgcgatggaatcccggaggacttcgtgcgggtcgccgccgagacgcgctgctgcgtcaacgtgctcgacgaaaacgagacctcgacagagttcctcgagcccggtcgcgaggtgagcgccgacgagttcgccctcatgagggagaggctcctctcaatcgccgcccaggcgtctgtggtcaccatcgacggcagtgtgccgcggggcgtctcggcggacgactacgcgggactcgtcgagttggtgcgcggcacgggaacgccctgcatcctcgacacctccggggcgctcctcaagtgcggggtgaaggcccatcccaccatggtcaagcccaacgccgacgagataggccagctcctgggccgaacggtcacgagcatggacgaggtcgcggaggctgccgcggagctgcacgagggcggcgtggagcaggtcgtggtgtcccttggaggggatggtgccatcatggcctgcgacgacggcgtgttcaggggcctctcgcccaagatcgacgtggtgaacccagtcggttcaggagacacgatggtcggcgcgtttgcggttgcaatggcgagaggcatgccccgtcccgagcagctgcgctttgccatgggctgtgcgtccgccaactgcctctcaaagtacaccgggcactttgacatggaagacgccaggaggctctcggagggcacgcgcgtcgagaggatcgactagcccggcattcgccatgcgccgcccgcatacgtggagaggggcgtctgccgtggcaggcgcccctctccccttttagacgagactctagaggatcccgaagaaggacaggaggatgctcagcccaaaggtgacgaggatgagcacgaccgggttggcctggcgcttcttgatgaagtagtacatcaggaagacgtagccaaacgccagcatgttggggaagatcttgtccagcacgtcggtctggatcgcaaccttggcattcgcgttgacctgaaccacggtctggatgctgatgctcacgtacgacgcaatcaggccgccgagcaccgtgcagcccaggacggtcgcggccttgccgatcttggcggacgcctccctgagcttgccaatcgccttcacgcccaggccgtagcccatatgggcccacagtggcctgatgaggaacagggccaggtagacgaggaagaacaggattgggccgacggggctcccctccatcgccatggacgagcagatgcccgcgaggatgggcaggagcgtgaaccagaagatggcgtctccgatgcctgcgaggggcgggaagagcgcgaccttgatgttcctgatcatgctgcgcggctggtgcgcctcctccatggcgaggacgaggccgttgaggaagcctacgatgtgcgggctcgtgttgataaactccaggttgtcggacatggcgtccgagaggccctgggggtcgtccttgtagatgcgcttgaggtagggcagcatcgtgagcagccagccacccgcctgcatcctctcgtagttgaaggacgcctgcaggaatatggtcctgtacgccatcctggtgatgtcggcgtgcgtgaggaccttgccaccctcttccttggcgggggcgtcgtccatgagctccctgtcgttagatgccatcttcctcatcctccccaccgttcacgcgagcctcagcgagcgcctctttcactgccttgtcgcggttgtcatcaatcgagtacacgaagagagccagggcgagtccgacgacggcgacgggcagcaggttcgagaagttgaggaacgatgccatgacgaagccaatcagcaggaagggcaggaactcgaaggtgaacatgacgttgaggagcatcgcgaagccaatcgccgggagcacgccgccggtgacctcgaagccatgggcaagccagtcgggcaggttctcgaccagcgtcttcatcgcgtcctgggcaacgtaggcgcacaggaagacgatcacgccgtagagcagggcaacgatggccgtgcacacgatgttgacctgcacgatcttgccggtgtcacccttctttgccgcctcgtccgccggtcccatgaagaacgagaaggcggagtagcagagcaggatcacgtactgcatgaggaagctgaaggggagcgagagggacattgccgccgcgggcttggttcccgtggtatgggcgatgaccaccgccatcacgcccgcgagcaccgggttgggcggttgggtgccacccgccggggtgaggcctgcgaaggccagctccgttatgccgccgcagatgatccccgtggtcgggtcaccaaggatcaggcccgttatggacgagacgatgatgggcctaaagatgtagaacccctcgagccaaaagtctatgccgcagacgatggccatcaaggtgagggccaacccctgccccagtgtcactggcatacgctcgtacctccctgttcgcagaccaatgctgacgtggtgctaaacgtcgtagcggatgcgctccttgactgcacccggaacgtcctggatgtagacgtcgacaccagcctcctcgatagccttgaagtcggcgaggtcggcgtcatccacgtaaaccttcttcgtgatcgcgcgcttgccctccgagaagtgcatgttgccaacgttgagctcgtgaatgggaaccccgccctcgacaagctggcgggcctggtggggagtcctgaccacgatgaagatcttctgcctgggggctgccttgtgaatggtggagatggtcttgtccaccgtccagaagcgcacccccacacctgaggtctgaagggtcatgctcatgatctcctgcacgaccttgtccgacgccgtctcgtcgtcggcgacgacgatcaggtttgcgccaagggtacgcgtccacgtcacgccaacctgcccgtggatgagcctgttgtcgatcctcgtgaggaggatgtttggttcggacattcgccactcccatctctctgcccagccggggtgtctaggcaaggatggtaggcgccacacgtgaggccaggcggtcttttaaacctgccgagcgaaaggtgaaaacttccggacacacggtcacgcccatggatatggcatggcacatgcggcctgccgaatccgccttggctcgcgcgcaccattgtgtcacgtccatggattgatggacatgattaacccatttagaaacgttgacggaatattctgtgcctcttacaaataattctggatactctgtctatgccattctttgctcgtccgataaatcattaccacccgcatagcgggtggtttgctcttagggtataacccagaaaagccggccagggactcaagtccctggccttcacttcgttcaggcccgatggccgcttgactcgtggcgtgcccgtcaaacgggctgtgccagctacctcttgaacggatcctcatactccttgacgctcagccggtccagggcgatgtcccccgctcctgctcccggatgtacttcgcgttctggccctcgttcaggccgacggtggacaacgtagtagccctccgcccagaacttcctgttcccgaacttgtacttgaggttcgcgtgcctgtcgaacatagggagcgagctcttccccttcaggtaccccatgaagctcgacacgctgatcttgggcgggatgctcaccagcatgtgcacgtggtcgggcatgaggtgccctcgatgatctcgacccccttccactggcatagctgcctgaggatctgcccgaggtcctcgcggtattggttgtagatggcccttctcctatactttgggcaaaacacgatgtggtacttgccatccacttggtgtgcgcgaggctgttcgccttctgtgccatggtgttctccttcctctcgcggccggcgacctgaacaccgccatcctagaggggagggagttttgttgcatagcgtcagtgtcatccacccgctgagcgggtggttctctgtgtcgcgcgtggcgcgacacaggctaaagccatgaatagagcccccagtcgttcgactgggggctcttgccagcatcccctcttccgggggaacagagactcatcggctacttgtgctgctgctccttgaagtcgtcaggcgagacgtccttcaggaagtcgcggaaccgctcgagctcgcggttctcctcgtcgcgcttcactgcgtcgaagttgggcatcgaggccgcctcgatgaccccctcgtcggcaaaaatggggacatgggcgcggaccgcgagggcgagcgcatcggaggggcgcgcgtctacctcgacccttgccccatttgcgtttgtgagaaggagcttcgcgtagaaggtggtacccctcacgtcgacaatctggaccgcgtcgaggctggatccaagcctgccgatcgtatcgagcatgaggtcgtgcgtcatgggcctgtcgtgcgtggaatcgtccacgcccatggagatggccgtcgcctcgacgggccctatgcgaatgggaagctgctcgctggcctcgccgtcacggggatggcgggtcttgaggacgacgagcgaggtgacgggacccccgcctacgacgaccgtctcgatgtccatcctcttcatagccacatgcccctctttgcctctcgtgcgtatcgtgtcgcatatggtacccaacaacgggtggcttgacgcgagaatacacacagatgtgccaagggacattttttccaaattggatgttgacccgcctgcgagtctcgagtaatatgtcttctcgcgttgggcccgtagctcagttggtcagagcgtccggctgataaccgggaggtcacaagttcgaaccttgtcgggcccaccacctttttgataataaacaccccagcgctagccgagtcgccgctggggtgtttattgcttaaggggacgtagctcagctgggagagcgcgggctttgcaagcctgaggtcgtgggttcgatccccatcgtctccaccatgattttgatgtagccagggctgtatgtcctggcttttttattgcatctccccccaacatcttcccggtcggggcaagtggcttcatacaaagcgaggggtgcgacgcgcctcgccgcacccctcgccgtaagccactcgtgtaaggaggacgctactcgtcgtcctcaatcatggactcgtcaatctcctcctcgccgccgatgtcgacgggttcctcctcgccggcctccttggcacccgcggcactgaggtcgagcatgccctggttctcgtactttgccttgggagccttcttcttgtgcgcgaccatgcgggcaacggcggagagacggtcggagtctcccaggttcatgatcttgacgccctgggtggagcggccgagcaggctgatgtcagagctcttgaccctgatgacaacgccctcctccgagaccatcatgagctcgtgctgggggccgacgaccctgcaggccaccaggttgcccttcttggaggtcatgctgatggtcgcgacgccctggccgccgcgcttgtgcacggggtactcggagacgggcgtacgcttgccatagcccctctcggtcaccacgaggaggtcacccttgccgttgctgatctccatgccaagcatcttggcgccatccttgagggtgatgcccctcacgcccgaggtgtcacgcccagtgggcctgacctcgctctcctcgaacacgatggccttgccggcgtcggagcagaggatgaccctctcgcccggcttgacgcggcggacgttgaccagctcgtcgcccttcttgaggttgatggcgatgatgccgtcgcgacggctcttgtcgtagtcgctcatcgcggtcttcttgaccatgccgttgcgcgtggcgaacatgagatactcgtccgtcgggaagtcgcgcgtggtgatgaccgcggtgggatgctctccctcctccagaggcagcacgttgaccagggccgaaccgcgggcgtggcgggagccgatcgggagctcgtgcaccttgacgcggtagaccttgccaaagttggtgaagaacaggacgtagtcgtgcgtggacgccacgaacaggtcctccacgaagtccgtgtccttgagcgagaggccctggatacccttgccgccacgcttctgggacctgtaggtcgcgacgggcaggcgcttgacgtagccggcgtgggtcacggtgatgaccatgtcctcctcggcgatgaggtcctccacgtcgaggacgaccggggcgtcggagatggtggtgcgccgcttgtcgccgtacttctccgctatctcgcgcatctcggtcttgatgacctcgaggatctttcgctggtcggcaagcagcccctcgtagtactcgatggcacgacggagcccctcgagctcctcctggatcttgtcacgctccaggccggtaaggcgacgcaggcgcatctcgaggattgcggtggtctgctccttggtgaagccaaaccgcgcgatgagccgctcggatgcctcggagtcggtgcgactcgagcggatgatggtgatgacctcgtcgatgttgtcgagcgcgaggagcaggccctcgaggatgtgggcgcgtgcctttgccttggcgaggtcgaacttggtgcgcctggtgaccacgtcgacctggtggtcgatgtagtactggagcatctccctcagcgagaggagcctgggcacgccgttgacgagggccaggtcgatgatgccgaaggaggtctggagggacgagtacttgtagaggttgttgagcacgacctcggggatggcgccctgcttgagctcgatcaccaggcgcaggcccttgcggttggactcgtcgcgcatgtcggagattccctcgatgcgcttctcgttcaccagctgggcgatcttctcctgaagcgtgcccttgttgacgccgtaggggaactcggtgaagaccagcttgttgcggccgcccttggtggactcaacgtgcgccttggcacggacggtgatgatgcccctgcccgtctcgtacgcctgcctgatcccctcggagcccatgatcacggcacccgtggggaagtcgggcccggggagaaccttcatcaggtcgtccgtggtcgcatcggggttgtcgatgagcatgcaggccgcgttgatggtctcggtcaggttgtgcggcgggatgttggtcgccataccgaccgcgatgccctgcgagccgttgaccagcaggttgggaaagcgggaaggtaggaccacgggctcctgcagcgactcgtcgtagttgggctgccagtcgaccgtgtccttgttgaggtcgcggagcagctccatggcgggacgcgccaggcgcgactcggtgtaacgcattgccgccgcgccgtcgccgtcgatgttgccaaagttgccatgcccgtccacgaggggcacgcgcatggagaaccactgggcgagacggaccatggcgtcgtacaccgcggagtcaccgtgggggtggtacttgccgatgacctcgccgaccgtccaggccgacttcttgtggggcttgttggggaagatgcccgcctcgttcatggcgtagaggatgcgcctgtggacgggcttgaggccgtcgcgcacgtcggggagggcgcgcgcagtgatgaccgacatggagtactcgatgaacgactgctccatctcgtgaccgaactcgtggaactgcaggcggccgccatggacgtccaccccatcgccgtcgccgcggttgtcgggggccatctgggcctccccctcgtccgcgtcatcctccgcgtcgtcctcgtcagaggagtcgtccaggccggcctcgtcctcggcgtccgggtcgtagacgggaccctcggactcgtcgcgctcggctcggtcgaggagctccctcaggtcctccggcagcatggcgccgtcggactggccctccccggtcccgccgttcatgttgttgtcgtctgccacttaagctgcctttcgcctagatgtcgaggaagcgggcgtcctttgcgtgacgctcgatgtaatccttgcggtactcgaccgaggtgcccatgagccgcgacaccgcgaggtcggcgcgggaggcgtcctcgatgctgatgcgctggaggattctcgtcttggggtccatggtggtgtcggccagctgctgggggtccatctcgccaaggcccttgtagcgctggacgctgtacttgcgctgcttgccctcagcatcgcggggaacgtactcctcgatcgcctgggcaaggagcgtctcctcgggcgtctttccgtctgggtagacgtagtggatgcgcttgcccaccttcacgccaaagatgggcgggcaggcgctgtagatgtagcccgcgtcgatgagggggcgcatgtacttgtagaagaaggtcatcagcaggatgcggatgtgggcaccgtcgacgtctgcatcggtcatgatgatgatcttgtgatagcgagccttggagatgtcgaagtccccgccctcgccgttgttgagcgtgacgccggtgccaatggcggtaatcagcgactggatggtgtccgagctgaaggcacggtggtcccccacgcgctcgacgttgaggatcttccctcgcaggggaaggatcgcctggatgtcgcgcctgcgaccatcctttgcggacccgcctgcggagtcaccctcgacgatgaagagctcggtcatggaggcgtccctcaccgagcagtccgcgagcttgccgggaagcgacgccgtctcgaggaggctcttcctgcgcgtcgcctggcgcgccttctgggcggcgaggcggcccttggcggcctgggcacccttcttgaagatctccttcgcctggttggggtgctcctcgaggtactcggcgagacccgccgagacgatcttgttggtgagcgtcctcatgtaggagctgccgagcttggccttggtctgcccctcgaactgcgggtcggggagcttgacggagatgactgccgtgaggccctcgcggatgtcgtcacccgtgaggttggcgtccttctccttgaggagcttgtggctgcgggcgtagtcgttgacggtcttggtgagggcggtgcggaagccctcgaggtgcatgccgccctcctcggtgtagatgtcgttggcgaagctcatgaccgtctcggagtagctggtgttccactgcagggacacctcgacctcgccctttcgcgctacgggcgcgtcggggtcggaggtgccctcgatgtagatgggcttggagcagccggggaggacggtcttgccgtcgttgaggaacttcacgaagtcgatgatgccgccggagtagcagaactcgtccacacggggcgtgagctccctctcgtccttgaggacgatcttgaggttcttgttgaggaaggccgtctcctgcaggcggttgcgcagggtgtcgtagtcgtagaccgttgtctcgaagatctggtcgtctggccagaaggtgacggtcgtgcccgtcgcctttgagtcgcccaccacgtgcatcttcttggtgacctcgccgcgggcgagctcgatctcgtagacgtggccgtcacgcctgacctgaacgaccatcctcttggaaagcgcgttgaccacggagatgccaacgccatgcaggccgccggacaccttgtaggcgttgttgtcgaacttgccgccggcatggaggatggtgaggacgacctcgagggtcggcttcttctcggtgggatggaggtcgacggggatgcctcggccgttgtccacgacggttatagagttgtcgggatgcaccgtcacctggatcttgctgcagaagccggccatggcctcgtcgacggagttgtccacgacctcccacaccaggtggtgcaggcccgtcttgctcgtggtgccaatgtacatgccaggacgcatgcgaacggcctcgaggcccttgaggaccttgatttcctctccgccgtagtggtgctcgttcttcttgaccacgcaattcctctctcgaagagtgggagagacgatcctccctagactcgtcagctctcccatgatacgccacgatgacccgcaagacggcccgttacctcaggctcaggagaatcaacacgtatcttgagaggcgatttctcgcctgaggcgctcaggtgccgatatttggccacatcgtcactttgacgtgttgtcaagcttctcgcgtcgcatcgagagttccatggcgtcgcgggccctctgcctgaggggctcggggaggtcggccgtgagctcgtccgccctccgccgctcggcatccgtgagcggggccagctcgacagtggcgggcgacggctcgtcctggccggacgactggaccccctgcgccggctcgcgcgacagcctgaactcaacgcctgacacctcgaacccaaccgccgcaagcctcaccaggtagatctcgcggtttgccatgaagtcggtgaggcgggagtgggagtcgacgtacacgacgaggacgggcgggagtccgctcgcggcggcacgcttgaggtacacgcctgacgtgtggcgcctctcgacgtcgccgttcgccttgaaccaagccatggcggcgcgcctgtttctgccgagccgggcccacgcgcctcggcccatcatctcgtcgaggaccgacgagatgtcctccgacgaatcgcccctgaggtcgagcgggacgccgtccgggccaacgggacggcgacggtccgagccggggaggtagcgcgggtttcccctacccaccgatctccaccaccttggcgccctcgaggaggtcgtcggggaagtaccccaggttggtcgtcgtgaccaccgtctggatccccgattgcacgaagcgcgtcatgctcgcgcgccgatgggcgtcgagctcgctcatcacgtcgtccaggaggaggaggggctgctcccccaccacctcgcgggccaactcgacctcggccatcttccaggcgaggacgatggacctctgctgcccctgcgacccaaacgcccgcgcgtcgcggccgtcgatggagaaggtgaggtcatcgcgctgcgggcccacgagcgtctggcggcggcggagctcctctcccctgagctcgccgaggcgggacaggaagacgtcggcgatctggtcgcgggagagcccgaggacgtctgggcccagggagcactggtaggagcactccaggcgctcgccgtcggagatctgcccgtagatggcggagatgtgcccccgcagccgctcgaagagcctgaccctcgccgagaggagcgtggcccctcccaacgcgaccgaggcatcccaggcatccaacagcgagaggtcgggatggtcgtccttcagcagcctgttgcgctgctcaactgcgcgaccgtatgccgagaggagctttgcgtacccgcggttcgcctgccgaccgaagccgtcgagctcctcgcggcggtaggaggcgccgcgcttgacgaagctcaggtcatcggggttgaagagcaccgacatgagcgtctgcggcatgtccgaggcgtggcagcgcttgccgttgcgctcgaaacggcgctttcccggctccaccacgcaggcgacgtccaccacgcgcccgtcgccctccatgcgcgcggatatcctcgccgaggtgcactcctcgcggacgagctggctgggcttgggcttgcggaacgacgtcccggcggtgagcatctgcagggcctcgaccgtgttggtcttgcccacggcattgctcccgcacagcacggtcatcgttggggagaggtcgaggtgcctctcggagaagtttcgccagttcctgagccccagactggtgacgacgagtcccaaggtgtctacatcctcacgggcatgagcaggtagaggtagttgatctgtgcgtaggacttgaagatcgccggctgcatggtgctttgcagctccagggtgacctccttctcgctcccggccgcgttgacgcagtcgaacacgtagtggtagttgagggcgatggacatgctctcgccctcgacctcgacaggcaggagctcggtcgactcgccctggtcgggggagctggccgagagcttcatgacgctgccgtccgcatcgacgtcaaagcgcaccgaagggttggcgagggcaatgaccgagactcggcgcagcgccgccgcgaactgctcgacgtcgatcttgacggaggtcgaacaacttgggggaaggagctggcggtagttggggaaggtgccgtcgatcttcctcgagatgtaggtggtgttcccaaacacgaacacgacctggctgtcggtggtaccgatgaggaccgtctcggtcatggacgggaggcccagcacgtcgtggaaggtggtgccgggaacgatggtcacgaacgcctcgtcagacgacgaggtctcggcgttggagtcgcacaccgccaggcggtaggagtcggtcgcgacgaggcggatggtgttctcctccacggacaggaggatgccttggaggatcggacgggacgtgtccttggaggtcaccttgtacaccttgtcgaccatctcggagaggagcgcgctcggcagctcgattgcgcgcgagagggcgaactcggggaactccggaaagtcggagggctccagggtgttgagccggaagctgctcttgtcgcaggagatggacatcacatgccccgacccctcgaacgtgaccgcggcatcagggagcgtcttgacgatgttggagaggatcttgcccgagacgaccgtggtgccgccctcctcgacgttcgcctggatcttgtgacggatcgagatgttgaggttggtggtctggaactccaggaccccgtcctcggccttgatgtagatgccggagaggatggggagggtggagttggtcgccatgccctttgccacgacggagagtgcctgtgcgagcgaggattggctaacggagaacttcatggtggtcccttcgaggagcgtggctaagagtattagtacttatatatagataaagagatattagtagtaatagtcggtgttgaaatgttgacaatgctacgtcggcgcaggtaggtgatatcgtcgcgaccccgagtccctgtccttcgcgtcaacgcttccgacaacgcggaatcttgtagaaaactctttcaccatcacccacccacttatcaacgcttttctacatggtttgcaccgctcggtcgacagcgccctacccggcgtccgtgatgctgtcgtgcagggtctggacgcggtcctggaagatcctgtcctccttcttgctcttgtcgacccacgcgatgctgtgcttcaccgtggcgtggctgcgcccgccaaagtgcttgcctatgtccgccagcgtgttgtcggtgagctccctcgtgagccagatggcgacgtgccgtggctccatgagctccttgttgcgctttgagccgacgaggtcggtgtgggacacgtcgtagaacttctccaccgccttctggatctgctccacggtgatgaccctctggcccgtgggccacttggcgtcggcgtacttgatgatgtcctcgcgcgtgagggactcgcccttctgctccttgcggtaggcgttgatcaggcaggtgtggacgaagccctctatcaccctgatgttggtcccggcgcgctcggccatgagctttctgttctcgagcgagatcgttccgcagatgttgggcacgtgctcgcgctcggcgtcctgcctcatgcggtcgtagaaggcgttgatgaggttgagcttgagctcgtagtcgggcacctgcacgctcacggtgacccccgagtccatgcggctggtctcgcgctcgtcgaacttgctgtcccccatcccaagctgcgagggcgagcggtccgcggcgcacacgatctgcttgccgtggtccatcagggcgttgaacgtctcgaagaagaagcggatgctgcccgctgcggtgcgcatgttctggatgtcgtcgatgatcagcacgtccacgttctggtagcgccgggagagggcgctcctcgcgctgagctgcgggtcgttccaggctatgcggtactcctcgatgaactctgccgccgttcggtagacgcagagcctcgaggggtcgttgctgatgatgtagttttggatggccctgagcaggtgggtcttgccgaggccgctcttgccatagatgaacagggggttgaagcggctgttctcgccgttcgcgacctgttttgccgcctcgtaggcgagcatgttctcttcgcctgccacgaagcggtcgaaggtgagctttgagtctgcgatctcggggtcgttgtcaaagccgggggcatcctcgtcatctctcctgctcacgggtgtcgagacgaccgaccttggttgcacctcgcgctcccggggtcgctccgcctcgtcctcccggatcctctcggcctcctcgctggatatgcgcgcccccgtttcgaccggggtggtgtccgtgtcctggacgaggtccaccaccagggcgaccggctggaacgccgcctgctcgaggcagccctctatggtctttgcctgctgcgatacccgccgctggacaaacgagagggccgtgcccacgtgaaggctcgacccgtcgaacgagatgggtcggcagctctcgagcatggtgagcgttgcagggggcatcccgccctggcgaagtagccccagcgtgtcgttccacaggagggaggcgtctgattcctggtttgggtccattggtcacccgtgtcttggcgttgaaatgtcgaaaagtccctgacattatatgatgaaaactcacctacgggggaggatgccggtgcccatggctggcgaagtcgcctgttctggctagattctggcgaggtatgccttgccgagctcggtgaggcacctcttctgctcgcccctgcgcttgatgagaaggccgtcctgttccagcgtctgtagctcgcgcgaccaggttggctgcgagcccccgaggctcctcgcgaggtcggttggcccgacggagtcgtggtccctgaggtacgagagcacctgccaaccgcggcctgtgagcgccacggtcggcacctgcggagcatcaatctgggcagcctgctgaactggtgcccgcatcgtgccctgcgcgccctgctgctggtagggctgcgcgggtgccgcctgcccctggtaaggcatctggtatgccggctgcacctgctgctgccagccctgcccatacgccgcgggctgttgggtccacggtgcctgcgcctggtagcccggctgcgggtagccgaccggggggtagggcgtggcaggtggctgctgccagggggtttgcgcagcgtaggactgctcgctcgccattcccggccactgctggcccgacggctgggccggccacggctgcgcgaccggtccctctccccctcgggcctcctgtcccgacctggtggatatggtcacaacggtgccgcccgagatgttgtcctcgatggtgagggaaccgcccttgtcctccatgtactgctgggcgtagggcaggcccgagccgaccccgcgaatgtacttgcgcatctcctcggtggcggaggacgtgccgtactccagtgcgcgtgccttctccctgatgccgggacccttgtccgagaagcggatggtgtctcccccgtcgaggattgagatggtcggttggatgaagtaggcgtggatgaagttctcgacgacctcccttatcaccatgaaggggatggagccgccctgctcctttgcgagcctgaccacggtggcggttatctcctccaggtaggagcgaacgtcctggggctggatgacgacgacgcggggtgcggcggcggcatcgtcgtagacggcgatgcgggcgggatacctgacctcgagcgcgctgtccccaccctcgttctgtgtcggctcgccgccctgattgtcgacgaacggatagaacgactcttgcatcgtctgcgctcccccttgggttttcgaccgatgttcatcagtggatgaaaacttccgttctgaatgaaactacgaaagaaagttttcaacatgcgatgaacaaatgttgataactgggggtaccgcgtacgaatatgacgaaagaaaacggtcagaatcgcctgtgttttcccagttggaatgtaatcttacaggttttcattcatgctttccattccgcatgaaatgtgaatgtgcacccttggggacccctctcgcgcatcggcctcccgccgagcgcgctccccggcaaaagcgttcaaagggtgaattatgctctggaccatggaaaaaattgacatttgaggcttcccacccctacaatcttggggcttgacgctataggttctacgtttacatccaggaggatttcgtcatgaagcgcacgtatcagcccaacaagaggaagcgcgcaaagacccacggcttccgcgcccgcatggcaaccaggaacggccgcgccgtccttgcccgccgccgtgccaagggtcgcaagcgtcttaccgtctaggaccccatgaagaccatcaaatccaaagcggagtttgagagggtcttctccagcggaaagcgggccagtcacaggctcgtccgcgtcacagctctcaagggtgatgaaggcgacttgggcagagtcgcctttgttgcacctaagaggctgggcaatgcggtgtacagaaacaggtgcaagagggtcctcagagaggcggcgcgctcgtgcgggcttcccgttccgggctacgacgtcatactctttgcgaccaggcaaactcatgagagctccccgagccaggttggcgatgcactgtccgccctccttgcgcggtctggggtgagaaatgagcgatgagcgtgggcgggaatcactcccacagagggtgtgtctcgccctcgttcggttttatcgccggttcatctctcccctcacccctccctcgtgcatctactcccccacctgttccgaatatgcgctgcaggccatacagaagtatggcgccgcaagggggtgctggctcgccctcaagaggttgcttcgctgcaacccctttcacaagggcggctatgaccccgttccctagcagaaacagcccggaggaaccatgtgggattggtttattaacttcctgaccggcatcctggcccagctcgccgcccttacgggtgactggggtcttgccgtcatcgtcatcaccttcatcatgcgactcatcgtcatgccccttcagacgcggtcgacgcagtcgagcgcccgcatgcaggcgctgcagccgcagctcatggagatccagcagcgctacgccaacgatcccgagcgccaggcggacgagatgcgcaagttctacgccgagaacaagttcaacccgcttggcggctgccttcccctcctcatccagatgcctgtcttcttcgcgctgttcgcggtcatgaagaaggttcccgagaccgcccacttcctcaacatcatgccgtcgctctcccagagcgcggctggtgcctgggcggcgggcggcttctccggtgctctcgtctacatcctctttgacatcgcgtttggcgtcatgacattcatccccatggtcatgaacctccagaacaccacggaggaccagaggcagcagacgctaatcatgggcgttgtcatgtcaatcatgatgctctggtttggatggacctgccccggagcggtccttctgtactacgtgacctccgccctgtggcagaccattcagcagaaggtcgtcacgcagagggtgatggacaaggtgaaggcggagaccgaagagaagctcaagaatcagccggtaaagatcgacgtggttcgcaaggagcacaagccgcgtcccaagaagaagcactaggcccggcgtcgcgttcggttttcacattccctgtatctgttccctttggaggttcacatggaggacgagaaggtcgtctcgacggcagagacggacgaggcttcccaggcgcaggacgactttgcttccgtccgcgagcactttgaggcgggtcaggagctctctgacgaagaggtcgacaagatcgcagacgcggccgttggctacctcaaggccatactctcctactttggggagaacggtgtctccatcgatgagtacgatggcgatgacggggagctcattctcgatgtcaacggtggcgacctggcggtccttattgggaggcacggacgcacgcttgacgcgctccagatgatagttacttcatttatgagtaaccgtctcaagttccactaccccatcgtcgttgacattgaggggtacaagggccgtcgcaagcagaagctgcaaggccttgccctctctgccgcaagccgtgcgaagaagcaggggcgtgtcgcacttcctcctatgaatgcctacgagaggcgtatcgttcaccttgcacttgtggatgatgcggaggtcacgactcactctgaggggtcagagccagagaggcgtgtcgtggtgacctccgtgaggtaagactgaacgatacatggtatcttgtgaggggagaggctcaaggcctctcccctttttgtcaaattctttctattcaaaggtttttgtccaaaggaatgaccatgcagcaaagcctggaccccctctcctctacacttatcgaatatgcgcaaggatatggcgttgacctctcggaagaacaggcaaggatgttgattcgacacctttcgctagttcttcagaagaatgagtacatcaacctcacccgcattactcaacctaacgaagcccttgttcttcacatcatcgattcggttctcttttctaccgtgatgccttggggattcggtgactccttccgactgcttgatatgggtactggggcagggtatccgggtatcccactcgccatccttttcagcggtgcaaggtgtgatcttgctgactcagtgggtaagaaatgtcaggctgtctccgagtttattgacgagcttggactggcaggtcgagtcaatgtcatttgcgatcgtgtcgaatcgatagcaaagacaaaggggaagtcatatgatgttgtgactgcccgtgccatggacaagctctctgttctgcttgaatacgcctcaccgctcctctgccataaggggactctcatcgcttccaagggcaaacttcaggacgaggaaaagtcacatgcacttagcgttgctccaacccttgggtttgagcttttaaagactaagcagttggaactacccaatagtcttggttctcgtgaaatcctttgctttaagaaagtctctcaaccgaagattcacttgcctcgagcaattggagcgcctaagcataaaccgctttaatttctgttgatgtttcacgtgaaacgttacgagagacaattcgtagttgtagtgtttcacgtgaaacaattcagcacagctaaactttgaactagagacataaacgagtttcacgtgaaacatcggaaaatcaatccgggggtacaagaagaatgagcttcaaggatacaaagagagccttcccagataggccagcaagagttatggctatcatcaatcaaaaaggcggggttgggaaatcgactacagccgtaaacctctctgctgcattaggagagtcaaaaaagaaggtactcgttattgactttgacccccaaggaaacacctcgtctggatatgggattgagaaagacgagttggaacacgatgtctacgatgcactgcttcatgactttccaattgaagagatagttctagatacctgcgaaccaaatgtgttcgtcattcctgcaacaattcagcttgcgggagcagaaatcgaactcgtctcaacgatggcgcgcgagagcgtactcaagaacatcctctcccccatcgtgaatgactttgactacgtgttcattgattgcccaccttcactcggccttctcacgataaacgcattggtggcagcagattctctcctcattccgattcagtgtgagttctacgcacttgaagggcttacaaagctccttgagtcaatgaagatggtaaagaagaggttgaaccctgaactcaacgtatttggagtcgtcatgacaatgtatgactccagaaccacgctttcaaaggaagtcgtggaggaggtacggaagtactttgggaagaaggtcttcaagacgatcatcccaagaagtgtgaagctctccgaggcaccgtctcatggcgtgccaattacgatgtactcaagggttaataagggtgcgttggcatataggaaccttgcaaaggaagtggtgcgtcgtggctaagaggagcgggcttggaaagggacttgagtcactcatgggtaccgccgatgcagaggtaagtgctatagacgctgacactaccactctaccaattgcggagatacggccaaacaaggggcaacctcgaaagaactttgacgaggatgctctcaatgagctcactgattcgattcgacagaatggaattctccaaccaatactcgtgagaaagaagggtgctcactacgagattgttgcaggggagagaaggtaccaagcggcaaaactggctggtttgaccgaggtccccgtgtgcatcaaggacatctcagacaaagaggtatttaagctagctctgatagaaaacctccagaggtcggacctcaatccaatcgaagaggcacagggctaccaaaagctgttgaaagagaatggctttacgcaggaggagctcggaaaggcactctcaaagtcgaggtctgcgattgcgaataccctgcgactgctggacttgcccggtgaagttcaggacatgatggcagacggcaggctcaccgccggtcatgcgagggcgattctcgcggttgcaggcgaggacgggcgcctcagactggcacataaggtggtggatgagcacctgtcggtcagggagacagaaaagctcgcaccgctattttctggcacgcatagcgaggagaagccaagaagggagccccagccacagtcatacaaacgagccgcgaggcaactgaggcttgccttggatacgaacgtaaaggtaaagaaggtcaggaacaagaacaagatcgagattgagttcaaggatgaggatgaactagtgaggctcgttcagcgactgagctcaatgggggagtgacgagatgaaggtcaagaccctgggaacgtacgcgatactgattggagcaacgaccacccttgcaatactcgcatacaaggtattactaaacgaaggggcgagggactcggtcaggaagacggccgccagcgtcagaagtgcagtgaacgatttggagagagtggtccagaacgctaccgggacgtatgtcgaggaagatacgggggagagcaacagggcggagacccttaggcaatggtcttcccttgggttctagaaaattgatttgataaaatgaaggagcctgggaacatgtgttctcaggctcctttggtattggaatcgagaatgtctaagcgagaccggactcgacgttttgcctgagctgtccgcatgcagcgtcgatgtcagagcctcgagagttcctaattgtcgcctcgacgccaacgttaccaagccggcggacgaactcctgtgccctgaggtcggacgaggggaggaatttggagcccttcacgtgattgagctggatgatgttgacgtgcgcaagattgtccttgcagaagtcgcaaagggcagcgagctcggcgtcggtatcgttgatgcccttgatgagtgcgtactcgtacgtggggcgccgtccggtcttgtcaacgtactcgcccatcatgtcatagaggcgaagaagagagtacttcttgacaccgggcatgagcatgtcacgcgttttctggacggcggagtgaagcgagactgcaagggtgaactgctcgggctcgttggcgaatcgcttgatcatcgggatgacgccacaggtggagacggtgaggtgtcgcgcaccaatgccggcaccctcgggggagttgagcttgcgaagggcgccaagtgtcgcgtcatagttcatgaacggctcgccctgccccatgagaacgacgctcgtgacgcgcgcgttgaagtcgtcgcggacgtgcatgacctgctcgtagatctcgcccgaggtgagggagcgggtgaggcccgaggcgcccgtcgcgcaaaaggcgcagcccatggcgcaaccggcctgggtggacgcgcagaccgcgagcttgttgcgtgagggcatgccaacgcactccacgtggactccgtctgggaagcgcagaaggtatttacggctgccgtcggccgacaactgacgtgcaacctcctcgacgccaccgagtgtgaggtgctcggaaagcgtggccctcagagacttgggaaggtttgacatatcatcaaaattcgtaacgttcttctcccatacccactcttcgatctgcttggccctaaacttaggctgaccaagttcctcgagaagggagacgagctccgagtgagagacggtgtggacgtcacgtcgcttgatgggggctgaggggccaccagacaatgattcttgcatttttacctctcgttcatggtgggtgcggtagtggagtatcctcggaaactgggtgagagcacccatttaatcgagtctaacgcaccaccacagcgcgctaaggagtccatgcatgaccaagactgacgttacacaaaacaaggttgccgttctcgcgggcggttggtctgacgagaaggacatctccatgcagtccggaactgcctgcgccaacgcgcttagggaggcggggttcaaggatgtcgagcttcttgacgttgcggctcccgacttcgtggtgaggcttgcccaaggtgggtacgacgttgcgttcgttgccatgcatggccactacggcgaggatggctgcatccagggcctcctcgagattctgcacatgccctacaccttctccggggtcctggcatccgctctcgggactgagaaggaagtggccaagtcggtctacaaggccgccggcatccccgtccccgacggcgttgacgtcgctcccgacacgaggctcaccgacgagcaggtagatgagcttatcgcccgcctggggctccccatcttcgtgaagcccgcggccaacggctcgagctttggggtgacgagggtgaccgaggcctccggcctcaacgatgccatcgggaaggccggtgcgcagggcgatcgcgtcctcctcgaggcctgcatcgaagggaccgagatcaccgttcccgtcatcggcaacgacgacccccaggccctccccatcgtcgagatcgtgttcaactcgccgttctacgacatcaacgcaaagtacgagccgagctccatgcaccatgtgattcccgctcgcattcccgaggaggcgtatcgcaaggcgcaggagtatgccgtcgccgcgcacaaggccctgggctgccgtgggacctcaaggagcgacttcatcgtgaaggaggacggaacgcccgtcatcctggagatcaacaccatccccggcatgaccgagaggagcctcattcccgattccgctcgtcacgccggcatagagttcccggagctgtgcaagcgcttcgtggagtgggcgctggaagattaggggattgcctgaatgacaaaggggaccgaccccagtgtcgccaacgaggtgacgctggagtccatcattctgcccggaacgcccgagtcggttcgcgagcggtacctcacccttgccgacagggcgggggagaggggctttgacctcttggaggaggatgtcgtcgtcctggacaccgagacgacggggctctcgttcaagaggtgcgagctcatagagattgccgcggcccgactgagcgggcgcgaggtggtggaccgattccagaccttcgtgaggccatcgaagccgattcctcacgagatccagcggttgacgaacatcagcgattctgatgtggcggatgccccatccgccagggaggcagtcgcaagcctggctgagttcgtgggcggggcgccggtcctcgcacacaacgcgacgtttgaccgtaccttcatcgagtcggtccccggtggggcaggcgtctcggacacgtggatagatacgctcgccctctcgaggatcgcgctcccgcgcctctcgacccatcgtctctccgacctcgcgcatgcctttggatgcgactccgtgacgcatcgggcgaccgacgacgtcgacgccctggcgggcatgtggaggatcatcctgcttgcgctcaccgacctgccggcgggactcctcggggtgctcggggacatgcaccccgaggtcgattgggcctatcgccccgtcatctctcaccttgccctaggggagggggacgatcagcccttctcgctcaaggaggtccgccatgccttggtggaggaggggcgtggtcacgttagggaggacgcggcggaatccgacgtcgagcccaaggcgccagcgggccgcgtgatagaccagtgctttgacgaggacggcgtcgcctcacggatgtacggaaggctcgagcggcgtcccgaccagctgaggatggcgcaggaggtgcgagacgccctcgacgaggggtcgtttcgcgccatcgaggcggggacgggcgttggcaagtcgctcgcctacctgatccccgaagtgctctttgcgcagcagaacgacctcacggtgggggttgccacaaagaccaacgcgctcacggaccagcttgtctcccacgagctccccgcactctcggccgcgctcccgggaggcgtgagcttcacaagcctgaagggatacgaccactatccgtgcctgcaccgcgtggagacgtccgtctctgccgacctgcccgtctcccttgtggagggggtaggaaaatcgactcacaccatcgaggccgagatgctcacggcgctggcggtgacgctctcgtattgctgccagtcccccgacggtgaccttgatgccctgggcatacggtggaggttcgtcccccgccccatgctcaccgtgaccccggacgagtgcctgaggaacaagtgtccctactttcccaacgagtgcctcatccacggcgcccgccgtcgcgccgcccagagcgacgtggtggtcaccaaccactcgctcctccttcgcgacgtcgacatggacggtgcccttctgccgccaatccgtcactgggtggtggacgaggcgcacgggttcgaggcggaggccaggcgccagtgggcgcgcgaggtctcgggcgacgacgtgcgcagggggttcgagcagcttggcggcctgcggacgggcgtgattcaccaggtgatggcgcagctcgagccaacggagggggcgtctctccccacgcgcctggtcaccaagctggctgccgcaacgtctagggccatgacctccatggaggcgctcttcgatgccctccacggccttggctccgttgccccgcagaacggggggtacgacaacgtctcgctgtggatagacgagggggttcgtcagacgcccgagtgggcggcgctcctggagtgcatggaagccgccaagtcccgcctggacgaggcggcaaaggatgccgaggaggcctccaaggccattgcggagactaacggccagctcgcggccgaccttgcctccgcaaccaagttcatccccgagacgcgcgacgccatcgacctcatctccagcggagcggacgagacgtacgtgtactctgccgagctcgcgcgtcgcaggagggacgtcctctccgagcgcctgctcgcccagaagatcgacgtgggtgccgaggtggggaagaggtggctctcgcagatgcgcagcgtggtgttcacatctgcgacgatagcggtggggaaggacttctcccactttgagcatgcggtggggctcgacaccatgccagccggccgccgcaagtgcgtcaagctcggttcaagctttgactacgaccacaacatgtcgaccatcgtgtgctccgacatgccccagccaaatgaccgtgagtacctgcccgcgctcgaagatctcctgttcgacatccacagggcgatggggggatccgtcctcacgctcttcaccaacaggagagatatggagcgcgtgtaccagggcctcgcaccacgcctccgtcgggtcgggctcaacctcctttgccaggagagaggcgcctcgcccagacggcttagggacagcttcttggcggagaggagctgctccctcatggccctgaggtcgttctgggaggggtttgacgcgacgggggagaccctgcgatgcgtcgtgattcccaagctccccttctccaacccgacggacccgctcgtgagggagagggagctgcgagaggaccgcgcgtggtggcgtcactcgctgcccgaggcggtcatctcggtgaagcaggcggctggccggctcattcggacctcgaccgacaggggggtgctcgtcctggcggactcccgcctcgtcaccaagaggtacggtcggcagttcacctcgtcgctgcccaccagcgacttctcccgcctgccgagcgcggacgtcggtcgatacatcgaggactggcgagcgtcccacgagtgacggggctcccgacgcagcccatggtggcgttggctaacgggcctttgacagctgggcaacgcagtagtcggcgattgcctcgcgcaggccagcgtcttccacgaccacgcccgacccgcaggacgcgaggttccttgcaagccatgttccgccgtaccaggggagacttgtcgtcacgcttccatcctcgccgcgggcaaggacggtgaggtcgttccagttgcgcgagcgggcgagtgcgtcggacgagaagcgcacgacgaccctcttggttccgccatccgccgctgccgtgggggacgagcggcgcccctctggcgtctcgcattgcggggtgcccatgcggtcgaggcggaaggtcctctcgcctccccgaacgaggtcgaacccgtcgaggtaccaccgcccgtccgaggacctcaacgcctgcggtgcgaccttcctggtgagggaggtgccgccggaagcggcggcgtaggtgaacgagagccacatgccgtcggcgatcgcccgcacgcacgtctcgtaggtcgtgccggagacgttgggggacatcgcacggtcgagctccccgctgctaggggatggatgcccgatggcccccacgctctccctgaggcgtgccacgatcgggtcgtcgccgtccacgcctatggagtcgagggcggcgaggagggcgtaggtctccgagaggctcagccgaagctgccgccccctgacgccaccgccaaacgcgagcgtcagcgtgtcgtcaccctcgtcgtatgcaaggggcaggttgagctgctcctcgtcccagctcgttgccacgagcatgagcaggtgccttgcgtggttgacgtcacagccgaggcgcgccgcgacggaggatgcggatacctggtctccctggcgcgagagagcacccagcagcgcggcgagctcgcgggcctcgtcgattccgccctttctccccatgcgcttggcgtggcgcgcggtgcgagccgtctttagcgggggtcggggtgaggggcgatcggggtcgcgtgacgtgtcgcgggctgcgtcgagcgcctcctcgaacacctgccgccaccggctgacgagcgccttgggggcgagggggacgatgtccgacgccacggcccacgaggccgcgaggccgaggtccgatacgtccgaggtccaggtgcgcccaccgtcgactccgtccgcccacgtccctctcccctccatctgctcgcgaagctctggcgcaagtgggctgggaagggagaaggagcaggttgcgacggtgggaccggcctggaaggggagcttgaggaagtcccttaggcagaagtcctccgggacttggtacgttcggccatcgacccttcgggcggatttgaagcggtcgaggcggtaggtgaggggcctgccccaacccgtctctgtcgcgtcctcgcccgctgccaccacataggtgttcccgttcagcccgaaggagccgtagggggcaaggaccctcgcgctctctcgtccccttgcgtcgacgtaggtcaccctgacggcggtgcgggccgccaggcactccagcagctcgcgggcgacagacccgccgccctccgcgcctcccccaacgtacacgggggtggccgagccaaagtgacggtcgagctttgccagcgcgaggcgcaggtcggatcggtaggggaagtcggggtcggttaccaggggcgcacaggcgacgtcgagcgtcagcgcctcctcgggcaggagcacggacggctccgcgaacgtacgctgctcgtcgacgacccacgagccgtcctcgcccgactgcgagacgttcctcacgaccatcccacattgcgcgagcgcctcgcgatccctgccaaaggccctgcgaaagctctcgctcgagagctcgggatagtagacgcccctgatctcgtcggaggagaggggcctgcgcgagccggagaacgccatcaggaggccggcgatgcgccgtgccctctcgtcgtcacgggtgatccgctcccccgcgtcctccccaccgtgctctcgtgacatgtcagaccccttggacgtatctggtcaccctatgtgtgcatgtggcacgtagctggcaaaacgtggcggtgcctcaccgatggcggggtaccgtaatcctcgtacgcatgataagacgtatactcgaacgatgaaaagatggacgattctcacttccttcggcaaaggatgcatatatgtcctcaacgcgcagctatctggactacctggacgacaaggttgacatctctccggttaacagccaggaggagctcgacgaggcgcagctcatccgctccctcatggacgagcatggcctcgagaccagcatgcaggagttctcggcgccccttgcggcggagcttccccatgcggtcctctacatcgtcctcgtcctggggaccctgctctcggggtttctcggcagccgcgtggcgctggtcgggctcgtccttgtcgtggtggcgtttgccctgctcgccgcacggtattccggaagggacccgtttgcgcgcctcggacgccgtgccaacagccagaacgtgatcggcgtccatcgcgcgagtggccccctcgtcatgaagggcaaccgccccatcgtgatcgtggcccactatgacagcccgagcgaggacttcctctattcccccggtcttgctcgctaccagtccctgctcaagggtgcctcgttctactgcgtcatcgccgacctcctttgcgcggtcatccagctcgtcgcggtcctgcccgccggaatccgccacctgttctggatcgtgggcatcgttgccgcgatacccctggtggtgctcgccgcatccatcgtgtacgcgaggttctcgccctgcacggtcggtgccaacgacaacaagtcgtccgtcgccgcgatgctcggcgtcatggacaaggtgcgccccggcgacgaccaggccaagcgctgggcggagctccacccccgcaaggaggagtcccccgcaccgtctgccgagcccgaacgtcgtccttttgagcccgagccccaggcggcgccacaggagccggctgcctccgtcgaaccgcccgtgcccgcctcgcccgatcctgttgccgtgactgccgcgtccgacatgcccgtggtcgagcagccagcggcgtcggcgcagcaggacaacatcccctcgatcaccgatgccttcgtcccccaggtcattcccgcgccgcaagacggcgaccgtgcggtgcgaaggggcaccgagttcatccagagcctccatatcctccccgaggactgcgagatcgtgtacgaccgcccgccggtcccggatgtcgtgcttccggaccttccccccgtcgaggacctcgttccccagggggcaccggaggaggaagaggagccggagcctcaaaggaagcccggtgcggttcccgacttcttcgggggctcgtcccaaagcgaggttcaggagacccaggtgcgccccaagcctgtcgaccaggtgtactaccccgagtcctatcatgaggaggaagacccgatcgccgagtatgaggtgatcgaggacggggagccatccgcggagcatccctccggtgcggggtctttcttccgtcgccttgcccagaggttctcctccggcaggggagaggggcagccttccgccgcggagcatgcggccccggcgggtgaggtcgtctcgacccacgctgccgacgccccaagcgtcaaggtcgtctcacgtccccacgacgatgacgtcccccacatcgagaaggggcagacctatataaagagtcacgtgccgagcgtcgagccggacgacggggtgcccgcatccgagcaaacggagcgggacgccttccacatccctgacttcgtgcgtgggaacggtgcgtttgcatcccgtgaggaggaggcccccggcgaggctgtcgcatcggttccggagcctgcctcgcccgacacccaaaaggccgcggacgccgcagccgaacaggtaggcgtttcccccgtccccccggcaccgagtgagcccgtggcgcaggaccgggttgccggtgcggcggagggatcggagcagggcaacctcgcctctgacatggaagcgcacgcccctgttccctcgcaggacgaggttcacgtcagtgacacgaccggcctgccgccgctgagcgagaggctcccgcgcctggacgtcgagccgacgcccccaattgactcaaagagcgtgcccgctgctaccgatgggcccgtagcggaccagcccgcgtccgttgactcctccgagcccgagcgggtcgtgacgcccgatgggacggaggacggttccgccgactccctggccaccgaccaggccgcctcgccttgggtttgggagcaggaggtcatgggtgacgacctcaccgactcctccgtaacggaggagaccgagggcgcggaaccagaggaggcctcctcgggcgacgacggctgggatgcctgggggagccaggccatggccggcaacgatgccacacccttcgcctccgatgccagcgtgccccacgggatgcccgtctccgcattcgtcgaggggtcggagaggctctatggcaatccgtcgcccttctgggacgtcgcagatgctgagtacgagacgattgacgacgagccggatgagccaggcggtcaggacggccggccagagccggtctcatccgacgaccaggtgcagccggactccgccgtgacagaggtcgcgtccgcggaggatggggcagcggaggggatggatggcgcggcgtccctcgcagacacctcccagttggaacccagcgatgctggtgacgagcccacgctggtctcgcgtcccatcaaggcgaagacgatagacgacgtgtacgtaccggaggttcaggtgcccgctggcgagaccggtaccctcgaccccggaagcgcccagtccgagacccccatgacggcggaggttgcggacgaatggcctgcgacaccacccgagcagcaggacgccggcgccacgaccaagatgggcgccctcttccccgcggaggacgagtacgagacgtcggaggtcgcggaagcactcgcccccgtcgcggaggagcaagccgcggtcccggaggcgccagccgaggagaccgaggacgagacagcagtcccccagcgggcgattggctataccctgggcgaggagcccgccgaggtcacccctgatgactatggtctggatgacccgggcgagacgtcgtcatttgcggtgtcccaaacgcccgacgcgagcgtcaacgcatccgagacggatgccgtcgagacgaacccggaccccgatggcctgcccttctcgcttgacgacgtggtcgacgccgagtacgaggtcatagacgacgaaccagaggccgaggagccggagtcaaacaaggcggctgacgaacagtcgatgcccgccgagtccgccccgagcgagccggagcccgcacccccggcgttggaggacgtccatcccgaaaccactgccagtcagagcggcctcgaggggactatggcatacccgccgatcgagacggagcctgcgcaagaggagcctgccggcgccgtcatcgagaccgcggaggacgaccagccaaaggctgagacggcggacaaggtcgatgcgaccccgattcagcagagcaatccacaggtcctgaacttcgtggagaagaacgaggttcccgagagtgacgtggcgaaggacgattcgggacttgacccatcgaccatcgatcaggacgttcctgccgagcctcgcaagaagccggcagcggtggatgacccaacctggggcacgagcgacttcgttccgccacaggccaacgtcgcccgtcgcgccgtcctgtttgacctgccggatcctgccgttgcgacgagcgacccgttgggtggagacgatgacacctcaacgaacctggggacggcagccatcccccgtgcgaccattcctcccgtcacaccgctctcgggcacggaggcaccgcgccgcaaggcaagctatgcgcgtggcgagagggagccgatcggcttcctgagctctgacaccacgcctcaggggaggagcatgtctagaagcgggagctccaagcagtcccaccgcaaggaggggaagcgcaggttcgggttcttcggcggtcgctccaaggcggaggacgagtcggagagcatgggcgagtggcttggcgtgggtgacgactacgacgccaagagcggaggccgcgccataggcaactggaagaactttgaggagcaggagggcgacgactccgatgccacccgtccgggccactggaagggcggcgcaacccgcaggtttgacctccgtctggtcgacgacgcatcgcaggaaccacctcagcagaccgaggccgaggggtacgtcctgggtggcgagccggatccgtcagagggtcaggcacaggctgagaccgagggttacacgcttggcggggaggacccgctcgaggcacccacgacggacgagcagcagcgacgggacaaccaggatctggtcgaggccatcacgagcatggacgacgacgagctccttgcccacgacatctacttcgtggcgctaggagcctcctctctccgccatgccggcatggagaagttcctggagggataccgcaagtcgattcgcggcgccttcctcatcaacctggacagcgtcggtgcgggccagctcacggtcataaccaacgagggcgtcagcaagcctcgccgcgcggaccgcaggctcgtgaggctgctcctctccaccgcccaggacctgcacatcccgctcgagcgcatgaggctcaactggggcgagacggacgcgacgcaggcgatgcgtgcctccgtgaggggtgccaccatcatgggcgtgtcggaggacggtgtgccggcactctcacatactgccgacgacgtgcccgagaacgtgagcgacctgcaggcggcagacgtgacggagcttgtcgcggagctcataaggaggtcatagcgcgggccgttgccctgtgttagaatcacgtagcacgcgggcatcgccaagtggtaaggcaatggcttcccaagccatcatccgcgggttcgaatcccgttgcccgctccatagagaggatgaggggctccgccatgtgcggggcccctctttgttgcagggagggcagagatgggcatccccatgacgtccgaggagtgctcccgtgccatgcggggcatatcccaggagatcgagaactatgccgagctgctggtgaggcagggcgcggccatcaaaccgggacaggagctggtgctccaggctcccgtcgagcgtgcggactttgcccgtcgcgtcgtgcgccacgcctacgcagcagatgctgggcacgtcaccgtcatctgggcggacgatgaggtcaaccgactcgagtacgagaacgtggacctgccctactttgagcacacgccctcgtggaagatcgagcagctcaactcgcttgcaagcggcggtgccagcttcctgttcctggagggcacggacccctcggctctcgacggcattgaccctgccaagcccgctgcccgctcgcgtgcacgaaacaccgagtgcaaggccttcaggaacggaatggactttggcaggaacgtctggtgcattgcgggcgtgcccattgcagcctgggcgcagaaggtgttcccggaatatggccccgaagaggccctctacaggctttgggtcgcgatcctgcaggtcgcgcgctctgacggtgaggatccgcagcaggcgtgggagacgcacaacgcaaccttccagaagaacaagcgcctgttgaacgacagtcgctttgaccgcctgcactacgtgtcctcaaacggtaccgacctcacggtggggatgaatcccggacacatatgggagggcggcgccgcccgtacgattgacggaaccagcttcttccccaacatcccgacggaggaggtgttcacgacccccgatcgcatgcgcgtcgatggtgttgtccactcggcgatgcccctcgtccatgcgggtcagatcgtggatgacttctggttcaggttcgagggcggaaaggtcgtggagtacgacgccgcgcgcggcagggaggtgctgcggcacatcctcgagaccgacgagaacgcgaccaggcttggcgagtgcgcgctcatctccaagaacacgccaatccgtcagagcggcatcctgttctatgacacgctttacgacgagaacgcaagctgccacctggcgctggggatgggcttccccgagtgcatagcaggcggcttccagatggacgaggaggagcttctccgccatggggtcaaccagtcacgcactcacgttgacttcatgattggctcggacgacatggacatctggggtgtgggcgaggacggcagggaggtgcccgtcttctccaacgggcagtggtcatgggagaacgagtagccacgggtgcgtgttagaatcttttgagtcaacgggtcgttagctcagttggtagagcaggggacttttaatcccaaggtcatgggttcgacccccatacgacccaccagcaaaacagcaggtcaggggctatgtgcctctgacctgttcttggttctagttcgcttcctagttcatcatgatgtgcttcaaaggtgcttttggaatccatgatggaagccgtttggaatccagggtgcagccaatctgtgcccgcgggtagcgtctgggcgttgctttcagaagctgacgacccatgagatgcgtgctcgcctcgtggtcctgggcttccactatgtccacagttgcttcacatagccagatgacgtggagactatgggcttgaagggattgagtttgcacttggtgacgagagacctatacacgcagcgccgcttggtcttgcatggtcagtggcctaccttgcgggtaaggcgttgagtcatcgggataaaaccacaggtgagagacatgttggaaccatcaaccaggcaatggttgcgttggcggggtttgtcgcgactcgtgatgggacgtcgcatcaatcaagtggcaaaggtcatcggggtctgacggcgtgacccgcggacgtgaatgtttccaaacggaatcgtgaggattttctcactcaactgtataacgaagcctgttatattacccgacaacaccacgagggtgtgaatcagagtggatgaacggagggaggacgaagatgaccgcagcacagagggatgagcgacgccggggtggaatccgtgatcagcgacgccagggcgtgtcgtcttcagtcccacgcggctaaacgccacccataggttggactgcaagcgcacctggcatcgccgggcgcgcttttttcataacccacaaggcaaggaaaacaacgggaccgagtccctgcacctataagtacaaacatcaaaaaattaataataaggggagtggttgcaatgacggcaaaggcaaatggcaaggagaaggtcgtcctggcgtactcgggcggtttggacacgtcggtcatggtcaagtggctgcagctcgagaagggcctggacgtggtcgccatctgcggcaacgttgggcaggagtcgcaggacctgggatgggtcgagcagaaggcgtacgacatgggcgccatgtactctcaggcaatcgacatgcgctccgagtacgcggagaaggtcctgaccaaggcgattgccgcaaatggcatgtacgaggacacctatccgctgctctcggccctctcgcgccccctcatcgtgaagcacctcgtggacatcgcgcacaagaccggtgcctcgtacatcgcgcacggctgcacggggaagggcaacgaccaggtgcgctttgagacctgcatccacgcgctggatcccagcatcaagatcctcgcacccgtgcgcgagtgggacctccacacgcgcgaggaggagatggagtgggccgcggagcatgacgtgccggtgccaacgaccgcggcaaagccgtattccatcgacgacaacctttggggtcgtgcgattgagtgcggcgtgctggagaacccctggaacgagccgcccgaggacatctggaccatgaccacgagcccggaggacgcccccgacgcaccggaggagattgtcgttgcgttcgaggccggcaagcccgtctccctcaacggcaagcccatggcgctgctgcccctgatcgtgcagatgaacaaggtctgcggcaagcatggcatcggtcgcatcgacatgatcgaggaccgcgtggtgggcatcaagagccacgagtgctacgagtgccccggctccctcacgctcatcaagatgcaccattcgctcgagacgatgtgcctggacggcgacacgctcaagtacaagcacgcgattgaccagcagtggtcgaccaccgtgtatgacggcctgtggttctcgcagctgaagcaggccctcgacgcgttcatccagaacacgcaggagtttgtgaccggcgaggtgagggcaaagctctacaagggcagcgtcacggtcacgggcgtgaagagcgcctactcgctgtacgactacagcctggcgacctacggcgagggcgacacctttgaccgcaccgcgtcaaaggggttcatcgacatccacagcctcccggtgaagacctggtcgggcaagcagggcccgtttgccaaggatgcagccgagacgagcggcacccaggcgcagcgcctctccgcataggctgacggtcagtctccaccgtcccgactcggaaccagggcggcggcgaccaggagggcatgggttggtgacatgcgcggggagacgtcccgtgcatgtcacccgtttggggcagcaggatgtgacagacgacagcgagggagaccagatggctctgtggtccggaaggttcgagggtggcgtcagcgagttcacccaggagtttggggcgtcgcttccgcaggacaaggcgatgtatgcgcaggacatccaggggtccatcgcgcatgcgaggatgcttgcgcggcagggcatcatcttggagggggatgcggagaagatcgtgtccggcctcgaggcaataaaggagtcgatggacgccggcgagtttgagtggaacgtcgatgacgaggacatccacatggccgtggagtccaagctcacgagcgacgtgggcgaggcgggagcgcgcctgcacaccggccgctcgcgcaacgaccaggttgcgcttgaccttaggttgtacgcaaaggaccagataaagagcctgatggacgagaactgccgcctgcgcgcatcgcttctgtccgccgcggagaagaacctgggcgtcgtgatgcccgggtacacccacctgcagcacgcgcagcccgtgctcttctcccatcacctcctggcgtacttttggatgctgacccgcgacttccatcggcttgccgaggcccgttgtgccgccgatgccaacccgctgggtgcggccgcgctggcggggaccacgtacgacctggaccgcttctacaccacggagctgctgggcatggaccaccccatccccaactccatggatgcggtttctgaccgcgactacctgctcgacctcctgtacgcatgcagcgtgagcatgatgcacctgtcgcggctgtgcgaggaggtcatcctctggtcgtcgacggagttctcgttcatcacgctctcggacgcctactccacggggtcgtcgatcatgccccagaagaagaaccccgactttgccgagctcacccgcggcaagacgggcagggtcgtgggggacctggtttccctgctcgtcaccatgaagggcctgcccctcgcctacaacaaggacctccaggagtgcaaggagggtcccatggacgcggctcgcacgctaggggactgcatgacctgcgtgcgcgggatggtggacacctgggaggtgcacccgcagaccatgctcgagcaggcgggcaggggcttcaccgccgcgacggacgtggcggactacctcgcgaagaaggggatgccctttaggcaggcgcacgaggtcgtgggcaggctcgtgctgtactgcgagcggcacggaaaggggctcgaggacctctcccccgatgagtttaggcaggcttcgccgctgtttggcgacgacatcgctaaggaccttgacccagccggcatcgcgcgcgcccgcaacacctatggcggaacgggtgacgaggccgtgagggtccagctgggggaggccaaggccgcgttggagaaagacgaggcagccccgcggtagcggtgcgcccgggggagaggggagaagccgccaacgggagcggggacgtccgggcgtcgggctgcccgggcgtccccatgccgtttgtcacctccgtggggcagggtcaagcgaccctctcgaacggacatgacccatcgccgtacttgctggtacatcgtgtggttgcgcccgcgttgtccaggaccccctggcccggcgcgctagaatcgtgcatgcaggcaaccccgtgaaaggaatgcgcatgatcgaccgctatacccgccccgagatgggccacatcttctcgctggagaacaagtacgccatctggcaggagatcgaggtgcttgcctgcgaggccgaggccgagcttggcaagagcggcatcaccaaggaggaggcgaagtggattcgcgaccacgccgccttcaacaaggaggaggtcgacaagatcgaggccgtgaccaaccacgacgtcatcgccttcctcaccaacatgggcagctacatcgacagggacgtgcccgagggccagcccaagcccagccgctgggtccactacggcatgaccagctccgaccttggggacactgccctgtgctaccagctgacccaggcaaccgacctcctgatcgaggactgccagaagctcggcaagatctgcaagcgccgcgcctttgaggagaggaacacgctctgcgttgggcgcacccacggcatccatgccgagcccatgacgtttgggatgaagtttggcagctgggcatgggagctcaagcgcgacctggaccgtctgagggacgcccgcaagaacgtcgcgttcggcgccatcagcggggcggtgggaacctactcgagcatcgacccgtttgttgagcagtacgtgtgcgagcaccttggcctgcagggagacccgctctcgacgcaggtcatcagcagggaccaccacgcctacctggcgggtgtgctcgccacgactgccgcgacctgcgagcgcatcgcgaccgagattcgcaacctccagcgcaccgacaccctcgaggtggaggagccgttcaagaagggccagaaggggtccagcgccatgccccacaagcgcaaccccatcacgatggagaaggtctgcggtctctcgcgcgtcgtcaaggccaacgcccaggttgcctttgacaacgtcgccctgtggcacgagcgcgacatcagccacagctccgccgagcgcgttgcccaggcggacagcttcatcgccctcgaccacatgttccagtgcctcatccgcgtggtggacggcctcatcctctatcccgagagcatgaaggcgaacctcaaccgcacccgtgggctcatctatagcagcaaggtccttctcgcccttgtggacacgggcatcacgcgcgagcaggcctacgccatcgtccagcgtgacgccatggccacctggcacgacgtccagcaggtgaagcccggccccacctttgaggagaggctcgaggcagaccccgagtgcacgctcaccagggagcagcttgacacgatcttcgatccctgggacttcctcacgcgcatcgacctggtgttcgaccgcctcgagaagctgagcttcgactagcatccgcatccggtaccgcctggttgggcgtgcggccggcgctcgtcatacgggggtgcggcgggtgggtctcgccgcatccccttgggtatactcgacgggacgaaaggggacccatgtttgcatacgactacaccccgcacggggtctgctcccagaacattcacgtcgagctcagcgacgatgggaggaccatcgagtccgtgggcttcatcgggggctgcaacggcaacctcaaggcgatcggaaagctcgtctccggcatggccgtcgacgacgtcgtgagcctgctcgctggcaacacctgtgggctcaggcccacgagctgcgccgaccagatgaccatcgcgcttaccgaggctcagcgcgagctgatggcccagagggccgagtagggacgtagatgcccaggcaacgtcacaacatcactcgccgcgggctcattcgcgccacggctgccaccggcgcgttagcggccaccgtcagcgtgctctccggctgcggcagctcatcgagcgacgactccaccaatcccgtggtggtggacgagagccaggagacgagcatcctcgacaagtacaaggaggccgactcgcccctcacgctcaagtcgacgtggagcattgcgctcgggaacgtcctgcatcccgccgagggcacctggataccctgcaccacggcggggtccagcgcctctcccatggtcaaggggtcggctctctcgcttgcgtcgggcacggtcggcgaggtcgtctccgcccccatcaccagcgactccaatgtggagatatacgacgtccgctgctccgactcggtgtacgcatgggtggagcttgaccttctcacccacagctggtggctgtatgcccagcccttctccgatggggccctctccggcaaggcaacgacgctgtggaaggcggactccgactacgacccgcccaagttctgcgtgacgggatccagcgtgatctggctggtgatgccctcgtcgtcggggaagaagacctcagagagctcgtactgctacctgtggaactccggcgactccaaggcgaaggccgtggtcgagtcacccggcaggtttgcgacggagccctcggtgagcaacggcatggtgacactcgtcccccgcgttggcagctcgtccagcgtctactacggcatcaccgcctacaagctctctgacgagcttggcacgcaggttgaccagctcgtgctcccacagagcgtcaagcccatgaacgcgacgcgcataggggacaagttcgccttctccatcgagtcgacctactcctccggcggcgtcctgggcaccatgggcacctacatcggcacccccgacggccccttcctggcgctgtcccgcgagccgttcgcgaccgtctcgggcaaggatggcctgtacatcatcaagagcacctcctcgtacttcgtcgtggacagcagcgcgcagacctacgcagtgctcgcggcaacgaaccgctgcgttgactacggggagtatcccggaacgcagggccagagtgacagctttgtgaccttcgcgaccgtcaagagccaagagacgggctatccctccgccgtctcggtcagactgttcaccctttagggcgaatggaaaatcgcgtgctgcggtaaaatatggagagactttacatttgcacagcaaagagggtgcaacttccctcacagctaggttgggaggccgctcatggcttcggaagagaagaagattctgctggttgaggacgagaagaccattcgcgacgcggtggccgcctacctcgagcgcgagggctacatcgttcgcggcgtcggtgacggccagagcgcgctggaggagtttgagaagcactcgttcgacctcatcatcctcgacctcatgctgcccaagctctcgggcgagcgcgtgtgccgtgccatccgcgagacctccaacgtgcccatcatcatgcttaccgcaaagggcgaggtggaggaccgcatcatcggcctcgagcttggcgccgacgactacctgatcaagccgttctccccccgcgagctcgtcgcgcgcgtgcgcgccctgctccgccgcgcccacaccgagagcgagccgcagctcgaggtcctcgacttcggcgacctggtcatcgacatctcgggccacaaggtcatggtcgagggcaaggaggtcgacctcacggcctccgagttcaagctcctgaccacgctcgcccgctatcccggtcgcgtctacacgcgcatggagctggtcgagaaggtcctgggctacgacttcgagggctacgagcgcacgatcgacagccacgtcaagaaccttcgtgccaagctcggcgatgacccccgcaacccgcgctggctgtacaccgtccacggcgtcggataccgtttcgaggcttcgcagaagcctgcggactccgatggcaaggacaagaagtagcctatgggcgaccttcttgatgatggaggggtgacaagggagtacgaggaggaggcccacgaggcctccgactcttcttccaaggcatcgttcaacaccatgccgcacgacacgaagcggcagcgacccgagaagaccttcaccgcccgcatggccttctactttgcgttcaccgcgatcatgactgccgccatcctctccgcggtcctcgccgtggtgtgggagggccagttcaaggagtacgcgagggacaacatgcaggccctcgcggagcgcacggcaaacaacctctccacccagtatcgctatgcgggcgagtggaacgacgacgtgctgaagtatgcggactacgcgaccaacgccacgtccagcgtcgtggtccaggtggtcgactccgccggcgacatcatctacgacgacacctgggacgactccaagaggacagtcgactcgtcacggcacatctcggcaaagtccgaggagccggaggactccgactcggtcgtcaccgccgatgtcatcagcgacggggcaaaggtgggcgaggtgcgtatctggagcgttggctccagcccgctgctcacaaagaacgacgcggcgttcaggctcaactcctatggggccatcttgggcgccgccggcgtggcggtcattctcgcctgcgtggtggggtacctcgcctcgcgcgcgctcaccaagcccatcaaggtcatcacctccacggcgacccagattcgcaacggcgacctaacggctaggaccaacctcaccggggacgacgaaatcggcaggttgggcgagaccttcgacagcatggcgtccgaactcgagcgagacatcaagtttgagcaccgcctcaccagcgacgtcgcccacgagctccgcaccccgctcatggccatgcaggcgaccgtcgaggccatgcaggacggcgtgcttcccacggacgacgagcattttgagatagtcgccggcgaggtgcgacgcctttctcgcctggtcgatgcaatgctgcacctgtcgcgcatcgagaacgggacgcgcgagctcaagatcgagcgcgcagacgtggtctacctggtgaagagcctcgtgtccatgcaggcgcagctctttgccgacaagggcctggcgctgaggtttgacgacaagacgaccagccacgagtgctacgcggacatcgatcccgacctcattcgcgaggcggtcaccaaccttatgtccaacgccatgaggtacacgcccgacggcggctgggtcgtggtctccgtcgcgcgcgaccgcaccaagaacgaggtcctcatcgcggtccaggacacgggcatcggcatcgccaaggaggacatccccagggtgttctcgaggttctggcgctcggacgcgagtcgcgagcgcgtgagtggcggcttgggcgttgggctgtctctcaccaaggagatcatcgagaagcacaacggttccatctcggtcgagtccgagctggggaagggtaccaccttcaccctccacatccccatcgaccacgggcacaagagcatcaagcagcagatccaggaggcacaggaccgatagcttgggcttggtgcacgtcctctgcacgcgttccgggcccgcgttgtttgagggccaatcaactacaatcgaaaggtcactgtctcgacgtgacgttgagaaaactcatcgatgggagacctaatgggagccatggagcttcgtccggattcacacggcaaggtgcgcgacatctatgactgcggggacagcctgctcatggtcgcaagcgatcgcatcagtgcgttcgactacatccttcccgacgagattccctacaagggcgagatcctcacgcgcatctctgcattctggtttgagaagttcgccgacctcatgcccaaccacatgctgagcatggacgttaaggactacccggaggagttccagaagtactccgactacctcacgggtcgctccatgctggtgaagaaggccaagacggttcccatcgaggcgatcgtccgcggttacctcacgggttcgggcaagaagacgtacgaccagagcggcaccgtctgcggcatcagtctccctgccggcctcgtggaggcgtccaagctccccgagccgctcttcaccccctccaccaaggcagagcttggcgaccacgacgagaacatctcgttcgatcgcatggaggagctcgtgggtgacaaggtcgcccagcagattcgcagcgccgctctcaagatctacagcgcagcggcggagtacgcctctacccgcgggatcatcatcgcggacaccaagttcgagtttggctacatcgacggccagctcaccctcatcgacgagtgcctgacccctgactccagccgcttctggcccgccgagggctacgagccgggcaaggtccagccgagctacgacaagcagtacgtgcgcgactggctcaaggccaactgggacatgcagggcgagccgccccacctccccgcggaggtgattgagggaacctccaagcgttaccaggaggcgttccagatcattaccggaaccgagttcaagcccgcaaaggagtcaaatgtcactgcgtgataccatccgcggcgcccgcgaggaggccgagcaggcaaacagcgacgcaccggagcccaagaccgcgcagcagaaggcggtcgagaagatcatgtcctccgatgagcccaaggcgggcttcagcaagaggtccgtctcccgtgctcgccccgcgcgggaggccgccgctggcgtccgcgtcgtgaagtccaatgacgtcgcaacggggaagatgaccagcacgggcaagctcgagtccgagatgaccaaggaggagaagaagcaggcccgcgaggccaggcgcgactccgaggaccggcgtgccgccgcatccaggatcatcctcagttccaagccaggctacaagagcggccagcgcatgtggtggatcctcctgggcgtgggcatggcgtgcacactcctgagctttgccctctccaccatctacaccgcggatcaggccacgggtcttgccggactgatcatgctcgtgctcatcatccttgcgtacggctgcatcatcgtcgcgttcgtctacgattggcgcaacgtgaggccgctccgcaaggctgctgaccgcgaggtcgcgtctctctccgagaagcgcgtgatgcagatcatcgaggaggactacaaggcggcgcagcgcaaggaggcggcccgtgcagaggccaaggaggcccgcaaggccaagagggcccatcgccacgagcagcacaggtaaggtccttttgtcacccatctggtgactacttgatgctagaatggtcaggcacggccccgtagctcaggggatagagcacaggtttcctaaacctggtgtcgttggttcgaatccgaccggggtcaccacgaaaaagcgcaggtcacagcctatatctggttgtgacctgctttctttttagatagtgacatagacagatgtcgcccggatgttgccccgtttttgccgaatcttccaatgggcatccatcatcgccggcataggcgaggttccaaacttaagacggcatggcgaacggcttgagatgggcgccaatggccaactcgtcgcatcggtacataggtgccctcgaaatgaaaaaaaggaggacctcgtgatgaggtcctccacaagactcgcgcgtgctgggggaggcgagcctagttgccgctcgtggtgctgcttcccgacgtgccgctggtgcccgaggtcgagctggtcccggtggaagaagaggtgcccgagctcccgtcgtcagtcgtgctgctgctctgcgggccgttcgagatgatcagcgtgatcgtggcgcccttcttggcattgccggtgggcgactggctgataacctggttcacgggcgtgctgtcgtcgtagcggtactgcgggtcgtacttgaacccggcgtttgcgagcgtcgactgcgcggtgtccttgtccatgcccacgacgctggggaccgagacggtctcggagcccgtggagacggtgatggtgatggtggcacccttggtcgccgtgccggtgggcgactggctgatgacaaggcccttctcgacgctgtcactcgatgcggtctgtacgtctacctcaaagccggcggcctggagcgcactggttgcgtcggactgcgactggccggtcacgtccgggacgtcgacgctctggggacccttggacagctggtaggtgatggtgtcgcccgccttggcgctcgagccacctgcaacggactgtgcggcgaccttgcccacctcgaccgtgtcgctgtagacggagtctcccgccttcgccaccaggccaaccttgctaagtgccgcctccgcctcggagggagacatgccggacaggtcggggacggtcacggtggcggcaggcttagcgcccttggagatgacgatgttgatctgcgtgcccttcgttgcggtggttccggggtcggggtcctgatccatgaccaagccctcggcaaccgtgtcgctgtattgctccttgacggtacccttgctgaagaacccgttgctactctcgatctgctggatggcctcgtcttgggtcaggttgagcaggttgggtaccgactcggtctgggaggagttgaagtacgtgacggcagcgacaatcgccgcgatgagggcgatcgcacctacgaccgcaaggacggcagtccgcttcttgtgcttcttggcgttgaccgcctcctgctcctttgcgcgctccgtggcagtctgccccttgggccgcgagatggtgttgatgcggctcatggccgccgtggaggcgtcggcaggcgagaggggtgcggtcaccgtttgggtggcacccagattggtgagcgccgtcgcgttgctgacggcagccatgcgccccgcgaggtagtcgcgcagcacgtggtagagctcgtccgccgtctggaagcggtcggcagggtccttctgcatgcacttgaggatgatgctctcgagtgccgcgtccacgttggggttgatctggctgggcggcttgggttgctccttcacctgcttgagggcgacggtgatcgcgtcgtcgccgtcgaagggtacctggccggtggccgcctcgtacatgacgatgccaagggagtagatgtcggtggtggggccaagctccttgccctgggtctgctcgggcgagacgtagtgggccgtgcccaggaccgagttgtcggtcgtcaggtggctgttcttggcgcgcgcgatgccaaagtccatgaccttgatgttgccatcgggctggaccatgatgttctgcggcttgatgtcgcggtggatgatgtcgtgcctgtgcgcgaccgagagcgcctgggcaatctgcgagccaatctgcgcgaccttcttgcagtcgagcgcgccgtgcttgcgaatccccgtcttgaggtcggtcccgcgcaggtactccatcacgatgtaataggtgtcgccgtccttgccccagtcgtacaccgacacgatgtacggactctggagcgcggcggcagcctgagcctcctgcttgaagcgcgcggcaaacgaggggtcggcagcgtactggggaagcatggtcttgattgcgaccatcctcccaagaacctcgtccaggccacggtagaccactgccatgccaccggtgccgatcttgtcctgtaccgtgtatcgcccgccgagaactctatctgacatcgtctctcccatctgaggcgtgttgtgactcgcgccgaagttcctcgtaccccataggcaaatcccctagtgacctcatgagctcgcccccagggactgaacgttgaggcaggctgccagcacctgtccggcaaccgctgccgcctgcccgttgacgttgttgctctccgagccctccagacagacggatattgccagggtcggagaatcgtaaggtgcaaaccctacgaagagcgagttggagacggagtcgctcacctgggcggtgccggtcttgccggcaacctgaactccgctcacttgggccgcggtgcctgtgccgctcttcacgacgtcgagcatggccttcttgacctccgaggcggtttggctcgagacggcctgtcccagggacttgggctgcgtggtggaggtggtggcaccctcgggcgagaggatgtggtccaccacataggggttcatcacgatgccgccgttggcaattgccgccaccatgaccgcgttctgcatgacggtggtctgggggccggcgggactctcatggacgcccaccggctggccgatggcggaccacgcggtctcccattcgctcatctcggagggcttgggcatgagggacgccgtcgtggtgaagtcgaggcccaacctggtgccgtacccaaaggcgtcggcgtagctcacgagcttgtcggcacccagggcaacccccagctggccaaagacggtgtttgcagactcggcgtaggcctcctgcagggtgagggagtcccatgcctcgctgtcgttgttggtcacctgtccgccgccgatctccatggtcgagggtgcctggtaggcggtgctgagcgaggccacgcccgagtcgagcgccgcggcgagcgagatggtcttgaaggtcgagcccggggtgtagagcgtctgggtggcccggttgacaagctcgccctgccccgcgcccgacgccatgaccgtgtcgaggtcgtcgtaggtgtagctaggcgaggaggcctctgccagcacggccccggtcgaggggttgaggacgacgatggcgccggtctggccctgcagcgcctgctcggcggcctgctgcatctgcgagttgatggtgaggaccaccgacgagccggcgctctcgacccccgcaagcgagtacagggcggacgtccaggacgagtagtcggaccgaccggtgagggtctcgttgaaggttgactcgaccccagacgttccgtactgggtcgagacgtacccaacggtcagggcggcaagcgaccccatgggatgctgtcgcacgtaggtcccgtccgcctgctgcaccgactctgcaagggtctggccgtcggcggtgatgatggagccgcgcttgatcttggacgacttggcgatggtgtggttgttggtcgggaggttctggtagtagtccgccttcacgacctggatgtaggtgaggttgccgatgagcagggtgaacatcaccgcaaacacggtgatgagcgcggtgaggcgcttgcccagcgcgaccctgcccagcacgccggactcgggggtctggagcccaaagctgccgcgggcgtgggaaccgtgcaccaccgagtcggtgggcgacttggtcctggacgccgtgccgcgcatggtctgagcagggctgtgcgtgttggccgcctcgatctgtgccatgtggccggtgccctcgtcgcccgccttgaggagcaggcccacgatgatgaagctcgagagaagcgagctgcctccctggctcatgaagggtagggtgacgcccgtgagggggagcagcttggtgacgccgcccacgatcaggaaggcctggaccacgatcgccgaggtgaggccgaccgcggtgaaggccgagacgtcgctcttggccctgcccgccgtggtcaggcctctcacgcccagaagcaggaacgcgatgaggacggcagccgcacccaggaggcccatctcctctcctatggcagagaagatgaagtcggactcgacaacggggatgagggtgggaagccccttgccaatgccggcgccaaccaggccgccgtctgcgagggagtagagagactggactatctgcaggcccttgttagaggggtcggcaaaggggtcaagccagatctggatgcgggtctggacgtgcgagaacaggtggtagcaacccactccgccgatggcgaggagcacggccgagaagatgacgtagctcacgcgcccggtgcacacgtagagcatgatcacgaagaaggtgtaaaagagcagggcgcttcccaggtcgcgttcgaagatgacgaccagcagcgagacgccccacatgaccagcagcggaagcagcatcctggggcgcgggagggcgagcggcccaatgcgacgggtggacgcggagagcatctcgcggttctcggccaggtaggaggccaggaacaggacgatgaggatctttgcgagctcgcccggctggaacgagaacggcccgatgacgagccagagcttggagccgccacgctcggtgccgatgagcatgggcaggaggagaagcaccacgcccgcgatgcccatggagtacttgtactgggcgagcgactcgatgctggggacggccacaaggacggcgatcatcgccgctacagagacgaacagccacatgacctggccctcggcaagggagggcgcaagtctcgtcacgaacgctatgccgattcccgagagcaggaacacgatgggcaggatcgccgggtcagcccccggggcgaaccttcgtaccgcaaggtgcgccaccgcgaacgccgcgaagagcccgagcgggaccgagagggacgagaacgacactgccacgttcatgttcacgaggtacatcgcatagagcagcgtcacggggagggccgccaggacaaggagcatgagctcggtgttcctgcgcgtgttctggcgctttggcatgctagtcgcccccgttctgcttcgtcgccgagctcgaggagtcggcggtatctgtgttgctgcttgtggtggtcctgtccgcggtcaccgcggcggagctcttgtcggcgtcgatctggtcgcgatagctctcgaccgtccgctttgcctcctcctcgctccccatgcggagcccgcccaccagactctgctgcgtggcatcggggaggtcggagatctgcacggacgtggtctcctcaaggtgggagaggggaatgcccatgaagctcccggttatcccctgatagattccgaccgttccctcgttgttggcgaggtaccaggaggagttgacgaagaccaggcccacggcgaccatcgcggcgaggatgcagccgccaaagatgagaaggcgtcgtatgagccgctttctcatcgtcctgtgggcctcgattgccccgtcgtcgctcacgtcgacgacgatgacggtgatgttgtcgtgcccgccggcgctgagcgccgcggaggtgaggttgtccgccgccgactggggtgtgaccgacgagacggcgatggcctcgatctcggagtcctcgaccatggacgacaggccgtcggagcacacgatgaggcggtcgcctacggagacgtccagcgtgaagtggtcggcgtacatgtcggggtcggacccaagggcgcgcgtgatgatggagcgggacgggtggaccctcgcctcgtcggcggtgatctctcccgcgtccacgagctcctcgacgtacgagtggtcgtgcgtcagcctcacgagcgtgccgtggtggaggaggtagatgcgcgagtcacccacgtgggcgatggccatcttgttgttctcgatcaggacgcacgaggcggtgcagcccatcccgggcttgcccttgccggttgcggcaccctcgatcacggcggcgtttgccgcctcgaccgcggcgccaagcaggatgtcgtccgcatggatcggggcctgggcaccaatcgtctgcacggcaatcgagctcgcgacctcccctgcggcatgaccgcccatcccgtcgcagacggcaaagagcgggggctggacgagaaacgagtcctcgttgtgactgcgcaccaggcctatgtcggttcgggcgccccatgacaggcgctcggtgtggccgctgcgcgtctcggcgccctcgcggttctccacgggaatcgtgtcgtgacccgggctgttgaccggctcctcctggggatgcctgggcagcatgtcggcgaggttcaccctgtgtggctggtgccagatcatcgacggctcactcgcatgatcgcgtcgcccacctggacctcgtccccgtcacggagcgtgacgggctgcgagatggggtggccgttcaccagggtcccgttggtggagtccaggtcctcgaggaccagggcggggccctggagcgtgaagcgcgcgtgcatcgccgagacaaagggctcgtcgatgacgatgtccgacgacggggcgcgcccgaccacgacggggccgagcatgtccacgtgaaggcccctgagcgacttggagcccttctccacgtcgatggaccagatcgccccgtcgcggcgctggccgcgcaccaggccgaccccggtcttcatgaccgcgaagaggaacacgtagagcaggatcaccaggacgatgcgtcccgcaaagagtacaagctctatcatgacctgctctccctgaactcgaggttggttagcccaaccgtgatgaggtcaccgtccctcaggatgcagctgtccacgtcgacgtcgttcacgagcgtgccgttggtcgagttgaggtcggttatgcgccagtcgcggccgtcgtaggtgatctcggcgtggcggcgcgagacgttggggtcgtggatcacgatgccgccctgcgagcgctcgcgccccagcagcgtggcgggggcggtggcgttgtaggtgcggcccgtctggtggtcgatgagaaggcaggttggtgcctccgagctctccctcgagctcctcgcgcgctgcgggttcaccagggggacgttcttgcgctgcgtggcggggaccgtctgaggctggggctcctggatggcgatgtcctcgcctaccgacggaacccgacgagcggtgtggcgcgcggcctgctccgcctccgcctcctcgatcgagtcctggacaaagtcctcgggcaggaccctgagccccgcggaggcatcctcgccctggggggagacgagcggggcaaactcctgctcctggaggttgtccagaccctggtcgagaggatctgccgcggggatgggcgatggcgtgggcaccggcatgggctggaccgccgcgcggggctgctcgccgcggccgcgaccctgcctaccgccgcgatccttgcgcgcgcgaggcgcgggcatgggcgccgcggcgccgccggagccctgcgaggcaccgaggaacgcctcctcctcgtcacgaaggcgtgcgagcgtgcgtgcatcgacgttctcggcaaacactgcgaacttgccgctgcggagcgttgggtcgaccatgaagcgagccaggggcttgcccacgaacacgtagcccttggcgtttgcctgggcctccacaaacgagacgatctcttgggtgagctgggagtacagggagcgcatcatcgagtcgtcagccgacgagatgaggatggtgaagagcgcgggggcggtgtcgaccccatcaatctcgtacgtctcgtgttgcatctcccgcgcggcctgcttggcgagcttcttgaaggagaagggctccacctggccctgcggagaggcgccaaaggcgtcgttcacacgactctcgaacgtcttgagcaggttcatctattcctccacccctccgtccacctgtcgtggacccctcaggctggttgcggtacacataagcacacccaagagtacagcaatgcccaatgccaccgccgtggaggcggtccatatgtccccattctccactcgtgcccggagtgcctgcgtacccaggatgattaggcaacataccgcctgacctgcataaccccagcgcgtggaccctccgtggcgcgagactgccgcccccgcccacgcggcgcaggcgcatccggcgacggtcacccacgtaccgggtgacacgagcgtggagaggagggccgttgcggttgggtaggccgcgaaccccgccgccatcgcctgattcgtgagcagggagagaagcaggccaaccacggaggatgcggccgccctcgcggggggcatgcaaaacgccgcaaggggggctgacgccatggggctggggagtaggcacggggcgaggacgacgaggccggaggtcctgtcctcccttccgctcgaccaccaccaggcgacgaaggcgatcagggtgagcgcggggagcatgaccccggcggcgccctcgccaaagagcgccaccacgaggagggccacgaacaccgccccaccgaaggcgggcgccagtgccgagagggcagcgcagcccacgagcgttgggacgacccagcttgggtgggccgcgagcgcggagtttgcgaggggcacggccgagcccgcacaggcgacggcggtgcctcccctgagagcgagctcctggagccaggggtatcggtaggcgacggggaggtagcgtccctccctggtctgcggctcggccccgtcttcactcgtcgtctgcgagaggaggtcgcgcatggactcgcccccggcccgcacgtccccggcgagcccgaagacaagctcgtcggcaaacgtgccgacgctggcaatcctcctggtcgggtcggggtcgagcgcctgtgacatgacctcctccgccatcccggcgaggctggggtcgatcttcgagagggcgcgccgggggcctgcctccatgagcttgagcgacctctcggcggtgtccgccgcaaaggggttcgttcccgtgagggtctgccacaccacgacggcgagcgagaacacgtcggtgcgctcgtcgacgagcccacccgtgatctgctcgggaggcatgtagcccacggtgccccctcgcgcgccgccaaaccccgtggcggaggcgagcgtggccatgccaaagtcgcagagcttcacagtccccgacctgtcgaccatgatgttggtgggcttgatgtccaggtggagcacgccgttctcgtgggcaaacgagagggcctttgccacgctcgtcacaaggtgggagcactcgtcgttggtgagggtgccgccctccaccctcgagaggagctcggcgaggttgagcccgtcgacgtactccgtcaccaggtaggcccagctgccctccacctcaaagtcgtagaccgtcacgatgttggggtgcgccagcatgcttgccgtgcgcgcctcctggagtgcctcccgtatggttgatgccccgcccgctcccgccgcctgcgggctcagggggatcctcttgatggcaacgcggcgctgtagcctggtgtcccagcaggtcaggaccgtgccaaagcctcccctgacgcccgcgcgcatgacgcggtatcggttgaggaggagcttgggctcgctcccgctcgatgatgcggtcacgggcgaatccaagcgctgcgttgtggtggggtcttctctcacggccgtcctcgtcttcggttcaactgcggttttgtcgatggccacgctctatagtagcccgtagggcgtcactacccgtccgcacccgtgccgagggggccaaatacgcatccaacgccatctctctgcatgaagtccaaataatttgccgttgcagagcgcgagaatagtagtactatggtgacccacgcgggcgtggcggaattggcagacgcgtacggttcaggtccgtatgagagcaatctcatgaaggttcaagtcctttcgcccgcaccatggattgcaagccccgtcagcacaggctggcggggcttatttgtggagggagacagtaggtagacgcctccctcagtgccgcttgtggcgtggcgtcgaaatgccaggggcgcctcctgccggtacgggaggcgccccattcaaaagcaaggtcttctcgacgggtactactacttgttgtcgtcgtcgaagtcggaccagccgctctccgagtcgtcatcgtcgaagaggtcccaatcctcgggggacttctcgtggttcttgtagatcgcccgcgtcttcctctccaggacgatggcgatgatgagaaacaggaggatgccacccaggacgagggcgatgaccccctggcgcgtgttgaagagccagttgataaaatccattgatcgccctttccatacgagacacgcacctggtgcgcggcctgttcggggaatagtcgccacaagtatatacttgggactcgcgcggacgtgtccgcgcaggcagtaaggccaaccaaacggttggcgtggccaagccatccaagcacgaggggaagcagcatgcttgacatcaagttcgtcagggagaaccccgacgtcgtcgacaaggcctgcgagtccaggcagaacgcccactgggatcgccagaggttcttcgagctggacgaggagcgtcgcagcaccatcaccgaggtcgaggcactccaggcgcagcgcaacgccgtctccaagcagatcggccagctcatgagggagggccgtcgcgacgaggccgagcaggccaaggcgcaggtgagcgccaacaaggagcgcatctcccagcttgacgacaggcgtgccgaggtcgagaaggagctcttcgacctcgttgcggcgatccccaacatcccgcacgagtccgttccctatggtgtcgacgactccgacaaccccgaggtccgcaagtggggcgagccgactaagtttgacttcgagcccaaggcgcactgggacctgggcccctccacggggatgatcgacttcgaccgcggcgtgaagcttgcgggcacgcgcttctacctccttggcggcgcgggtgccctcatggagcgcgccctcatcaacttcttcatcgacgagcacgtgaaggcaggcttcaaggagtggtggccccccgtcatcaccaactatgactccctgtttggcacgggtcagctccccaagtttgacgaggacctgttccacgtgagcggcgggatgtacctcatcccgaccgcagaggtcatgctcaccaacatccaccgcggcgaggtgctcgacggggacaagctccccctgtggtacacggcgttcaccccctgcttccgcgaggaggctggctcggccggtcgtgacacgcgcggcatcatccgcgtccacgagttcgacaaggtcgagatggtcaagtttgccaagcctgatgactccatgaaccagctcgagtccatggtcgccgaggcggagcactgcctccagaaactcggcctgccataccacgtggtctcgctctgcacgggcgaccttgggttctccgccaccaagtgctacgacctcgaggtgtggctccccagctacaacaactacaaggagatctcgagctgctccaactgctgggacttccaggcgcgtcgcgcaaacatcaagtaccgcgacccgtccgagttcaaggggacgcgcctcgtccacacgctcaacggctccggactcgcggtcgggcgcaccatggccgcgatcatggagaactaccagaacgcagatggctccatcaccgttcccgaggccctgaggccttacatgcgcgacatggaggtcatcaagccccaggcataggtcactctttccgggtggcgcaggtcgccattcatacaagcagcaactaaaatggggtgccccgctggtgcggggtaccccttttctataaagtctgatatattagaacaaatgttctactacggagaggagacgagcatggcgggcgagtgggaagaggtcctgagggatggcggggatgacgagctcagggtcataaccgccaaggtggagggggacaccctctttgttgaggagaagaccgaggggaacgcgaccaggttggtctacgaggaggactgccacaagcacatggtgcgcgtccgtggggcgtcactgcacgccctgaaggcgtttctggaggccgagatggaggttccccctgcgcccatgcttcaggtgctccgcatgttcctctcggagcattccagcatgctcgaccttcaagacaggctggacagggccgcgcttccctacgactacatctctcgggagggcgtctgcgagatctatcgtcccggcgttacctttcagtagggggcgcccggtcccgtcggcgcctcgatgcgtcgatggctattggcaacaaaaaagaggacctctttcgaggtcctcttgcattcgctggtgcggcgtataggattcgaacctatgacgttctgattcgtagtcagaccctctatccagctgaggtaacgccgcgttgcgggtattaatatgcccccaaaccaccggagtgtcaaggagaaatctcaactttcttgccgctgaatccgtttgcgcaggtagctactgaaaaaaaattgaagcgaggagcctggctagcgagtgggtcgcagccttgcgtgcaaggtaaaaagaaacccggcaccttgaggtgccgggttgcgtgttctggcggagagctggggattcgaaccccagatagggtttgcgccctatactcgcttagcaggcgagcaccttcggcctctcggtcagctctccaatcagtgatgccgttgcatcataccccacattatcgaacgtcacaacatcgacttccatggagtccaagaatctgcggcaccgccggcggccacggagggcttttggtcgggggagaggggccactgggcaaggctcctcgtcctcatcatctgggtagcagcacggatgcgtccgcctggatgtcctccctgtgcgagcggatggcatcccaggagaagcgccgctcaaactcggcggcgtcaatttcctctcccccctctgcaaggccgatgtacgaggcgagaagtcccaccaccgccttgggggagacgttgttctcccgtagtgcctggaggctcaggtcgtggtcccgcttcgagaggcgcctgccgtcaggggcgacgaggaggggtacatggccgtagcgtggcggcgtcatccccagaagccgtgcgaggtagatctggcgggcggaggaggggagaaggtcgcggcccctcacgacctccgtcacacccatccggcagtcgtccacgaccacagccagctgataggcgatgatcccgtcgcttctccgtatgaggaagtccccgcactcttgcgccaggcactcctcgtgcagaccgtatcccaggtcttcgaacccgatggtgccccttgggtcgtcccccggggggaccatgagtcgcgtcgcaggtcttctcttcctgctcctcttggcaacctcccggggagaaaggtcacggcacgtgccgggatagaggtaggtcccgtccgaggcatgcggtgccgttgcggcgtgaagctcggagcgggtgcagaagcagggatatgtaatgcccttctgggcgagggcatcgatctgttgcaggtagacgtccgttcggtcgctttggtagacgggaccctcgtcccagtcaatccccagccatcgaaggtcgtccacgagcatcctcgcgttctcggggtcctgcgcacgtgggtcgaggtcctcgatcctcaggatgaccctgcctccctgcgagcgggcggatgcccacgcaacgagcgccgagaacgcgtttcccagatgcatgcggccagacggagttggggcgaggcgccctacggcgaggggcttttgcgcttcccctgtgggtgtggcgtcatgtggaagagaggtagtcatggccctatatcgtatcgccttcccatcgccgtgcccgttgcaggcctatatggtcgcggtgaatacaccgtaatgcattaatggaaaaaagtatgcgttacgtaatgattaacgcaagtagatacctctaattcccaaaatggtaccgttcacagaatccaatattttcacgacaaaatactgatgtcgaagttatagtaataagtctggacggttcgtctgcaggccaggtatggtgccttggcccaacacacaggaggaagacatggcaagcattggcaagcccaaccgcgtcgtcatcgccctcggcggcaacgcgctcggcaacacccccgaggagcagatcgcccgcgtccgcgcggctgcccccacgctgctcaaggtcatcgagcagggcaacgagatcatcatcacccacggcaacggcccgcaggtcggcatgatccagaagtccttcgcactcgcccacgaggacgacccctccgtgcccgccatggacctgcccgagtgcggcgccatgtcccagggctacatcggctaccacctgcagcaggccatcggcgccgccatgcacaaggcctacaagcgctggcacgtggccaccgtcgtcacccagatcgaggtcgaccccgacgaccccgcgttccagaaccccaccaagcccatcggccagttcctcaccaaggagcaggcggacgccgagaaggccgcccaccccgagatgaccttcgtcgaggactccggccgcggctggcgccgcgtcgtcgcctccccgcagcccaagaagatcgtggagtacgagagcatcctcaacctcctcgacaacgagttcatcgtcatcgcctgcggcggcggcggaatccccgtcgtgcgcgactacaacgacaagggcgcctacaagggcatcgccgccgtcatcgacaaggacatgggcggcgagctgctggccgaggactgccacgcggacatgctcgtcctgctgaccgccgtcgaccacgtcgccatcaacttcggcaagcccaaccaggaggagctcaccgacatcgacacccagcaggccaaggagtacctggcccagggccagttcggcaagggctccatggagcccaaggtgcgcgccgccgtcaagttcgcggagtcccgccccggccgcgtctgcatcatcggctcgctcgacaaggccgccgaggccatggccggcctctccggcactcgcatccacgcgtagtccgagggaaataagccttaagggggtcgcgacgttggtcgcgaccccctcctttgtattcaggtgtaaagagcgggtgatggggtgtctcgccttgtaaaaatggcgcatcgaaagatgcttgccgcgcgctagcttgcccaaaagtcgcggcgcagggcctcgcgattgggctgcccgcacttcttcatgatgttgtgcaggtgcgtcttgatggtaccttcggccagcaccagctcgttggcgatctctcggttggacttgccctggagtgccagggcgagaacctctcgctcgcgctttgagagaccgtgcttggcggcgtaggaggggagcgcactttcaatgtgggcgacgatgtctgtgttatgggtcttctgctctcttgtctccggctcgagggggttggtggggacgacggaggttggcggctcaaggtagcgcagacgaaggtcgcgtatggccctgctgcacacgtcccaggccatgtacagcatcatcatgttctcggagaagttcctgctcgagaggaacagtcccacaaacgaggagttctcggagggtatgggagcgatgaggatcacgtaggtatcctccgccaggatacagagcacgagcagggacaaaagtcccaggacgcgcctccgccgcatgaggcgctgcttggtcacggggtccttcgtgtgtcgggtgtacaggtagcagtaggcaaggcaggcccccagcgatacttgccgcatcgtgtagaacagccactgcctgagcgggccgtagggcatgagcacgagtatgagggtctgcgccacgaccacggcgacggcgggtatcaccactgcgcggacgttatggatgtcgagcagctcaaacgccatgagccagaagcatgtgaggattccggcgccaaccaaaatacggaacaccggcatgtccacgtcgtagtagtttgagtagtcgatctcgaagatgttctgcaccgcccactccgaggcgaagatgctcgaggtctcgacgcagtagaacacgaagaagagaatctggggcagataccggcgaccatgggtggcgagaagtgctgcagagcagaccgacgccgtgatgatgcagaccaccaagagcgcgatggtatagacgaagaagaacatgctcacggtataaaccactcccctcggggtgggtgcacgcatcccaacgaatagctcaacctgcatggatgaccgcctatatgcggcataccagagtaatcagcgccgcgataccctacaccccggtttattcgtggtgtaattcgcgttgacggcaataaaccacgctgttctggactgttacccatcccgatgcgcaaatggagctgcgaggcgcaggaggcgccatttggaaacgtgggcacgcatcgccgtggatggcgcgcccaacgagaaagggggacgcgggatggcaggaaagaaattcagcttcttcagcgtgattctgtccgttatctgcgtcgtgttcgtggccgaggcgtgcgcgccggcagccgccatcggcaatgcgcaattcttctggtggatcttcctgatcctcaccttcctgctgccgtatgggatggtcgtcgcggagctgggaaccacctactccggcgacggaggactgtacgactggatacgcgacgcctttggcgacaagtggggcgctcgagttgcctggtactactggatcaactatcccctgtggatcgcttcgtgcgcaacgctgttccccgacatcctgggcatggtgtttggctgggagttctccatggtggggaagatgcttgtggagctggcctttgtctggattgtcgtggtcatgtccttctccaaggtctctgactccgagtggatcctcaacggcggcgcgattatcaaggtcgccatcgcggtcctggtcggctgcctcggcatctggtacgccgccaacaacggctttgccaacgatatgtccccagcgacgttccttcccaagtttgacggctccgcactcaccaacctctccatcatcctcttcaacttcatgggcttcgaggtcgtgtgcaccttcgcgtctgacatgaagaaccccgagaaggacattcccaaggccatcatctacggcggaatcgccatcgccgccatctacctgttcgcgtcgtttggcatcggcgcagccatcccacaggatcagattgaccccgactttggcatgatcgttgccgtccagaccatggttggcaacagcccaatcttcgccctcatcgcgctggcgttcctcgtcaccctgtttgccaacatggcgtcctggtcgtttggcgtcaacttcgtggccgactatgccgccaagcaccagaacatgccgagcctgttcgccaaggagaacgagaagaccgagatgcccaacggcgcagccgtcatcgacggcgtggttgcctctctcgccttgtgcctgcagctcattcccaacgagaccatctcgaacaacatcttctggatgctcttctccatgaacgtggtgttcctgctcctgagctacatccccatgttcccggcgttcgccaagctccgtagggtcgaccccgaccgcaagcgcgtgttcaccttcccgttcaagggcgtctgggagcgcgtcttcctcatcgtgcccgccgtcgagctcgtcctgtgcgtttttgcgaccatcgccccgcttgacgcaaacggcaactggtcgctctcgggcgactggagctacgtgatcgccacggtgttcttcgtggtgctgggagagatcgttcgcgttgtctccgcgcgcgggcgcaaggaggagttcaaggggctgacccccgagctcgccgcccagaggcttgccgaggaggctgccgaggcagagtccgagtaggggagagacgagtccacatccctggaattgtagggaccggctggaggcatcggccttcggccggtccgctcgtgtgtcggaaggaccgttactcaagggaaggctgacatcctcctgagatgcgccaaatcctccaacggtgttgctccgcgctgatcacggcgagctcttgggcgtgttcaggggggacatgacatttaggggagaggcgcctctcgtcgtggcttcagtcgagacggagggcggacggccgcatgataggtcattgcctgatgcccccaaaccgagtgcgacatgcagcaaacggtcggttttgaccgctcggcggaagggccaaattgagagaaagccgcaggtcaatgacggttgaagcggggtgtaggcgctcgccgccgcaataaacctcattagtctggaagtttgcgcctctctccccgacagtgtgaggcgaaggcactacgggtcgcggcgagcaagagggcgagccgcacgaggagaagggtcacgctcatgaccatgccgaaggacttcatcgacagcaacgacttcaccaaggaggagatcctcgcgatcgaggacctcgccatcgcaatgaagaaggccatcaaggtcgacggctactatccgcacctgcttcgcaacaagtcgctgggcatgatcttccagcaggtgtccacgcgcacccgcgtctcgttcgagacggccatgaccgacctgggcggccacggcgagttctttggtcccgggaccatccagctgggcggccacgagtccctgggcgacaccgctcgcgtcatgggctcgctgctcgacatcatgatggcgcgcgtcaaccgccacgccgacgtggagggcctcgcaaagggctccgccgcccccgtcatcaacggcatgtccgagtacaaccatcccacccaggagatgggcgacctcctcaccatgctggagaacctccccgagggcaagcggattgaggactgcaagctcgccttcatcggcgacgcgacccaggtgtgcgtgtccctgatgttcatctgctcaaagatcggaatggactttgtccaatacggccccaagggccacacgattcccgacggcgccctgcacgtgggcacccccgaggagcgcgccgagttcggcaagcacctcatggaggtcggcaaggccaactgcgagaagtccggcggcaccatcaccatctccgacgacatcgagagcatcaagggagcagacttcgtctacaccgacgtgtggtacggcctgtacgaccaggaggagtccggagcctcctacatggacgtcttctatcccaagtaccaggtcaactgggacctcatgaacgccgccggccccaactccaagttcatgcactgcctgcccgcgacccgcggcgaggaggtcgtggacgaggtcatggacgaccccgagcgctccctgtgctgggtcgaggccgagaaccgcaagcactccatccgcgcgctgctcgcagcccttggcccccgcaccccgctcaacgacgaggatgttgactactccaccaaggaggagctgcacgctgccatctcgaagatcgacgagctgcagaagtagtcgtctctcgccccattaggaggttcccgggagaagcgtcccttctttcggctttgtaggtttccagtagcgtcaggacgttttggaggtttgcaatgcgtacgattcacgagtccgagtcaacgcccgctgccgacggcttccacatgccggctgagtttgagccgcagcgcagggtttggatgggttggccccaccgcaccgacacctgggcctttggcgccaagcccgcccagcgccagtacgccgccatcgcccgtgccatcgcggagttcacgccggtcgtcatgtgcgtgaacgaggcggactacgccaactgcaaggcggtctttgagaacgacgagaacgtcaccgtcctcgagatgaccaccgacgacgcatggttccgcgacacgggcgccaccttcgtggtgaacgacaagggtgaggtccgcgccaacaattggcacttcaacgcctatggcggcctggtcgatggcctgtacttcccctggcgcgccgatgacgagatcgcccagaagatggcggagttcgcgggggcgcgtacctatcgtcccgacgacatgatccttgagggcggctccataaccgtggacggcgagggcacgctcgtggtcaccgaccagtgcctgctgtctcccggccgcacctgctccgcagtgctcgccgacgaggaggacgaggacaccatctggccgaggtatgcccgcaagttcgagccctggagcgaggagctgcgtgcctacatgaccgagcacctcaaggagtacctgggtgtcgagaagatcatctgggtcaaggagggcatcgaccccgaggagaccaacggccacatcgacgacgtcgcgaccttcattgcccccggcgtcatggcatgcatctggaccgatgaccccgactacccgttctaccgccagtgccacgaggcgtacgagaccctctctaatgccaccgacgccaagggtcgcaagctcaaggtgtacaagctcccgatgccggtgaagccgctgtacatgacgcaggaggcctgcgactccatcgacgtggacgagtccgcggaaccgcgcgttcctgacgagccgctgatcgcctcgtacatgaactacctcgtcaccaaccgcggcgtcatcacgccccagtacggcgacgagaacgaccagctggccgttgacaccctccagaagatctacgacgagacctggggcgagggcgcctacaaggtcgtgggcgtcaagtccgaccaggtcgtgtacggcggcggcaacatccactgcatcacgcagcaggagcctgccccgcagggcaagtagcgccatgacgacggggcggcttcgcagcatgcgggccgccccgtccctttttgttgggggagggagtgaccatggcggggaggaagcttgggctgcgcgacgtgatgctctccacggtgtgcgtcacgctcactgttgaggcctgtgcccctgcggctgccatagggaactccgcggtgttctggtggctgctcctgctcggcacgttcctcctcccgtatggcctggtggtatgcgagcttggatgtgcctatccggaggacgcgggcgtgtatggatgggtcaggcgtgcccttggtgaccgctgggcatcccgtcaggcatggtggtactgggtaaactacacaacctggctcgccgccgtcgccctgctggtgcccagcaccctggacggcgccctgagcgccacgcttgggctgacggttcccgtgtgggtgcgtaccgtgctgggcgttgcgtttgtctggctggtgatgtgctcctctcagggaggggaggggcgagaggcccgcatcatgcgcgttggggcggtcgcaagtctgtcgcttgcgtgtgggctgggcgtgctgggaatctggtacgggacgacccatggcttcgcgaaccccgtgaccgcaagctcgctcctgcccgaccttgccgacccgtcctccgtcacgtacctctcggtgatcctgtacaactacatgggctgcgaggtcgttgcgacgctcattggctcgatggaggacccgcagcgcgacatgccaagggccatcgtcctgtcgggggcgaccgtcgcggcggtgtacctgtttgcctcgctggggatatcgagtgcgctcccggccggcgcgatacgcctggacagcggcctcaccgatgcggtcgccgtcatggcggggcgtggcagcggcgctttcgtactggcatccctcgtcttcgtggtctcgctcttctccaacatggcttcctggtcgcatggcgtatgcgtggtggttggacaggcggcgcgggaccgcaacctccccaatgcgctcgcgcggccggagcttgcgacgggcgtggtggcatccgtcttcgtcgtcgcgtcccccgtgctggacgcgcttggcgtcggcgtcttctcggtggtgctgcagctggacgtggtgttcacgcttctctcctacgtccccatgtttcccgccttcctgcgtctgcggaagatgggcgcggatcgtaagaggccattccgagttcccggaggccgcccggtcctgatgctcgcctgctgggcgcccgtggtggagcttggccttgccacggcggtggccgtcgttccccttggtgcggggcaggaccagctcgcaaaggttccgctgctggttgccacggcaatcgtgctggtggcgggcgagacgggcgcggccatccgcgcgcatcgtcatcccacggcctcagggcccctggccgccgcgcccgaagcgaggcatggctggatcgtcccggtgtgccccgggcccctggctacgctcgccccgtccctagagggtgctagcctcacctgccggcagccgctggccatagacgtagatccccggcagctcgacctctctccccttgccctctgcgctgggcacggtccggcttccgtacgactcaaggcggctcagccccttgtggtcgtagaacgtgaagtcgcactcgtcgtcggtcatgaggaagaacccctcggcaccctcctcgctcagctcccgtcgcatgaggtcgaacagcctgcctcctatgccgagtcccttggcgtccgggtcgaccatcagcaggttgagctcggcggaggcgcagtcgtcatcgcgttggaggtaggttgcggccacttccagctcgcgccggttgacgagcagctggtcgtgcatcctcttggtgagctcggggctaaaggcgtccgcggcactgatgaggaggtcccggtgccaccgccactggctgggggtcgcctctcccgccatgcgtcccagggtgcagccgaccgcccggccgtcgtgctccgccacgatcgagtggggcgagatggagaggtaggtggcgaccgcgactgcgccaaagaggcgtctctcgtcctcctcccccgtgtcgcaccacagacgaccgtagatgccggacagggactcgaagtcgtcctccgcgaacggtcggaactccaccgagggcattgtctcacgcctttcgcaacaaaagatttcccgattgatgcctaccgtatcacgtaccccgtctcgcgcggggtagacgccaggacggcatagccagttatgtctccgcaaggaagacgttgaatggggcgatagtccccgccccccacctgtccgggcgtggggtgcctctgccgtcgcgcccgacagcgtcccgtatatgggtacgatacggaagacgttcgctctcgacccacggaggcacgggcatggcctatgcagaggagacacaaccatcgttcacgctgggcgaccccgccatcgtctgccggtggcgcctgtgccaggggcgtctccccatggagaaccggcacctgagggcgctctcccgacgcagggtcggaggcgagccggtgagcagggagctcatcgcctgggccaagcagcacatagagtggacgctcgaggacggctcggcggagcaccccgacggcgtcctcatgctcgtcatcgactccgagggcaaggcagccatgaccgtggggccctacaccgagctgccggcagcccgtctcgccgacctggtgggcagggcaaccgtgtcgagccgcgaggcggacgagacgggcgtggcccccgagtcgctttgggtcgcccgggacggcgtgttctactggggcatcgagccggactgcgcgccatcgggcgccgccacgctggtggaggacctcgccaagaccctgggccttcccgtgaggcgcatcgacgggctgtcgcacaaggtcgcgtccggcgaggtcgagtacgacgaggcgtttctcgtatccgacgagcatggagtggttcccgcgactgacgccgctggggagcagggcgagaggttccgcagcggctacgacaagctcatggagagctacaggcgcaagcactagcccgcgcgtgccgtgggatgcgatggcactacaccccgcggaacccgcgtccgacgatctcggagctgctcaccatggtcatgaaggcgtgcgggtccgtctcgcggaggtagatcctgaggcgcgtggcctcgcgccgcgagagcacggtcaccaggaccgtctcgggccgtcccgtgaacgcgcccctctcctcgcgcaccgtcgcggtgcgatgcagctcgcgcaccaggaagccgaccacgtcgtttggcctgctgcagatgacggtgcacaccttttgggtgttcacgttctctatgaacgagtcgaccacaaaggacttggagaccaggcccaggatgcagtacaggcccgtcctcggaccatagagcgccgccgcggcggcgacgatggccgcatccaccagcaggagcgccttgcctatctggagcgacgagtacttcttgaggatcatcgcgaggatgtcggtgcctcccgtcgaggcgccgatgttgaagacgatcgcgctccccaccgcggggagacccaccgcgaagatgagctcgagcagcgtgtcgttggtgagtggtgccgagagcgggatcagcctctcgaggaccgagacgtagaacgagagggcaaacgaggagaacacggtccagcccatcgtccggcggtcaaggaacgcgaggccgaggagcacgagggcgaggttgaccagccacatgaaagcgctcacggggtacttggggaagagcgtcgagaggatgatggacaggcccgacgtccctcccagggcaaagtggttgggggccttgaagacctcgatgccaatggccgtgaggaagagcccgaggttgagcgtgaggaagaactggacgcggcccggctcctcccgcctgcgggcgaccttctcgccctcctcgatctcggtgcgggagagttgctcctgtgggacgtacatgccgtgctcctcctgttgcccgtgcgccatcgacggtcgcgagcatgcccccgtcccatctatttgtcaatcgtcccctcgaccccctgtcgcaagtcgccccatgagcggcagggggtttagaatgtgatgaccctgcggagtgcagggatagccaatcggccgaaggaggccctcacgttgttcgcttctcccaactcaactaagaagcacctgtccaccaccagaatcgcccgcatctcgaccattgctggcctgtatgcggcgctctcgcttgtctgcatactgttcctgggcggcctcgcatgggggccggtccagttccgcctctctgaagccgtctgcgtgctcgccctcttcacgcccgacgccgtgccgggcctggcccttggctgcgcaatcgccaacctggcgaacatcgcgcttgggggcaccggcatgctcggcctgctcgacgtggtgtttggctcccttgccaccgcactcggggcccttgcaagctggaggcttcgcgaccggccccgccttgccctcctggggcccgtcgtcgccaacgcgctcatagtcccggcctacctgcccgtcatgctccaggggctgggcttctacaccatcccgttcacgtccatctcgctggacggggcgtatctgcccatgtacctctttggcctcgttgcgactggcctgggcgaggcggccgtgatgtacgtgctcggcctgcccctctaccgggcgctgagcgacggcccgcttcccgagcgcctggcccaggacgcgggggcgcagacggaaggagcgtaggccacagtgaaccccgtcgtggtcataccgtcgtactggaccggtcatgacgagccctccaccctgggggaggtgggggtctacgactacgccacccccatcaccaagcccgtgccagagcttcagacctgcctggagtcccttgagggcgtccgcggcgtcctccgcgtcatcgtcctcgtgataagcgaggcctcctgcgcggagggcgcgcgtgcgcgggtgaacgccgtgtgccgcatgcacccggacctcaaccccctcgtcgtgggcgcccgcgaggcggacctcatggcacgggccatcgggcgggtctcgcccaccatgatgggcgacgtggtgtcgcttcgcggctacggcgccatccgcaacatggggcttgcggtcgcggctgcgctcggccatgacgtggttgtgttcatggacgacgacgaggtcgttgccgacgagaacttcctcatcaacgccgcctacggccttggcctggcgaccaggcagggcctgcccatcgccgtgaagagcggctgctaccacaactcggagggctccccctacgcaacggaggagaagcctcactggtacgaccgcaggtggtcaaagagggtggagttcaaccagatgatgcaccgccttcagggcggcacgcgcatctcgcggtcgagctacgcctgcggcgggtgcctggcggtgggggcgagggccttctgcagcgtcccgtttgaccccttcatcaccaggggagaggacctggactacgtgctcgacctccgcatctacgggtacgacgtgtggtttgaccaggactggtgggtgtggcggaaggtgccccccctgcgagagggcgttgagctcttccgtcaggacacgtaccgctgggagtacgaggcgcgcaagctccaggtagccaacggctccatcggcctgcacccggtgcgccccgagtcgttgaggccctacccggcggaatgggtctcgccggaggtgagccggcgcatctccaccacggccctcctccgcgccgtcggctgcagggagcatcgcaggtacctccagatatggaggcacggacacgcggaggcgcgcgagtgggcggcccgggagggcgagagctacttcagactccagacgtactggtcaaagatgatgggtgccatctgggcaaacccggttcttgcgcaggagctccagcgcctgggcggcgtggtgcagacaggggaggagaggcatggctagccaaacgtactcgcggcgtggggtcgtgctgcgcgccgccgtcgcggtgggggcggtgctgctcctgtcgctcgtggggctgctcgcctccgccaactcgggccccgtgcgcggcggcatcgtcatagcccttgcggcgggggcacttctcgccctggtcatcgtgctggtgtccgcacgcatgctggagccggaggacctgcgctcgcgcgccaccgagcgcaccctgcgcgttgcctccggcactctcaagtacatgtcggaggggctcacggaggaggactgcaaggcggtgtgccagctcctcctgcccgagacggccgcctccgccattgcgatcacggacctgaccaagctcctcgcctacgttggtgtcgagatgcaggggcccgcggtgggcacgcccaacagcgtcccgaccatgcaggtcattcaaagcggccgcatgcagaccttcagcaacatggacgtgcaggaggacccccgcatcgcagacgaggggcgtcgcggcgacctggaccccgtgccctaccccatgggcatcatcgccccgctgacggtgcgcgaccacgtggtgggcgccatcaagctgtactacgcacggggcagcgaggtcgaccgcacccaactggccatcgcccgaggccttgcggagctcctctccacccagctctcggcatacgagctcgaccgacaggcggagctcacggcaagggcggaggtcaaggccctgcaggcccagatcaacccgcacttcctcttcaacacgctcaacaccatcgcgtccctcacccggaccgaccccgccaaggcacgcgacctgctgcgcgagttcgccgtgttctatcgcaagacgctccagagctcgcagcagaccatcccgctctccgaggagctggcgcagacccgccgctacctcaagatcgagaaggcgcgctttggcgaggaccgcatcatcgagaccgagaacgtggagacgggctgcgacgacgtcctggttcccggcttcatagtgcagcccatcgtcgagaacgccgttcgccacgccatgagggacgacgggccgctccatatcgacgtccaggcggtcgtggacgggggagacatcatgatcgccgtggccgacgacggccttggcatggacgagtcggttgccgagcggctgctgagcggatcctcgcaggagtcgtcggacaactcaaagggcacgggcatcgcgctgaagaacgtcgcggagcgcctggagcggttctatggtaccgggtcgggcgtggagatcatgagcaaggtgggcgaggggacctgcgtcaccctccgcctcgtgggcgccgcccccgcctcgcaacagtgtacggagggctgacccggacaagagccaccaattgtggggcttatgccgagaggttaagatggggagaggcaccgacgggccgccctggggcgtccggctattcgaaaggttgtgtgttgcatgcttaacgcgctgatcgtggacgacgaggccccggctcgctccgagctacgctacctcctcgaggagaccggtcgagtcgacaacatcgaggaggcatgcaacgcgcgcgaggcggtcgaggccctggtgaagggcaaggagggctccgaccaccgcaccgacgtcatgttcctggacatctcgatgccccgcacgtccggcatggagctggcccaggcactccacaagctcaagaaccccccggcggtcgtctttgtcacggcctacagcgagtatgcgctcgaggcctttgacgtcgatgccgtggactacctcatgaagcccgtggagaccgaccgcctcatgcgcgccctcgacaaggtggagtcgcgcgtcaagccgtccaccccgtcgcacgcgtcggtcgagcgcatccccgtggagaagggcggtaggaaggtcctcgtcccggtcaaccagattcgctacatcgaggccaaggacgactactcctgcatctacaccgacgacgacaggttcctctcgaccatctcgctcgccaagctcgagcagaagctcactccgcacggcttcttccgcgtccaccgcggctacatcgtcaacctcgagcacgtggaggacgtcgaggtcatctctagcggcatcctccagctgggcctcaagggtgtggacgacaagaagatccccgtctcgcgccgccgcgtggtctcgctcaagcgcgccctggggctgtaggggttggccgcggcatatgcgctacgatatcgtctctgacacgcacgggtacctctcccagcagctccttgatgccctgagcggtgccgacatgatcctccatgcgggggacatgtgctcggactccgatctgcgcacgctcgaggacatcgcgccggtgcgcatgtgcctgggcaacaacgactacgggtactcgtacggccccagcgttcgcaacctcaccagggtcttctccgacggcctgcggtgggagatctgccactaccgcgatcggcttgacctcgagacctgcgacatcgcgatctgtggccacacccataggccctacgttgagagggacgcccgcaccggggtcctcgtcatgaacccggggagccccacctacccccgcgccggcggcccgaccatcggtcgcatcgtctgcgaggacggaaagctcctctccgcccgcatcatcaagctgtcgggaacggggcccaccaggtagccgtttggttgcctgcggcgcaccccgcgctaggacaggctctcctcgtgcagcgcggactcggccgccgcctcgtggagcgcctcgcgcatctccctggtccgcttggcgggaacgcggacggtgctgccgtcaacgagctgcacctccggccccttcatccccaccacgagacgggcgttcaccgcatagctgcgatggacgcggacgaagaatggcggcagaccctcgaggaccgtcgtgagcgggctgcgaaccctgaacgacatgccgggcaggtggacgatcgtgtactggtgcgaggcctccaggtagagggtctcgtcgtagttgaggacgtggcgcacgccgctcgcgtcgcgcagcgccacggggcgcgcaccgcgatagccccatgcgggctgcgccgtcgttgcctgtggcacggcggagaactcctggaggtcgttgccgatcttctggagggttggcatcgaggcgtgcatgtgaacgagctgaggctcctggtccctctctcccatgtgccacacaaaggtggagcgggagcttgccacgtggcggccggactttgagatgacgtcctccaggaggagcacgacctcgcagcgctcgccgcgccacacgagcctgacggtgcgggtcttcacgtccagcatcttgagtgcgccgcggatgcggtcgaggtagcggatgaactcgtcaggcccaaatcccgtgccattgttgaagggacccacaaaggagaagtcgcttgcgagataggggagacaggactttccgtcaccgctccatgcggcccgagagactcgctccgagagcggaagggttccttgtctcatgctgccacccccttacgcgctcgcgtctagctggcgtcttgcgttgcgggcatgccacccattggtgctgggatgcttctcgcactctttaagctgaatatatccaatgtcccaaatgattgaacgagaatcgggcgagacgttttgccagatggcggctgggacatcttttaacaaccttcagaccaatggataccgggaacgtgccaaggccgtccgtccgtcgcattcctcgcctcccgtgtccctaaaattaccctgagggaagggcgcatggcggcgaaagtggtcccgatgcgcgcgtgggggagacgagacgtggctcggggacggcatctttcgaatggcgagactgtcggggagagaacccccgtgtatcgtcgccatggcatggtcgggacaatcgcgctcatggttgtcctggcggtcggcatgaccctccttgcatggccacggatcttgaacctcagggcgcaggcggagatggaccagagcatcaaggcggtggaggacctccgtgccgactcctccgcgacgcaggggcgtagcgacgtgaacctcgatgccgcctggcagtacctgagccagtacaaccaggacgtccgcgacgggaaggtcccccaggtcaacgatccctggggcttctccacttcctccgcgggcttccccgcgaccgagcttcccgatggccttgttggcagcatcaggattcccgcgatggacgtgagccttcccctgtaccttggctcgaccgagcagaacatgctcaagggtgcgaccgtcatgtatgggtcgagcgcacccttgggcgagacggactccaactgcgtggtggccgcgcaccgcggcttctccaacggctacatgttcaactacatcgagcgtcttaaggtgggtgaccacgtctacataagcacgccctggcaggacctggactatgtggtgaccgcgttcaaggtggtggaccccgacgacgtggagtccgtgaggatccagccgggcagggacatggtgaccctcctcacctgccatccgcacccgcagcacacgcatcggctgctggtctactgcgaccgtgcgggaaccggcgctgcggaagcggcgtccgcgagcgggtccccgcagaaaaccgaggggtcgtctgccaacgcgaccgtgcccaagacgtcggacgagacgaccatcctggggatggacgtgctccagtttcaggacgtggccaccaatgtggggcttgccgtcggcgccgtgctgatggcggtgctcgtggtgcgcctcgcgagggcgattggggggcggcgacgtgggtagcgcgaatcagtgcgcttgcccctcgtccctctcggggaggaagagcggcgcgaacacgcgcgtgtagacgatgagccacgcgatggacacgcagaagccggcgatgacgtccgacgcatagtgcacgcccaggtagatgcggctcagccctaccgcgacgatgaccaggcagaagccggtcacgcagagccacttcacaaagcggtccttctcgtagtgccacaccatccaggccagcagcccatagaatgccatcgcaatcatggagtgccccgacggaaagctgtagcccgtctcggcgatgaggcggaacccctcgggacgagggcgctgcacgacctgcttgaggaggacgttgaggcccaccgcgcagaggaggttcaccgcggcgcacagcccggggcgcctccccggggcaaacgcctcgaccaccagtagcatcacgagcaggacgacggggagggcaagctcgctgatcgcctccatgatgggggtgagccagggttgacgcatcttgaccacgaacagctggtacgcagccaggtcgagcctcatgatgtcgccctcgtggacgtcctcgaggagggcgaggaacacgatgaccgcgacccccagcacgatgagacgcaggttcttcctgatgagacgggccaaccttgacattgaaacctcacctttcgggcttctggcgctatgaaaaagcgaggacgcccgtacgtgggcatcctcaccatcagtgtgacgcatgcagccagtgaatgaggtggagactagaggttggcgctgatctctgccacgaggtccgccttgggcatgttgccgaccatggtgtggaccggcttgccgcccttgaagaggatgagcgtgggaatggagacgatctggaagcgctgggcgagctccgcctcgtcgtccacgttgcacttatagagcgtgaacttgtccgacatttcgtttgccacctgctcgataacgggaccgagcgcgcggcaggggccgcaccaagaggcccagaagtccaccaggaccggcttgggggaggagagaaccttctcttcgaagtcctgtgaggtgattgcgttggccatgagagctcctctgctttgcctgcgggcattggacccacggcatcctggaaggccgctcgccgacgcacgtggcacccgacaacgatggtgacgggcgggtggccggctgcgtgtctcccgcttcttgtcttgctgcgcttatacccatcgagtggcaggcgtggcgtaagatttgccccgtcggcacagtttggacaaaaaggttggtaaaaaggtggcatataatcgtcgcgacaggacccaggcatacctgagcaaggcgcgccacgacctgacctccctggcggagaggggggtcgtgatgggtggcaacgcgtttagcagctacgtctttgccaagggcgagctgtcgccggaggaggcctcggggggcaccctcctgggaggtgccgacggacgtgccctcagggcgtcgctggagcacctgggatacgccccagaggactgggcggcgctctccaccacgtcggccgcgggaggggacctcgaccccatgctgctgcgggaggcggtgtgcgcgctggacccctcaacgctcgtggcatgcgacgaggccgccgcccatgtgctgagggccgcgtacgccgacgagctctcccgtcttcccgactttcccgttgccatgctggagcccggctacgtggcacccatcctgggcatgcgcgtcatgaacttggggggcttctccgctgcgttggcagacccccgcaagaagcagctcatgtgggcgcgcctgaagcagctgcccccgctcggcgagccctactgagcctcccccggccttggccgtctgcgcaaacctcgcccccaagtgccaaaatagggggcggcaggttatccattgggctagctaaggagcaacgatggcagacgtccccgcaccaatcgacgcaacgaagacccccgaatggaaggcgctccaggagcactacgaccacctccaggacgtggggatcagcctgaagcggtggttcgcgagcgacccccagcgagtcgacaagctctcctttgacacctccgacctccactttgacctctcgaagaacctggtggacgaccagaccatcaagcttctcgtgggcctggcgaaggccgtgcaccttgaggagcgtcgcgacgccatgtaccggggcgtgcacatcaacaccaccgaggaccgcgcggtgctccacacggcgctgcgccgtcccaagtccgacgtgggcaagtacgtggttgacggccaggacaccgttgcggacgtccacgaggtcctcgaccgcatgtacgccttcgccaaccgcgtgcgcgcgggcgagtggaagggcgtcacgggcaagcccatcaagaacgtcatgtccatcggcatcggcgggtccgacctaggcccggtcatggtctacgaggcgctcaagccctacgcggacgcaggcatctcggtgcgctacgtcagcaacatcgaccccaatgacatggcggagaaggtcaagggcctcgaccccgagaccaccctcgtcatcatcgtctcgaagacgttcaccacgttggagacgctgaccaacgctcgtgaggcgcgcgcttggctcctcgaagggctcaaggcgcagggtgccatcgacggctccgacgactccgtggctgaggccatccgccaccacttcgtcgccgtctcgaccaatgcggagaaggtcgcggagtttggcatcgacacccagaacatgtttggcttctggaactgggtcgggggacgctactcggtggacgcggctgtgggcctctcgctcatcatcgcctttggccccgagcgcttccaggagttcctcgcgggcttccatgacctggacgagtactttgccaacacgccgctcgagaagaacgtcgtcgcgctgatggggctcatcaacgtgtggtacgtcaacttcttccacgccgcgagccacgcggttctcccctacgaccagtacctgcaccgcttccctgcctacctgcagcagctcaccatggagtccaatggaaagagcgtccgctgggacggcaccccggtgacctccgacaccggcgagatcttctggggcgagcctggcaccaacggccagcatgccttctaccagctcatccatcagggaaccaggctggttccggcagacttcatcgccttcgccaacacgcccaaccccaccaaggacggcgaccaggacgtgcacgagctgttcctcggcaacttcctggcgcagaccaaggccctggcgtttggcaagacggccgatgaggtccgcgccgaggggacgcccgagtggatggtcccagcccgcgtcttcacgggcaaccgtcccacgacctcgatatttggcgaggcactgaccccgcacgccctgggcgagctcatcgccctgtacgagcacatcacctttgtggaggggacggtctggggcctcgactcctacgaccagtggggcgttgagcttggcaagcagctcgccaagcagattacacccgccttccacgacgaccaggcgctcgccgggcaggacgcctcgaccaaggcgctcatcgcctactatcgcgcccaccgcaagtagtcgccttccgggcatcaagcagacgggaccgtcgcggttcgtccgtggcggccccgcccgtctgtccgcccgatgtgaccccgaagcgacgaaacgtgccttgccaggcgagaggtgcgcgcctctcggctagcagttgcccacaaagacgtgcgggagcctcctgcgcgcgacttcggccaggtggcggaccgtcggcacgggcgtggggcttgcgtcggacatgcgccagttggggaagaagcgggtcacgtgtagggtgatgtctcccggcagtgacgcgagccaccccgcaaggtcgtccatctcgcccgctccgtcgttcatgtcggggacgatgagcgtcgtgacctccaggtggcacgtgcgctcctcgctcaggcgtcggatcgtccccctcacggtgtccaggtcgcccccgcaccttctgtagaagtcgggcgagaaggacttgaggtctatgttggcggcgtccaggaggggcgcaagctcgtcgaccacacccggctcggcgtaaccgttggagaccaggacggtcttgagccccgagcggtgcgccaggtgggagcagtcccgcacgtactcccagcacaccagcggctcgttgtaggtgaaggcgatgcccaccatgtgggggtcgaggtccctctcgcgcatggccagggcaacgaggtcgtccggcccgacctcccgccaggggacgtcgtcgctccccgcctgcgagatccgccagttctggcagaacgggcagtgcaggttgcagccataccctcccaccgacaggacgcggctgccgggcatccaccgggcgaggggcttcttctccaccgggtcgatggcgatggaggtcaggcgcccgtacgcctcgtacgcgaccgaaccgtcgacgttgcgccgcgcccggcaggcgccgagggcaccgggttccaggcgacagcggtgcgggcacacgtcgcacgtcgcgatgacgcccggggtcccctcgcccttcatgcgtgcctcgccacctcaaagcgctcgagcgaccactcgtcgtggtccaggtctatcccgcccttccgcgcggcgatggagacctgctcctggaccgtgtccacgccgtcgaggtcggggagaaggacgccgcgccttccgtcgggggtgctcaccaccacgccgtagcgcctgacgtcgagctggtcggtcgactcgatcgcctcggggtcgcccagcacgtccacgtcgtacaccagctcgggcagctcctcaggccgcacgggcggaaagcgcgggtcgctcgagcaggcgctgacggcgttggacgcgatctcgtccgccaggcagtcgcgcaccgggcgaatggtcccgatgcaaccgcgcagctcgccgttctccttcagcgagacgaagcatcccgccctcctggaggtcatctccttcggcaagtccgtcggccgcgctgtcctcgcgccgctctccacaaaggcctcgaccgtggcgcgggcgaggcgcacgtacgggtcctccccctcgcggcgcgcctccatctccctgcgatggcaggactcgtacgcctccaggaacctgcgcctggggtccgtcccctcgttgccgatgggggtgaaggccgcaacggcatagcccacgccaaacgggccctcgtgcgacaggagctcgggtcgaacgtccgtgccgtcgagggcgcccgccatgatctggaagctgcggagcccgcactcggcagcccggtccgcaaagccgcggtccatggtgaggagcgggaggaagtcgcccgtctcaaacgccttctcaatgcgctcgtcaaactgtgggccctccggggcaaagccgtacgggccgtccttcgagagcttgtgagagaggtcccccgaggcgacatagaccacgcggcgcccaaggacgctcgcaactcgctggaccaaggcacccaaacggtagtgcgcggcaggggagaggcccgagagccctatgcgtacaagcttataatcagggtagtatttttgaataaagtgcatgggaatcatggtcgcgtggtcgagggaggggtccctctcgccccgtgtcccggcagagaggccctccgcatcgcaggcggctgcgagcgcgcttgcaaactgggtgtcgtaggctgcctcgtagcgtgcctgcggtgcgccaaactccgcgaagctccccgatgcccctgcgcctggcgagatgtggttgtagtcgcggtacatgaccgagtggggggtcgataccacgatggtgtccggcgcgagggcggcgaccctcctgccgacctcgtcgtacgcgtcgatggtcgactgaatgcccctctccctcccgcgtcccaccgcgggaatgatgagtggtgggtgaggtacggcaaacgcagcgagaatagccatggcagtcccccttagacgctgttaagggatggtatcccctgccatggccgcacttatgcgccttgggggagagggactttgccacgtctgtgccgacgttttcagatgcctgtcatgcgtgaacggcatgttacagaccagttatcggaaaattaacgacgctcaaccattcagacacgtttcatcaaccccacagcaacacaaaagccgtacattcgattatgagcgtttcttataggttggccatggctcgtagattgcacgtggccgagtggaaaggggtacgcccatgcgtagacatggactcgtcgcaaagacggtcgctgcctctgcagttaccgccgcccttgcgttcgcggctcccattgaggctctggcatgcacccaggtctatgtgggctcgcagctcactgccagtggcgacaccatctatggtcgcgaggaggactacgcctcccgccacgtcaaggtgtttggcgtccaggacgagaccgatggccgcacctacatctcgggagagagcaacttcaaccgtaccgtcggccacacgtatcgctacacctacgtgcgcgacaccgaggccgactggggcatggatttcccgccctactccgaggccggcatcaacgagaacggagtgacctgctccgcaacgctcacgaccgatgccaacgacaaggtcatggcggttgaccccgcgaccgacaacggcatcggcgagtacaacctcgccgacgtggtgctgggcgaggcaacctccgcgcgcgacggcgtggagaagctcggcaaggtgatggacgagtacggcaccgccgagcacaaccagatctggattggcgacaacaacgaggtctggaacttccagcagctctccggccaccagtggattgccatcaaggtcgcggacaacgtcgcctccgtcaaccccaacatcggctacctgcgttataaggtcaacctggacgaccagagcacctgcctgcactccgagggcatcgaggacgttgccaagaaggccgacagctacgcgaccttcgacgacggcagcttcgacgtcgccacctcctacggcgacaccgatcccggcgtccaccagatgacccgctacgcccagggccgtgcctatctcggcgccgcccttggcgacagcgacttcaccgtcgacggctccggccgcgtggactcgctctccatggacgcccgccagctgttcttcacgcccggccgcagcgactactcgctgtacgacgtccagcgcctgcttgccgcccgcggcgagggcacgcggtttgacgccaacaagaacaccaagctctacgccatcggcaacaaccgcggcgtcgagtcccacctgttccagacccgcaagggcatgagcgcggacatcgccaccattcagtgggaggccctctcgaggaccgagttcagcatctacgtgccgtcctactctgcgctgctgaccgaggttcccaccgacgtgtacagcacgtatgacggcatcgaccagagccacaccggcaagagcgagcgcaacgacgacgtcaacgcggccatggacaccaccaccaacggtgacaacatggactacgtgatgatggacctcaacaccctggcgtacaacaaccgcgacaaggtgggctccggcgtcgccgcgtacctcaaggccctgcagaccgaggtcaacagccagcaggaggtcgtggacgcctacatgcagtccctgccctccgaccagcgcaccgatgcggcgaacaaggcgtttgacgccgtctcgcatggtgtgtacgagaaggcaaaggccctgcgcaccgaggtccgcgagtacctgaagggcgaccagtccaaggagttcgccgccagcgacctcaactccgacggcacgctcaaggacccgctgcagtacgccgccaaggtcgtcccgccgaccatcaccggccagccctcgagcgcaaactacgtgcagaaggacgcggcgaccgccctgtccgtcgacgcaagcgaccccgccggcacgagcctctcgtaccagtggatgaagtccaccgacggcggcaagacctggaagaaggttgccacctccgacacctacacccccgccaccacggacgagggcgaggcccagtacaaggtcgtcgtgaccaacgagggcggcctcaccgccgagtcccaggtcgccacgatctcggtctccaagcccgtcgtccccgcccccaccggctccatgtaccgcgtgtacaaccccaacagcggcgagcacttctacaccgccagctcctacgaggcgggctcgctagtcaaggttggctggaggtacgagggcatcggctggacggctcccaagacgtccaacactcccgtgtaccgcctgtacaaccccaacgcgggcgaccaccactacaccaccagcgccgccgagcgcgacatgctggtgaaggccggctggaacgacgagggcatcggctggtactcggacgacgcccagaccgtgcccgtgtaccgcgagtacaaccccaacgccaaggccggcgcccacaacttcacgaccaacaaggccgaggacgagatgctcgccaacgccggttggaaccaggagggcattgcctggtacggagtgaaggcccagaactagcggcccaaggggcctgattcatcccttccggcggatgtggtttgtccgtccgccggaaggccttttacagcatgggagggtttttgccgccgttgtcggaggccctccctttctcttacccctctacacgtttcgcgtcccctggggacgagtctgcacctattgcctgaaataaaaccaaatcatcgttgcaagtaggttcgcgcgccggacatcgctggcgtgcgaggagagaagggagtggggatgcatcaggaagtggagaatccgtttggggcgctgcgcccgcgggagcagctcaggcggaggatcgcgaagggggccgcggcggtcgtgatgaccatagcgctcacgcttcccggggtggccatggccaacccggcgagtggggcgaccatcacgctcacgcagccagacggtgccaccttcgagtttacgatcaacggagacgagtactttaactaccgcctcatggacaacggcgcgatcgtcgaacttgacccctctgacggcgtgtacaagcaggtcgtgaggggctccgacggcagcgtcgcctttggaagcccggcccaggctgagaaggaccccggcgcaatcgggaagtccgacctctccgacgaggcaacgcgcaaggcgatctatgcactcatgggcagcgagtatcgcgagtccaccacgagtacgccgtcggcacccgtgaccgccgacaagatcacggcaaagcagcgcaaggacgtgaacgagagggagggggtcgaaaagacccttccgctcctcacggtcgtcgtcgagttcaacgacgagaagtaccgtgacgactacaactggggggaccagttcttcacgggcgagtggagcatcgagaagtactacaacattgcgtcaaacggcaagttcacctggcgtcccatcgaggagacgagcgccacgggcgtcgacggcaaccacaacccctacgacacggccaacgacggcgtcgtccacgtgactctcgaccgagaccatggtgcgcttgactatggcaagaactacatcgagacgctcgaggcaacctttgacgccgtgagcaagtacgttgacctagccaagtacgacaccaaccacgacggaaagctggacaagaccgagattggcatcggcctcgtgtttgccgggtatgacgagtcggcgggctatgttccctcgggtcacggctgcatctggccgcaccagtggaccttctccgacgcggcgggtcagaacggcatggatgccaagccctacgaggtgaccacggcgagcggcaaggtcgggatcgactcctacgtcacccaggcggagactgagtccacgggggcgaccgaggagcaccagagcggcatcggggcccttgggcacgagctcggccactacatcggcctgcccgacctgtatgacacctccgacgggtccaatcccggtccgtgggccgactactccttctccggcctctcgatgatggacggtggctcctggggcgtggtccagacgggcaaggacgcgggggtctaccgtcccgggttcttcgacgcgtggtcccgctacttccttgggtacatcgagcccgaggagatcacccacgacggcgtgtacaccgcaagctcccagatgagcgaggctggcttcaagagcttcatcatcaaggcgagcgacggcgagtactacctggtggagaaccgccagtacgagtcctttgaccagggcatggagaagttctacctcaaggggaagaggagcgggtactcctacgacaaccccaccggcggcatcgtggtgtaccacattgaccagggcgtcgtggacgaggatggcatcctcaccggtgacaacacggtcaacgtgagcacccaccgccccggcgccatgcccgcgtactttgagcttgccgacttcaacggcggcaagccgctcattcgcatgccgttcctcaacagccacacgcaggaccagctgggcaccagcaccacgcccgtcctcctgtacaacggcaaggacacccccgcggagcgcactgacaccggaatcaagatctcctcgaccgccaagggggccgcatcccaggcgttcgtcgtcgacttcccggcatccctcgcgtctctcgacggaaaggcggagctctccgccgatggtggcagcgtcaagtacaccgccaagctcaacaacctcaacgtggaccagaaggcggagctcgtggtcctcgatgccgacggcaacagggtcgatgcggactgggcgcatgcgtggctcgctggcggggcggcagacgagaatgccgtgagcacgctctccgcaagcatcgacgtgccggccaacgagacgaccgaggcgcagggctaccaggtcgcggtattcctggatggcaagcagctgggcgaggcggtcaagctcaccgtagcggcgcatcccgtaacgctcacctcgctcaagcccgcccagagcacgctcgactccaacggcgctgacgtgagcttctccgccgacctcaagtacgtgcccgagggcaagagcacgcagcttcgcgtgtacgacgccaacggcgaagccgtcagccgcgcctgggcgacggtcgacctccacaggggcgatgacggggtctactccgcggccatcagcttccccggaaacctcgagaacgccgacgccgagtatcgggtggcggtccttgtggacggccaggaggtcaacccggacgcaagcgccacggtgacggtgaagggggttcccaaggtcgaggtcgggacgatgttccgcatgtacaaccccaactccggcgagcacttctatacccagagcaagctcgaggcggggtcgctggtgaaggcgggctggacgtacgagggcgttgcgtggaaggcgcccaagacgtctgacaccccggtgtaccgcctgtacaaccccaacgccggcgaccaccactacaccaccagcgcggacgagcgagacatgctcgtcaacgcgggctggaacgacgagggcattggctggtactccgatgacgagcagggcgttgccgtctaccgccagtacaaccccaacgccaaggccggcgcgcacaacttcaccacgagcaaggccgagaacgaccatctggtgaaggtcggctggaatgccgagggcatcgcctggtacggcgtgaagtagcccagtcaggcaactgatgcagggagagggggcgagcccatctgggttcgccccctctcgtcggtggcaacgttcctctcgcccgcgcctactccgccagcaggggctccatcttgaagctgacgcagttgacgtagccgcggttggtcagcctgagctccgggacgcatgcaagtgacatgacgcccatggtcatgaacggagaggggagcgtgcaccccatctgccgccacgcggcctcgatggcgctcaccttgcgggagacgacctccacgcgctccgtgctcatgaggccgcacactgggagctcgaccagtgcgagcaccttgccgtcctggacggcgacctctccgccgccgcacgcctcgagcgtctttgcggcaaggagcatgtcggcgtcgttgtcgcccatgaccaggaggttgtgcgcgtcgtgcgagacggtctgcgccagcgcgccgtggatgccgaagccctttgcgaagccgcgcgagtgggttcccgcgctgccgtggtggcggtcgaagacgcagaccttgagcacgtcgttctcgccgtcagcctgcagcttgccgtcacggacggggacgtctacgatgatgtcgtgcgtgatcgtgtcgccgggggtgatgcccatggcgcgcaccttgcaacgcccgtcccgccggtcgacggggaactcgaaggcttggggggtgagggtgtcgcccagctccatggtgtgggtcatgaagtcgggccaggggaagggctcgacctcgaagcgcgccttgccgtcccgggcgaccaggtcgccgtcgatccatacgtaccgcgcgcggaagtccctgaggtcatccatgaggacgacgtcggcgcacttgccgggcgtgatcgagcccatgtcctggccaacgccaaagtaggtggcgcagttgatggtgcacatctgaatcgccgtcacgggatcgagtccgagcgagaccgcggtgcggagcacgcgatccatgtggccgtcgtccacgatggtgtgcgggtgggagtcgtcggtgcacaggaggcacaggcgggtgtcgacgccgctctccacgagctgcgggaggtaaccgggcaggttgagccaggctgacccctgcctgagctgcgcatacatccccatgcggagcttcgcgatcacgtcgtcgaaggttcccgactcgtggcaggaggagacgcccgcggcgatgtaggcgttgaggcccctgtcgtcgtcggggctcacgtagtggccggtcacgaccctgtcggccttgagggtctccgcgacctcgcccgtggcgttctcctctcccgagaggatgcccgggaagttcatcatctccccgagcgcgacggtctggtcccacgtcatggtctgcgcaacctgggacgcgtcgatcgacgagccggtgtcctccacccccaggacggcgggcacgcaggagggggttgtgagcatggtcttgagcggggtgcgggccgcgtcctcccacatcaccctgacgccctcgaggccgcgcacgttggcgacctcgtgcgggtcggcgtatatcccggtggtcccgtgcgggacgaccgcccgggcatactcgctcggccctaccatcgacgactcgatgtggatgtggctgtccatgaggccggggaccgcgtagaggcccgccgcatcgacgaccttggtgtcgggtccgacgcagtgctccgccgtgtgcccgccaatccccaggtaggcgattcgcccgtggctgatggcgatgtccgcgtcgtccaggacctcatgtgtcgtcacgctcacgagccgcgcgtggcggatgacggtgtctgctggccgctttcccagggctacctcagccagcgcattgtggcactcccagagcggctccttgcaaaagtggttgatcatttcgcgcgacctgcctttccagggcctgacctgccctcccgcggtggcactctgcattctggggctagggtaacgcaagaagtgccgctacgccttgcgggacgtcctgcccacttcgttggcactcccgcatccagattcgtgtcccgggctatggggggtcatggcggggaatcggtgggacaagaatggcgaggggagcccttcgcgtggatctctggcgagaaactcccgaggtgagtgcttgctgcgggtttcgcctgcctggaggggtcttcgggggacgagcttccccagtcggagattcatcatcatggcaactgagtcccgatatgagcgctcaccgcgggagtctgctgccatccgtgcccggaacgggagccgtttggcggcaaatgcccgaaatgagtactcacatcgggagtttgctgacactgtcagggtggcaggaatcttccccgacccctcacctgggaaagcgtcgcgtgaggctggcgtcttcgggcaatcatctcacggaagtactcacatcggactttggctgccatcggagggcgtcgtgccggtcgatgcgcggctaccgacgactcgactaccgagtcatggcggcaaacccctccctgtgaggcgcttgttgcagggggtaggggtggtcgttctcccacgagcagtctcgcggagtcgctcgtccccggcgaaaggcacgtgggcaagcaaaaaggccgaggcgagaagccccggcccacgactcgcgatgagtgcctcgcgtcgccctagtcaaccgcctcggcggaaccctggggcaccgactcctcgtccctctcgcccacgtgggcaaagagggtcctgaagacgaggcgggacaccggaccggctgcgaacaggttccagaggagcgccatggggaagttcttgatgagcgttcccacccagatcgcgggaagctgggccacgggcatgccaccgaggatcacgttgaagaggatggcggcgacgaggctcatggtggggcacatcacgagcaccgtgcagcaggacctgatggtgccacgcacgaaggcgctgtcacgctcctcgtcgacgcagcgggacgcaagcgccatccccaggcgattgccccagaggttggagaacaggaacacgaagagccacatgtacgcggcctcgagcagcgcgtcccagaagacgacgttcgtcatgttggagaacccgcccgcggtggtggggatccccatcttccaggcgacgttgtagacctccatcccataggccatggtcaccgacatgaggatcccgaagatgattccctgcgccttgttcttgggcatgctctctcccttcgcggcggtgccgcaacaaaaaagcgtgcgagcggtcgtgggaccgtcgcacgctttgccaactacgctgtatcgctgctcctggtggcgttgtggggcacccggttgcagcagctttgcgctacacgcaggtactgacgatagcatgtggcgcatgcggcgcgacaaaatcatcacgttgcgggagagggtcaaacgccctgagtcggcgggggtctgggctataatctcctgcgtcaatgagcggccccacgggcgtaagtccaattgatccaccaggccgctcgccgtgggcacccaagcccctgcgtccctcgcgtgcggccaaacgccgtctcgtcgaagggaaatcgcatggctcaaaccgcatcggaagggcgctccagatccgcccagccaaagctctggaccaaggacctcgtcctcatcatcctggtgaacctctgcgtcttcaccaaccacatcatgtcgctgtccacgttcccgttcttcatcaagagcctgggtggcaccgaggcgatcacgggcgtgtgcgccgcggccttctcgttcgtggccgtcatcgtccgcccgttcgtgggctggtggctggacaacggcgtccgccgcacggcactggtgatcggccttctcctcatggcgctctcgcccgtggggtacgtgaccgtccccgtcctctccatcgcgatcttcttccgcatggtccacggcgtgggcctctcgttctccaactccacgaccgcgaccgtggcgtccgacgttatctgcaagccgcgctttgccgagggcatgggctactttggcatggccaccgcgcttgcctccgcaatcgcgcccgccctgggcctttcgctgatggagggctttggcttcaaggtgctctacatcgtggccacctgcatcgcgctcgtgggcctcctgctgttctcgttcgtccatgccccgcgcgtcgaggtgccccacaagccccttgacctcaggacgatcatcaaccgcgactccctgcccgcgacggtgaccatgctcgtgttcatgttcacctttggcgcgctcgagaacttcgtcgccatctacgcgtccgacaagggcctgccctccggctccatctacttcctgatcatgagcgtcatgctcctgctggtccgcgtgttcctgggccgcctggtggacgagaggggcgaggcgttcttcgtctatgcgtgcaacgcctctatgctcgtggccttcctgctcctcgccttcgtgcctaacgtggggacgttcgtcctgtccgcggcactcgccggcttcgcgtttggcggcctggagccctcgctccagtccatggcggtccacacgtccagcgacgagaccaggggctcggcaaactccacgttcctctgcgggtacgacatcggctacggcctgggcggcggcgtggccggctcgctcatcaccgcgatgggctactcgtccatgtgggcgatcgtctcgctcgcctgcgtggtgtctgtgctggtctacgtgctctgggcgcgtcacagcgacacgagcttcagcaaggcgctcaaggccgagaagaggggatagtccccggggtgccgttgccggagacgccggcgcggcgccctcccatggctttttggtggttgccgcgcttctttgctacagtactctccgtaagtgcgccctgtgggttcgggtgacgccacacctcgaacctggtcagggccggaaggcagcagccataaggggcctctggcgggcacccgttcccgcagggcgcacttgtacgccccctgcagccagcgagaggttggccgcgggggcgttttctatgacggcagcgcctgccgccccagccgacctttggagagtcgccaatgggcttcgtcaacatgatcgccgagcttctcagggacccgaggaccgccatcgcaagctggatcgccgccggccccatggtcgcctacggcctggtcttcctcatcgtgttcatcgagacgggcgtggtgttcttcccgttcctgccgggcgactcgctgctctttgcatcgggcttcttcgcgcacaacggcgggttcaacatctttgcgctcctcggagttgcatgggccgcggccatcatcggcgaccagtgcaacttcatgatcgggcacttctttggccagcgcatcgtgaggagcggcaaggtcaaggccatgacccccgagcgcgtggagaagaccgaggccttcctggacaagtggggacgcctggcaatcttcctgggccgcttcttcccgttcatccgcaccttcgttccgttcctcgcgggcatgggcggcatggcctggcaccacttcgtggtgttcaacatcctgggcggcgtcacctggtccacgctgttcacgctgttggggtacttcttcggcgggatccctgccgtccaggagcacttcgaactcgtggtcgtgggcatcatcctggtttcggtcatcccggccgtggtcggcgcgatcaaggccaagctctcctccaagaagggcgcggcccccaagcacgcggcatagccgacaccgtcgctcaacctgccacccaatgccacgccccggggggacgtggcattcttgtctccttgccgcatccctgcgtttgggccgtcccaaacgtggaaaacaacgtacgatggcccgcgtgggccggggcacggccatgtctggcaagcgagaggggcgatgcaaatggacgtcgagggcatcctgggggcaatgacgctggagcagaagtgtgcgctcctctcgggagggaagcccttctccaccagggcgttcccctccctgggcgttcccagcctggagttctcggacggcccacacgggcttcgccaccaaagctccggcgcggacaacctggggcttggcacctcggaccccgccacctgcttccccaccgccgtgaccgtggcccagacgtgggacacggacctcgcggagaagattggcgaggcgctcgcggaggaggccgcctccatgggcgtcaacgtggtgctggggccgggcctcaacatcaagcgcaacccactctgcgggcgcaactttgagtacttctcggaggaccccctcgtctcgggccgcatggcggcggcatacgtgaggggcatccagtcgcggggcctcggcgcgtgccccaagcaccttgccgccaacagccaggagacccgcaggcagtcgtccgactcggtggtggacgagaggaccctgcgcgaggtgtacctcgccggcttcgaggagtgcgtgcgcaactcgcatcccatggcaatcatgagcagctacaacatggtcaacggcacctatgcgagcgagaaccgccacctcctcagggacgtcctgagggacgagtggggctttggcggggccgtggtcaccgactggggcgcctcgaacgaccaccccgcgggggtctcggctggctgcaccatcgagatgcccgcccccaacgactgctccatccgcgagctggtgattgcggtgaggaccggtcgcgtgagcgaggcggacctcgacgaccgcgtgcgagaggcgcttgcgctcatcctccggaccgaccgggccaaggccggctatcacggcggctacgacgcggatgcccaccatcgcctcgcccgccgcgcggcggaggagggcatcgtcctcctcaagaacgacgcccccgccgacgcatgggagaagggcgcccccgcggcggagggggccggcggggcggcttccgggcgcgtcgcgccccgcacctctccgctgctgccccttgtgccgcacaccaaggtcgcgctcgtgggtgactttgcccaggccccgcgctaccagggggcggggtcgtcgctggtcagcgcgacgcgggtagagagcctcctcgacgtcatgcgtgcagacgacaggctcgacctcgtgggctacgagcccggcttcgagcgctcggggagggcaaacccccagagggccgccgcggcggtcgagctcgcccggcgcgcggaggtcgtgctcctgtgccttggcctggacgagtccagggaggtggagggcctcgaccgcaccaacatccgggtgagctccaaccagatcagcctcctgcgcgccgtctttgccgccaaccccaacgtggtcgtgctcctctccgcgggaagctgcgtggaggtcccctggcagacccatgcgcctgcgatcctgtacctggcgctgggcgggcaggcgggcgcctcggcggcgctcgaggtcgtcaccggcgccgtcagcccgtgcggcaggctcgcggagacctggcccgtcaggctggaggacgtccccagctttggcaactttcccagcctgcagcgcacggcggagtaccgcgaggggccgtacgtgggctatcgctactaccagaccgcccacgtgcccgttgcctacccctttgggtacggcctggggtacacgcggtttgagtactccgacctcgtcgcctccaaggacgaggcaagcttcgtcgtgaccaacgtgggacggcgcgagggcaccgacgtcgcgcaggtgtacgtggggctgcccggtgccgcggtgtttgcccccaaggtccagctgaggggatgggcccgtgtgagcctggccccgggcgagtcgcgacgcgtgaccgtccccctcggcccgcgcgcgttccagtacttcaacgtcgagaccaacgcatgggagaccgagggagggtcctatctcgtctcggtgggggcaagcgcggccgacctccggcttcaggcggaggtcgaggtcgcgggcagcggtgcccccaacccctacgcggggctccgactccccgtctaccagtccgggagggtggcggacgtcgacgacgcgcagttctccgcgctcctgggtcgcgccatcccgtccccgcgcatccccatcgacgccaacctgacgctccgcgacctcaccaagtcgcgcagcccggtcatgtgggcggcgggaaaggtggccgacgcgtactgcggcaggcagctcgcgagggactccttcgaccccaacgtggcctttgcctacaacatgcccctgcgcgccctccccaagatggggctccccgtcaccaaggcggcgatcgacgccctggtgctcgaggcgcgcggcggctgggtggtgggtgccgccatcgccctcgccaggaggaagcgctggccccttggtgcctgcctctaccttgccgccgccgccgaggtgggcggcctggtcgccaacggggccctcgaggcgctcctggaacggcagtcgggcgagggctagggggcgggcgggggtccgccgctatactggtaggccgagtcatgcgaggcgtcggaggcgcgatggaatccctttacagaaagtaccgccccaagaccttcgaggacgtcgtgggccagcagcacgtggtcagcaccctcgagcacgcggtcctcgagggcaagacgagccatgcctacctgttctgcggtccccgcggcacgggcaagaccaccatggcaaggatcctcgccaaggcccttatgtgcgagaagggcccgggccacctccccgacggcacctgcgagcaatgcaccctcatcgccgagggcgagcaccccgacgtgtacgagctcgacgcggccagccgcacgggcgtcgacaacgtgcgcgaggagatcatcagcagggtgggctacgcacccgtgcgggggagctacaaggtctacatcatcgacgaggtccacatgctcaccacggcggcgttcaacgccctcctcaagaccctcgaggagccgccgtcacacgtggtgttcgtgctctgcacaaccgacccgcagaaggttcctgcaacgatcctcagccgcgtccagcggtttgacttccaccccatagccgcggacgagatgctcgcccaccttgagtcggtgtgcgagagcgagggcttcacctacgagcccgccgcactcgagcttgtggtccgccacgcccgcgggggcatgcgagacgcgctcagctcgctcgagcagctgagcgtctttgggagcgggtccatcacgctcgccctcacgcgcgacatgctgggcgaggtgtcgtcgtccacgctccacgtcacggccaaggcacttgcggagagggacgtgcccacgctcttctccaccgtcgcgtcgctcgtcgacgccggccgggacctgctgcagttcacgcgcgagctcgccgcgcacctgagggacgtgtatgtggtcgccgccgtcggccccaagcccggcgtggtgaccgcgacgaccgaggagctcgaggcgcttggctcggaggcatccgagtttggctccgtcgacaggctggcgcgcgccctcatggtgatgggcgacgcctcgagcgagatgcgcacggcgaccaaccagcggctcgtcctcgagatagccctcaccaggatcgctcgtcccaagagcgacctcacactcgagtcccttgccgaccgcgtctcgtcgctcgaggagcgcatcgcctcccttggcgagggcgtccccgtcgcggcggttgcccagccccgccaggcatctggccagcaggcgccggcgggggagaggaagccccagggcgcagccccggccagccccgcgccggcagccgcccagcccgtccccgcggcgaccgaggcgcaccgcgtggagcacagggtcgcgcccctctcggcgccaatcgcgcacccgtgggagcgcggccaggagcagcggcctgcaagcgggtcgcccgcgacgcagcagcgacccgccgagccagcccccgcccccgtggcacccgcgccctcgcaacctgtcccggcccaggcgccgcggccacaggcccagcgcgaggcccccaggcaggtccccccgacgcccgccccgtcccccaagccgcaggccccgaagccgcaagcccagaagccccagtcgactccctcctcgtccgcctatcctgcggtcaccgatcccggtgagctgcagcgcaggtggaagcaggtggtcgaggggctgctggcaaaggaccctccgcgcggctcgctgctcatgcagtcgaccgccatgcaggacgacggcgagcacctgctggtcaaccttcccaagggcagcggctttgcggtgaagatgctcgatcgcaaggacgtccgcacggtggtggaccgcgccgtcgccgaggtctttggctaccgctccatcaactacgtggaggcgagcctcgcgggtgcggacatcgcccgggcgcgcaggtcggctccggcatcacccaggcaggctcccgtcgcgccgcagcgccagcaggcgccgcgtccggtgcctcccgtcccggcgcccgccccatcgcccgcaccggtgcccgtcgcggaaccgaccgcgcaggcgagtgcgccggcccagccgggctacgccatgccgtgggacgacgaggcggttccctacgacgacgcctcggccgtctcgtatgacgaggaggcgcaggaggcgaccttcgccgcgcccgcggcccccgcgcccatggcgagcccggtcgggggggcgactgccccggccccggccccggcacccgtcccgcctcgccaggaggcggcgccagccccggcacctgctcccgttcaggcggcagccccctctcccgcgcccgtccccgcgtcggcggcggacccggtgccctcggcatcccccgcggcctcggcaggcggggaaccccttccccaggacgtcgaccggctgatgcagatgctcaccaacgtctttggcgatggggttaccgtgagcgtggagcatccggacggcgccggtggcgacaccggctcagaatcggggggcgacacaggcggggagggcctctcgcccgactcgtatggagacgaagactaggcgggcgtaacccgcggggaagtgattgacatggatatgcagcagatgatgcgccaggcacagaagatgcagcaggagcttgccaagacgcaggagaagctctcgcagacggaggtgtccgcgtccgccggcggcggcatggtcaaggtggcagggaccgccgacggcaagatcacctccatcacgatcgaccccgaggcgctcgaccccgaggacgtcgaccttctgcaggacaccatcctcgcggccgtcaacgagtgcctcgacagcgcgcaggacgttgccaaccagcagatgaggggcgttgcgggcgggatgaacctccccaacatccccggtctcttctaatgccggaacccaacgacggcagggcgctccagcggctgcttgacgagctggggaggcttccgggcatcggccccaagtccgctcagcgcatcgcctactacatcctggagtcagacgccgagacggcacgccggctctcgagcgcaatcctggacgtgaagcggcaggtccacttctgccccatctgcttcagctatgccacgcgtgacacctgcgacgtgtgctcggatgcctcccgcgaccgcagccgcatctgcgtggtgagcgagccgcgcgacgtgagcgccatcgagcgcacgggctcctaccacggcctgtaccacgtcctgggcggcgtcatctcgcccatggacaaggtggggcccgagcagctccatgtgcgcgagctcatggggcgcctggccgacggcgaggtcaaggaggtcatccttgccaccaacccggacgtcgagggagagacgacggcgacgtacctctctcgcgtgatacgcccgttgggagtcacggtcacgcgcctggcgagcgggctccccgtgggaggcgacctcgagtacgcggacgaggtgacgctcggacgcgccatcgaggagcggcggtcgctctaggcaccacgcaggtggcgcctcgcgctaccatgcacacagacaggaggtctgtcatggcagataacgagagaagggaccggaggggcgggaccccccggcgcggcagccacgcgggcgcgtctccgcgtcggacggcatccgcgggcagcgggtcgggcgccgcgcggcacgcctcgcacctatcgcccatatcggctccccagtcgcagggggcacggcccccgagggaccgtctgcgcaaccttccgcagatcgacgtcggcgggtccgagcaggacgcaccccgtcccatcggcgtggacccggcggtcaccgggtcgttccgccgcatcgacgtgggggagggcgccagggtcgagacgcgcgacaacgtgaggaccatctcgcccgactcgacctcgtcgtggaccaggacgggctttggcgaggagatgcagctgcagggccgcaacaagccccgcgtccgcaaccgcgagaccaagatcaagaccaacaagcggctgaacatcggcatcgccatagccgccgccgtggtcatcgtgctcgccattctcgccttcaacgcgatcatctcgcacagtcccagcgccgagcaggcggacagcgggcaggtggaacagacgcagaccggctccgacggctccatcacctacaacggcacggtcttcagcatcaagcaaggtgacgacggcaagtatgcgctcgtgggctcgccccaggacagctccacctcgagcgtgaacacgtactttgagttcgagggcacaccggtccagctcgtactgtacaacggcgcgatcatcattcccgagaacctggcggacggctgggacgtccttgcctacaccatgggtgcgggctcgatgagcacgcaggtgaccgactcgaacggcaacgccgtcacggggagcgggcagatcaccgacgtcaagctcgacggctccaacctcctgatcacggacagcacgggacagacgacgaccattgccctgggctgacgggccataaaaccggtacgtcttcggcggcccctccggcatcggaggggccgccatcgtatggaggactcgtgaagggaaagaaatcaaaattccccctagacaaggcttccgccttccgtgtattattactcccgcactgatgcacggggtattagctcagctggttagagcgccggcctgtcacgtcggaggtcgcgggttcaagtcccgcatatcccgccatagaatgcacggagcctcggttcgccggggctcttttcttatatctgggcaccatgcccgtgtgctgaatcgaaattgcgacaaatggcataatattaggagtaatggcatccgtggcaacgcgcattgcggaggcgaggtgtggtgggccaacaagacgggagcgacctcggcagggcgagacttgccgtgttcgacctagacggcacatccatcaacgggcagagcggcatcctcttctgtcgctacctctttgagagcgggctcatctcgccctcgcgggcgctgcgccttggctggtggggcgcccggtacgcccttcacctgccccagcggcaggcggagtcgagggagctcatctttgacgcgctcgccggtgaggggcaggacgaggtcgcccgcaggatgggcgagttccacgaccggtacatcctgccgcgctaccgcgccgatgccatcgcggaggttgccaggcgcagggggcagggttgcgtcacgctcctggtctcggcgaccttcgagggcatagcgacgcttgccgccgcccacctaggagtggacggcctggtggcgacaaggatgaggcgcgacggcgaaggcaacttcaccggcgaggtcgatggccaggtggtggcaggccgcggaaagaccgagggcgtcgccgcctgggcggacgagcacctggggcagggccgctggtacgtccaggcggcgtacggcgaccacctgtcggactgcttcctcctggggtcagccgtcgaggcgtttgccgtgtgcccagacccaaccctgaggctcgaggcccacaggcgcggctggacggtgctcgactggaggtaggccctcgggccgttgggtttcgagtgggaggcgtggaggccgtctccccgaaggcatgggaatggcatggacatctctcgcaagacagactacgcgctgcgcatgctcgccgagctcatccgtgcggacgggaacatcgtctcggtgcgcgtcgcggcggacaggaacaggatcccctactcgtttgccaggtcgatccagcacgacctcgtccgtgcggggctggtggagagcacccgcgggtccaggggtggcatgaggcttgcggcggaccccaggcaggtgacgctccgggaggtcgtcgaggccatccagggacccatctacgtgtctggctgtgcgaccgcgggcgacgacggcggcccgtgtccctacatgccccagtgccactacaaccccatctggtgcgaggcggagcgcatgctcagggactactttggctcggtcacgctgtaccaggtcgtgatcgaggacaagcatcccgttatgagcggtgggcaccgctttgacgtcgtgagccgaggcggcaaggccgacgggcagggggagtagggtgtccgacctgcccgcaacccccttcgacgagcttgcgccgttcagggagaaggtcctctcccgtggccgcgagctctaccgcgacctcccctggcgccgcacgcgcgacccctattccatctgggtctccgaggtgatgctccagcagacccaggtcgcccgcgtcgacggcaggcggcagcggtggctggcgaggtttcccgacgtccgctcgctcgcggacgcacagaccgccgacgtgctggaggagtggcagggcatgggatacaaccgtcgcgcgctctcgctgcgcagcgccgcccaggccgtatgcgacggtgggggagagatgccccgcgagtacggggacctcgtcgcgctgcctggcatcggcccggcgacggcggcgggcatacgggccttcgcgtacgacctcccaggcgtgtacctcgagaccaacgtgcgcgccgtctttctgcacgagctctttcccgaccgggagggcgtgggggaccgcgagctcgagcccctggtgcggcagtgctgccccccaggggacggcgacccgtcggatgaccccaggacctggtactacgcccttctcgactacggtgcgtacctcaagcggacgttgcccaatccctcgcgtcgctccaaggggcacgtcaggcagtcgaggttcgagggctcccaccgccagaagcgcgcggcgctcgtccgcctgctcctctcccatagcgagggtgtggattccgggacgcttgcgtgcgagctctcggcagaggaggtcaaagcgggtaggaatgagctaggcggcggggaggtcgaggcaatccttcgcgagcttgcgggggagggtttttgccatcaacaaggtggcatttggcttccctaggtgctactatgggcctgccgccaacggcacgcttgctgcaagtggcgcccgcaggaaaaggggcctgcgggcaaacgagagaggagcttttcatggcagtcgacttcgagaactcgcagaccaagaagaaccttgaggcggcatttgccggtgagtctcaggcaaccaacaagtactcctactatgcgagcaaggccaagaaggagggctacgtccagatctcgaacatcttcaccgagacctccggcaacgagcgcgagcacgccaagctctggtttaagtacctgcacgacggcgacgtccccgataccctgaccaacctcaaggacgccgcggccggcgagaactacgagtggaccgatatgtacaagggcttcgccgagaccgccgatgccgagggcttcaaggagatcgccgcaaagttccgcctggtcggcgaggtcgagaagcaccacgaggagcgttacaacaagctcgtcgagcgcgttgagaagggcgaggtcttcaaccgtccgggcgtcaaggtctggaagtgcaccaactgcggccacctgcacgttggtcccgaggctcccaaggtctgccccgtctgcaaccacccgcagagctacttcgaggagcaggcgatcaactactagcccgctgccatgggaatcttgggccccgacgtaagtcggggcccttttttgtgcctcaactcccaaacatatatgtgaaaccgataactggatagggcaagtccgcatatcgatgagactgttatcgcctccgtaaagcggtactatgcaggtcatggaaatgacggagacatacaacgagctatcgggacggcagatgccgtagcccgagcacggaggaagaaaacgcctccgactcgggcgccccagagaacgctcaccctaccaagaccaagatcaccgaacaggcacaaaggagaacaccatggcattcgagctcaatcccgacttcgctaaggaccccgagaagcacttcaacaccctgcaggttcacgccggctgggcacccgatcccaccaccggctccgcggcgctgcccgtctacgcctccgccgccttcgagttcaaggacgccgaggacggtgccgccaagtttgcgctcagccgccccggcaacgtgtacggccgactgaccaacaccaccaccgatgccgtcgcggcccgcatcgccgccgtcgagggaggcacgggtgccgtcgccgtcgcctccggccacgcggcagagatcctcgccctcaccaacctggtcggcgcgggcgacgagatcgtcgcatccgactccctgtacggtggcacctggaacatcttcctgcacaccctcggcgacctgggcgtcaagaccaccttcgtcgagaacaacgacatcgacgcctttgttgctgccaccacgcccaagaccaagctctggtacgtcgagaccatcggcaaccccctcgtcgacgttgctgacgtcccggcgatcgtcgaggcggccaactccctgccgtcccccgtccccgtgttcgtggacaacacctttgcgaccccgtacctgtatcgcccggcagaggatggcgcggcagtcgtgatcgagtctctcaccaagtggatcggcggccacggcgcgaccctgggcggcgccgtcatcgacacgggcaagtttgactggaagcaggatcccgagaagtggtccacgctcgccaagcccgacccctcctaccatggcctggtcttcgctgatgccgcccccgcggcgcccttcgccacccgcgtcctggcaaacaagctgcgtgactttggcccgaccctctcgccctatgcggcgcagctcatcggccttggcatcgaggacctctcgctccgcgtccagcgccactccgacaacgcgcttgccgtcgccaagtacctccaggacaaccccaaggtcagctgggtccgttactccggccttgagggagacccctcgcacgaggtcgcgtcgcgcatcctcaggcacgggtttggcggcgtggtcgtcttcggcgtgaagggtggtcgcgaggccggtctcaacgtcgtcaacaacgtcaagctgttcacccacctcgctaacgtgggcgacgccaagtccctcatcatccaccccgcctccaccacccactcacagctgacccccgagcagctgaaggccgcgcacctctccgaggacctcatccgcctctccatcggcatcgaggacgtggacgacatcatcgccgacctcgaccaggccctggccaaggcgtaggcaacacgtcacaagagcgactcgcccatgggggcgtccgaagggattcgggcgccccttcctcgtgtctgggcaccctttgcaacggcaaaggtcaattatcaggtgccgctcaggaactaaatatttcaaaggtgttacaaggtcggcttcagttaaatcggcccatttatgaaaatgtcaaatgaacaatcccagtgtcatttgattgcttatgcaaatgggaaaagctccgtcccccgaaacgaaaaaagccaaactttcgtttaagtcactattcagatgtggaaagttctatctctgattggtgaaaggacgaggagcacatggcaaagaggtggacgctgagggtactggacgccaagtcggcgcaccgggcatggtccaagcggcggatgttggtcgtgattgcggcagccgcgattgcggcgagcgtcgccgcccccgcggtcgcccgcgcggaggaggcgcaggcactgccggcggagcagcccgcgatcgaggtggcggagcaggtcgcaccggcaccagaggcggttgcccaggaggcacccgcagaggagccctcggcgcctgctgacgtgacgcccactgagggggcccaggatcccgccgaaccggcacagggtgaggccagcgcagagaagcccacagacgaggggcaggccgaggagacccccgcggcgggggaggcggggcagcccgccgagggtgcggctgcctccgaggagccccaggaggaggctccctcccaacccgcgcagggctcgggggccacggaagcccaggtcgacgtcacccagggcgagacgccccagcaggcggctgacgcccagctcgacggcatcgagttcacgcgtacggacgagggctatgaccagaccacggcgcccaagatctcgatgaccgagaagagggacttccaggttaccgttggtgttgacggcgtggacgtggatacgctgcagaggatgatcgacgagggctcggtgaagttctccctctcgcgcgacaagggcgccttcgaccccaaggtctatcccaagcagtgcctggggggcaacctcgaggactggatgaccgtcgcggcggtcgacaagaggaagggggtcgacgcaccgtccatcccgttcttcagcaacgtgctcatgaaggcggagctggttgacggaaagtcgagcatcgtcctcaggtttagcaacgagctgctgtttggcgtcaatggcatcgacgtccgcgcgcgttccctggtccgctcggcgatgtacgactacgtgggcacctacaagctcgcctgtgcgctcgcgaacggccagaccgtctcgacggacgtggagctcaggccctacgacgagttccacacccaggaggagatagacgccgccctgcccaagtttgtggaggaggccctgaagaacggcatttatgccaaggtcgagacctttggcaagtccgccgagggccgcgacatgaaggcgattttcgtcgctgggagcgagagcgacctcgccgactaccagaacctcaagaagctcatggagagcaaccccgccgcagtccaggagcagctcaagagcggtaagctgcagtacaaggtgcccatcttctacagcaacgtccacgcggacgaggtcgttgccgtcgacgccgtcatgcagtttatccgcgacctcgtggagtgcgtgcccattgactacacccgcatcaccgggtacaccgaggcgggcaaggaggagctcaagaaggagatggaggcggatggcaccgtctggtccggcctcttcaaggatgaggttacgggcattggctacatccgcggcaacggcgggaacggcaacggggtcgagtttggtgacaacaggagcaagggcgggctcaacgacgcctcggcggacctctcggatgccgacttcgacaagtactacaccagcgtgcgcgagacctttgaccccaaggagatcctgaagcacgtcttcttcatcctcgtgccgagcgagaacgtggacgcccgcacggacaacgtgcgcaccaacgggaacggcttcgacctcaacagggacaacacctatcagacccagcccgagacccaggcgatgtcagggctcatctccaagtgggatcccatctcgctccacgaggtccatgggtactaccagcagttccagattgagccctgctcccctgcccacgaccccaacaacgagtatgacctgttcattgacactgccttgaagcagggcgagtactttgcgagcaccgcactcgccaacaccaagacaatcaactctgcgcagattcccatccgcgactacctcaagaagcaggatgacgggtcggtcgcctgggatgcgcccttcgacgacatgtccacgagctacacgccccagtatgcgatgatgcacggcaccaacgcgtacacggtcgaggtgccggtgggcaacagcgatgccctgcatgccctggagtacggcttcatcggcaacgcgcagttcgtgatcaacaacaaggaccgcatgttctggaacatgctcgagcggttccgcaggggagtggagaacatcgactcgcctgacatccgcaagtactacgtcaaccagaaggacgaggctggcgccgaggccgacatcttcaggccgcagaacaacgagaaccacaacttcttccccgagtactacgtcatccccatggatgccctctcgcagcaggatcgcgccgctgccgccgagaccgtcgacttcctcctccacaacggtgtgagggtctctcgccttacgcatgacgtcacggttggcggcaagacctacaaggccggcaccatcgtggtcgacatgcaccaggcaaagaggaacatggccaactgtgccctgtatcccaacctcttgatcagcgactggacccagtactccctctatagtgagccgctcaccaacttctccgcgctgcgaggctatgacatggacaccatccgcaagaagggtgccttcgccaaggagttcctggagaacgtcaccgcagcccccgatcccaagacctacgtccaggggtctggcccggtcacgatcatccgcaacgacagcctccagtccatcagggcggtcaacgacctcctcaagcagggaaagaaggtcggcctcatcagggagggcagccacgagggaagctacgtggtctccacggaggacttcaacctggtgaaggacaagtacgtcctctatgccatccaggggaaggcgacgcccaaggcaagtaccatccgcaacgacctcaaggtgtacgtccccaaggcgtacgcggagtttgtcacggacgccgatggcaaccaggtgggcatgagcgggtacaacaaccgcctcaacaccaacggcaactgggacttcttcgcactggcgaagcagatgggcttcacgctgaccgacaacctggacgaggccacgattatcgtgggcagccagtacccgtcgtcggatgtagccgaggagattgccaagaagatcgcagaaggcgtcccctacatcggttacacctccgacgccctgcagtttgtgaaggacgccgggcttgccgacatcagcttcacgggcgaggactgggactggatggggtacgacgcgcttgacaccgtcgtgttccccgaggatgacatcatcacggctacctatcgcatcgagggcgaccgcatcatgtatggctacggcggaagctacttcgtcagcatcccgaagggtgcgaaggtgctcataaggaccaccgacgaccagcccatcgagggcttcatgaccgcggagttcctcgagaagtacaagggccagatccaggcgatcagcatcctcgatggcaaggccgacatggtcctcttcgcaaacaccctcaccaacaaggcacaccagcaggacgactaccgctacctcacggcatctgtctacagccgctccctcgcgggtgactacggcaccattcccgtgccggacgagcccgagaagcctgcggagcccggcaacgcaggaagtgcggtcaagccgaacgacaactgggttcccagcgcgcccgctcccgaggaccgcgtggagctcaatcgcgagggcggcgtgggcctccgcaccgcagcccagcatcagcgcgacgccgtcctcccgcagaccggcgactccagcctgtcaggctccggacttgcggcgatgggcatcgtccttctcgcctccggtggcgcgattgccttttcgcgtcgtcaggagcacgaggagtagcccgaaaaaaagatccttgctttgagttgggcgggggcccggaggttccctggtccccgccccatgtggttggcgcattcgtttgacggtatgggaggaagcatgggacagaagtggaccctcaaggtgctcgatgccaagtcggcacatcgagcctggtcgaagaggaggacgctcgtcgcaatcgtcgccgcggcaatcgccgcgagtgtcgccgctccggctgtcgcccgcgcggaggaggcgcaggcgctgccggccgagcagcctgcgatcgaggtggtggcacaagccggccctgctccggaggcagcgtccgagcagccagcggaggcgattgcccaggaggctcccatgggggagctcgcggcacctgttgacgtgacacccgccgagggagcccagggtcccgtcgaggtagcgcagggcgaggccagcgcggagacgcccgcaggcgtggggcaggccgaggaggcccccgcggcgggggaggcaggccagcccggcgcgggtgcggccgcggaggaggagccccaggaggcggctccctcccagcccgcacagggctcgggggcgacgggtgccgatgccgacgccacccagggcgagacgcccctctcgccctcggacccctctgctgccgaagaccccgagggtcagtccctggaggaggccaccgcggggaaggaggcggactcccttggcacaaagatcgtgtttgacttcaacggggacgggaagactgacgcgcaggattggaaggactacctcaagtggatggccgactacaaggcctttgactttgacctggagacgggcgacttgggagactcccacaacggtgggattcagattaccggggcaacccagataatcgccaacggccacgggaagcgccttgactcgatcgacaccaacctcgacgtcgcgaagatcacgcagtactacctcaacaacgtcggccttgccacgtctgtgaagaaccagagcccttggggaacctgttggtccttcgcgtccatctcggcgttggagagcgccatcctgaaggcacagaccggcgccaccccggtcgtgaaccccgacgaccacatgaagccgatcctctcggggctcgatgacaagggggtggacctgtccgagctctacctggcatggatggcctacgacctgcagtccatggggtcccagaagggcgagggcatcatcgacgtcctgccctgcgacaccaacctctccgaccggctcaactgtggtggctgggcaacgatggcggagacgctctttggctcctggcagggcatggcgaccgaggcggagcaggcgtactggccgcagggggttcccaagacctacgaggagttcaagaagaagtacgaccacatgggcgagtggaacgtctcgaaggacaacggtgccccctcggcgcacgtcgacggaatctactacctccccgatcccaacgtgctcgcgatggacaagagggaccacatcgtctggcagggctttgacgccacggccaacgacctcatcaagcaggcgatcctcaagtacggggcggtccagatcggctacggcgcagacacgtcgcgcgaccccggaaagagcaacggagactacttcaactacgactcctgggcgcagtactgcgacgccaccaacatcgagatcacccacgcggtcaccatcgttggctgggacgacaactttgacccaagcaacttccgcgctggcaagaatgacatcagcaagctcaagcccggggcgtggctgatcaagaacagctggggctctgcggagtggtacatgaagaacttcgggctgagcgaggacgaggttcgggcaaagcaccttggctgggggctccccgatccggagacgggactgccgacgggctacttctggctctcgtactacgaccactccatcaattcgccgtcgttcttcagcgtgaacctccccaaggacggcaagttcaagtacgacaacaactactcctacgaccacctcatcaacgagtcgcagtcgccgttcgtgttcaagacggcggatggcggcacctgggtctcgaacgtgttcaaggccaagggtgacgagatcctgaaggcggtctcggtgcacacgagtcagccgcagtcgcatgcaaagatactcgtctacctggtgaacgaggatggtcttagggacaacgaccccacgaatgacggcggccccgtcctctccatggactacgatgccctgattgccgggatgcacacggtggacctcatcaagcccatccaactcaaggccgggcagctcttcgccatcgtggagaacatcacctgtctggacggcacccccggcgccccagatggcgtgagctccctcatcaacctcgagaccgggatggctcagaaggcgcagttcccgtatcccgacgacctcgagagcaagggtcgtgccatggggtacctctggaccaccgtcaaggccaacccgggagagacgttcatcaagatcctcacgaaggccgggtaccgctggattacccctcagcagctgtcggaggcattctttggcggcaacgtctttgagtttggcaatgccctggtgaaggcgttcacctgcaacggcctccttcccgttcccgctgacggcgccgaggaggagcctgccatcgttgcccatgtcgaaggggcgtcgggcaagacgtccgtagagggtgccgagcccgtggaggttgcgaagacggcctccgtccgctcggcgagcggtagtgaagccgcgctgccgcagacgggggacgccacctcaaacgcccccattgcgcttggggcccttgccgccgcgctcctctcggcgggctacctggtccgtcgtcgcggccaggagtagcgagctcgggcgagacgggcatccataccgccgcaatgcggcatgagcgaggcggggcgagagggccaggttcctctcgccccgcccttgccgctggtgcggtcagtccgcctggccctcggggtgatccgaatgcgcctggtcgaaggtgaccgccttctgccggcagcgccgacgtgtctcctcgtcgcgcgggtgcagtgccacgaagtgcgcgaacccctccacggaccagtcgtcccagccctcggtcgggccgagcgcgttgaagatgcacgagggtatctcgcccagcgcgatgttcttttggatgcagcgatcgcagccacggccagcggcgaggttcttggggttgttgggattgagggggcagtcgtggtcggtgcatgtgcagaagtgggacatcctacctgtcctttcgcttgtccgcgcccgtccgccttggcttgcgcgcgtttggcttgccgtttgccttgaatgcgctggggcagatgtcgacgagccggcaggtgtcgcacttggggcgttgggaggtgcacacctcccgcccaaagtggatccactgctcgttgaccggtccccatagctcgcgcggcagaaccttgagcagttgcggctcggcctgcgcgggcgttggggcgctcacaagcttgagcctgctcgcgatgcggtacacgtgggtgtccacggcgatgccgtcgacgaccccaaaggccttgttgaggacgatgttggcggtctttctccccacacccgggagggtgacgagctcctccatggttcctggcacctcgcccccaaagtccgagacgatgacctgcgcgcactcgacgcagtggcgcgccttggtgtggaagaagccgagcgggtggatgacctcctcgacctcgctcacgtttgcggcggccatggactcggggtctggccagcggcgaaacagctcgggggtgaccttgttcacggcggcgtccgtggtctgggcggacaggaggacgcagatcacgagggtgaacgggctgtcaaagtgcagggcgctcttaacgtcgggatacatctcctgcatccggcggcagacctctatgccacgctcgcgctttgacttgagtgactcccttggcatgggccctcccgggtcgagcgaagtttcggacatcccgaaaggcaggtgccgcgcgggggctgcccgtgggatgcatctcatcgagaacggcgaaccgtctgtcgaacgcaggcggccctgccatgtgcctgcaatagtatatggttgctttgtgaagttttcactcgcgttcaaaaccagatgccccggcgcctggtgccagaggtgggaggaagagcatggctgtaagcgactccgagctgtcactcacaaaggatgacctgtatctcatgggacaggggtcctggtaccgcagctacgagaagatgggcgcacatcctgccacccgcgatggggtggacggctaccacttctccgtctgggccccggacgtcaggagcgtcagggttatcggcgacttcaacgactgggacatcgaggcgaacttcctggaccacacccccacgggcggggtgtgggagggcttcatccccggggtcaccgaggggcagctctacaagtatgtgatagagaccggccgcggggatctgctctacaaggcggatccttatgcgttctacgccgagtgccctccgggaaccgcctccaggaccacgagccttgacggctacaagtggggcgactccaagtacctcaaggcccgcgcctcccgtgacatgatgaagagcccgctcaacatcttcgaggtccacctgggcagctggaagcgtcacgatgacgaccttgcgggcaacggcgaccccgactccgacgagcacagcggcagctacctcacctacgacgagctctcggagcagctcgtggactacgtcaaggagatgggttactcgcacatcgaggtgctccccgtgatggagcacccgtttgacggctcgtggggctaccaggttaccgggtactacgcccccacctcgcgctacggcaaccccaagcagttcatgcactttgtcgacgcctgccaccaggccggcattggcgtgatcctggactgggtcccggggggattctgccgcgacgagcacggcctggttcacttcaacggcggaaagctctacgagaaggaggagcatcccaactggggaaccttcaagtttgacctgggcaggcgagaggtccagaccttcctggtgagcaacctgctctactgggtgggcgtgtatcacgccgacggcgtccgcatggacggcgtcacgagcatgctctacctcaactttggcgtggacgaccccagccagaagaagttcaacgagaaggggaccgaggaggacctggtcgccatcaagtttgtgcaggcgtgcaacgaggcagttgagaagtactaccccgacgtgatgatgatcgccgaggagtccaccgcctggccgctcgtgacgtacccgcccaaggatggcggcctgggcttccacttcaagtgggacatgggctggatgaacgacacgctgcactacatgcagaccgacttcccgttccgcccgggcaaccaccggctcctcacgttctcgaccatgtaccagttcaacgagaactttgtccttcccctctcgcacgacgaggtcgttcacggcaagtgctcgctcatcacccgccagccgggcgactactggcgccagtttgcgggcatgcgctcgctcgcgctgtaccagatgacgcactccggcggcaagctcaacttcatgggcaacgagatagcccagttcatcgagtggcgctactacgagggcatccagtacttcctcaccgagcagtacgagagccatgcccacttccagcactacgtggcggcactcaaccacttctacaacgagcatcccgccctgtggcagaactcttacaccaacgagggctttgagtggatagacgccgacaacagcgagcagtcggtcatctcgttcgtgcgcaagggggacgaccccaaggacaccctcgtggtcctcatcaactttgacgtcaacccgcacgaggacttccgcgtgggggtccccatgagcggctattgggtcgaggcgttcaactccgacagccaggagtttggcggctcgggcgtcaccaacggagaccatcgcttcgcctcgcaggagaccccctggaacatgcgcgacaactcggttgagctcaggctcccaccgcttgccgggctgatgctgcgctacgacgggcctctccccgccaagaagaagcctgccaccacggccaagcctaaggccgccaaggcttcgaaggcctcgaagggcgcgacgggcaagccagccaccgagagggccgccaagccggcgtcggcaaagggctcctcctcccgtggtgccaagcgcgcctcgtccgccaaaccttcggtgacgggcacggcaccggccaaggggaagactcccgcaagcgccgccaagtcctctcgaaggggcgcaaagcctggtgcgacggggaggggaaagagctaacaccgaccccatggattttgacgtaacctcttttggtgcgtggggtcgcacggcctttcgccacgtcggactagcgaaatgaggcatgcatatgacagccaagaacaataggatcttccagagcaaggaggatttcctctcccagtaccgcgacgcgtgcgagacgtttgtgggcaagggcttcgaggagctcaacgaccaggagcgctactacgtcctcgcgtcgctcgtggcgagcaaggcaaagaacgtgcgggcggcggcccgtcccgagggcaaggaggtctactacttctccctcgagttcctgatcggcccgctcctggacaactacctcctcaactttggcgtccgcgacatcgtcgaggagggctgcagcgacctggggacctccctcgaccggctgctctctcaggaggtggaccctggcctgggcaacggtggcctcggtcgtctcgccgcctgcttcatggactccatggccgcgctgggaatcaacggcaacggcaacggcatgcgctaccgctacggcctgttcaagcaggtcatcgaggacggccgtcagatcgagaggatggacaactggctcgagcacggcttcccctgggagacgcgcaagaacgagtcggccgtcatcgtccagtttggcggcaacgtcgtgcgccacgaggagaacggccgctactggttcacccaggagggcggcgacctggtgaaggccgtcccgtacgacgtgcccatcgttgggtacggcggaaagaccgtcaacaacctgcgcctgtggagcgccgagcccgccgaggagaactttgacctcgacgcgttcaacgcgggcgactacgccaaggccatgaagttccgctccgacgtagaggcgatctcgcagatcttgtatcccaacgactcgggcgagcacggtcgcatcctacgcctgaagcaggagtacctgttcgtctccgccggcctgcagaccatcctgcgcgcgtacgagaagaagtttggccccaagtgggaggaccttggcaagcacgtcgccatccacaccaacgacactcatcccgccatgtgcggacccgagctcatgcgcatcctggtcgacgacaagggcgtcgacttcgacctcgccttcaagatcgcccaggagaccatcagctacaccaaccacaccgtgatgcccgaggccctggagaagtggcccatcaacaccttccgcgcccttctcccgcgcacctacatgttcattgaggagatcgaccgccgctaccgcgagagcttcccccatgaccgcgacaactggcaggaccttctcgcccagaccgcgatcctgtgggacggccaggtcaggatggccaacctctcggtcatcttctcccactccgtcaacggcgtctcggcgctgcacacgggcatcctcgaggcagagaccctgcacggcttctacgagctcacgcccgagaagttcaacaacaagaccaacggcatcagccaccgtcgcttcctgggcaacgcaaacccgtcgtacgcgcggctcatcagcaacaccatcggcgaggggtggctgtccgacgccaacgagctcaagaagctcgagccctacgccgacgacgcgtcgttcctggaggagttcgagaaggccaagctcgagaacaagcgtcgcctcgccaagtacatcgcggacaccacgggggtcgagctggacacctcgatggtcttcgacgttcaggtgaagcgcttccacgcctacaagaggcagctcctcaacgtgttcaagatcctcgacctgtacaaccgcatcatctctgactcctcgttccagcccaggcccaccgcgttcgtgttctcgggcaaggcggcgcagagctacaccttcgccaaggaggtcatccgcctcatcaactcggtggccgaggtcgtgaacagcgacgcccgcgtcaacgacaagatcagggtcgccttcgtccccaacttcgccgtctcgagcgcgcagctcatctaccccgcagccgagatctccgagcagatcagctgggcgggctccgaggcgtccggcacctccaacatgaagctcatgatgaacggcgcgatcacgctggggacctacgacggagccaacgtcgagatctgcaagctcgtgggtgacgacaacatcaagatcttcggcctgcgcaccgaggaggtcgagaacctgcgtgcgagtggcaagtactgggcatgggacgcctacaacgccgaccgcccgcgcctcggtcgcatcgtggacgagctcaccgacggcaccctcgcgcacctctcgggcaacttcgagagcatccgcgacgagctcatggtcaacaacgaccacgacctggtgctcaaggacttctactcgtacgtgagcgcatgggaggagctcaccgcctcctacgccgaccgcaaggcctggaaccgttcggcggtcctcaacactgctcggtcgggatatttctccagtgaccgaaccattcgcgagtacgccaacgacatttggcatattggagattagaagagttttttggacgaaaggggttcctcatgagcaagaaggaatgcattgcgatgcttcttgccggtggccagggaagcaggctcggcgttctcacgcgcgacatcgccaagcccgcggtgtccttcggcgcaaagtaccgcatcatcgactttgccctctccaactgtgccaactccggtgttgacacggtgggcgtcctcacccagtacaggccgtacctgcttcactcctacatcggcagcggcgcggcgtggaacctggacgagggtgacggcggggtctcgatcctgcctccgtacgccacgcagactggcggcgcatggtacgcgggaacggcggacgcggtcacgcagaacatcggcttcatcgagcagaacgaccccgactacgtcctgatcctctctggcgaccagctgtatcgcatggactaccagaagatgctcgagaaccacaagcgccacaacgccgacctcaccgtcgccgtcatgccggtgccctgggaggaggcgtcgcgcttcggcatcatcacgcaggacgacgacgagcgcatcctcaagttcacggagaagcccaacaagcccgacagcaacctcgcctctatgggcatctacatcttcaacgccaagctgctggtcgacaccctcagggaggacgccatcgaccagacgtccgagcacgacttcggcaagaacatcatccccaagctccttgccgacggcaagcgcctgtacacctacgagttccagggcttctggcgcgacgtcggcaccatcgccagctaccacgagacgagcatggacctgcttggcatgcaacccgacttcgacctgtacgacgccgagaaccccatcatgagcaacgccggagccaagccgcccgcgtacgtgggccccaacggggcgattgacgactgcctggtgggcaacggcgcgcagatctttggcagcgtcaggcactccatcgtctccacctccgcctacgtgggcgagagggccgtggtcgaggattccgtcctcctgcccggcgcaacggtgaaggatggcgcgcacgtggtgcgcgcgattctcggtgagaacagcgtggtcgaggacaacgtggtccttggcagcgttgaccagacgaaggacaccgcggtcattggcaacgacgtggtggtcggaaagggggaggagtaacgatggagaagctcatcggcctcgtcactgccaactactccactaagtatccgagcgccctctccgagacgcgccccgtggcctccgtcccatacctgggccgctaccgcgtggttgacttcgcgctctccaacatggccaacgcgggcatccgcaccgtcggcctgatcatgccctacaactaccggtcgctcatcgaccacgtggggtccgggcgcgactggaacctcgcccgaaagaagggcggcctcttcatcctccccggctccgccttcggcacgtcccgcacgggttcgcgcttcctgctccgcgacctcgagcacaacaaggtctacctcaagcgcagcacggccgacctggtcatcctcagctccgcgagcttcgtgtacaacatggactacaaccagctcgccgccgcccacagccagagtggcgccgacatcaccgtcgtgaccaagagtgccaccgagaaggacgtggacgtcaccgggttcgtggtcgaagacggcagggtgcacggcatccgccatggcgtggcctttggcgacgaggcgtttctcgactgcttcgtggtcaggcgcgagttcctcctcagcctcctcgactggtacgagcagaacgactacctcgacctcttcgaggccctgtcgggcgactacggccgcgtggacgtgcgcacctatcgctttgacggctatgccgagcccatcttcaacaaggacgcgtacttccgctccaacatgcagatgctcgaccccaagatcttggcggagctcttccccgcggggaggccgatcatgaccaaggcgcacgacaacgcgcccgccaagttcgagtccggttcgcacgtgagcaactccgccgtgagcggcagctgccgcatctatggcacggtcaccaactccatcctcggccgcagcgtcgtggtggagagcggcgccacggtcaacaactccatcgtgatgcagtcctgcgtcatcaagagcggcgcccgcgtggagaacgccatcgtcgatcgcaacaacgtggtccccgccggcaccgagctccgcgggacgcccgatgacctgttcatcaaggagaaggccgcggactagggaagcgatatgtcttatagggaaagcaggaagatgagggtgctcttcgcggcgtcggaggcggtcccgtttgtcaagacgggcggcctgggcgacgtcgcggggtccctcccgcgcgccctcaacgcggcaggcgcggacgtatcggtgatcctgcccaagtacggcagcatcccgcaggagtaccaggaccagatgaggcacgtgacggagttctacgtgcccctcgcctggcgcaatgtgtactgcgggatcgagaagctcacctacaagggtgtcacgttctacttcgtggacaacgaggcgtacttcaagcgtgacggcatctatggctacttcgacgacggggagcgctacgcgttcttctccaaggcaatctgcgaggcgattcagaacgtccccgagctccaggtggacgtgctccagtgcaacgactggcagaccgcgatggcccccgtgttcctccgggagttctatcagggctcgtgggcgtgccgcaacgtgaagaccatcttcaccgtgcacaacgtcaagttccaggggcagttctccgacaaggtgctgcaggacatcctcggccttgccgacaaccccacggcagccagccaactctacgtggaccgcgactccatcaactacatgaagggcgcgctcctgtactccgacctcatcaccacggtgagccccagctatgccagcgagctgcagatgccgttctatggcgaggggatggacgccatcttccgccgccgctccaacgccctgcgcggcatcctcaacggcatcgacgtggacacctggaaccctgcgacggacccgctcatctcgcatcgctacgcggtggacgacatgggtcccaaggcgcaggacaaggcggagctccagcgcgagctcggccttgcggaggatcccacgcgcccgctggtggtcatgatcggccgcctcaccaaccagaagggcctcggcctggtccgctatgccatgaaccgactcatggaccgcggcgtccaggttgccatcctgggaacgggcgacaaggaccaggaggacgccttcaagtactttgactggacgtacggcgacaggatggcggcgaggattgcgttcgacaacgccctgagccatcgcatgtacgctggcggcgacatcctcctgatgccgtccgagttcgagccttgcggcctctcgcagatgatcgccatgcgctatggcacgcttcccgtggtgcgcgagaccggcggcctgcaggacagcgtggtcccgtacaacaagttcacgggcgagggcacgggcttccgcttcgccaacatgaacgcggacgagatggcggactgcctgcttggtgcatgcgaggtcttctggaccgaccacgacgcatgggctaagctacagcgtcaggcaatggaggcggacttcagctgggacagggccgccgacgagtaccttggcatctatcacgaccttcatccagagattgaccgataagagcagaagaggcaggcggcccgcttgaaagctaggcacatcacctccgacgcgcgttaccggacccccttcggcgccgcccccgcgggcggcgccgtcgtgctgtccatcgacgtgtgggacgagccggaggcaacagcgcaactgcgcatatggatcgacgagcgcggggagatccttcttcccatgacgggggagcgggaggacgaccacctgcacttctccgcacgctttgagccaagcgagccggaggtgatttggtactcgttcctcatcaccgccgccgacggcgcggtgtggcgctacggtgccgcctgcgagcacggctgcggcgagggcgcgtttgcctacggcgagcccccctcgttccagatcacggtgtaccagcgccagcgcacggtgatgcccgactggttcaagggtggcgtcgcctaccagatcttcccggaccgctttgcacgcggggacgactgggagggccgcgttcacgatgcgctcgacgcccctcgcaaggggcccgaccgcgtcctggtcgatgactgggaccgctacccccgctacgaccgtaaccccgacggctcggtgcgcagctgggacttctatggcggcacgctggagggcgtgcgggagaagctcccctacctccagggcatgggcgtcacggtgatttacctcaaccccatcttcgaggcagcctccaaccaccgctatgacaccgccgacttcctgagggtcgaccccatgctgggcgacgaggagtcgttctcccgcctgtgccgcgacgcgggggagaggggcatctccatcatcctcgacggcgtgttcaaccattgcgggcgagactcccgctactttgacttctttggcaactacggtggcgagggagcctaccagagcccccactcccgctatcgcagctggttcaagttcaacgacgacggcacctaccagagctggtggggcgtgggcgacctgcccgacttcaaccaggacaaccccgagtaccgcgagctcatctgcggtcacgacggcgtcatccgcaagtggctgcgccttggcgcccgtgggtggcggctcgacgtggcggacgagctgtccgacgacttcatcgccgacatcaagagtgccgccctggcggagaggcccgacgcccttctcatcggcgaggtgtgggaggacgcctccaacaagctcgcctacggcaagctgcgcaagtacttccagggggcggagctcgactcgaccatgaactaccctctgcgccacgccctggaggactttctcaccaacaaggcgggcgcgccggagtttgtgtccacgctccgctcgctccaggagaactacccgcgcgagaacttctactccacgctcaacatgctgggcagtcacgatcgcatccgcttgctcacgatcctgggagacgcgccggcgcaggcgcagatgagcgacgacgagaagtaccgcttccgcctggatgaggggcatcgctcgctcgcgataagccgcctgtggtgcgcggcgctcctgcagatgacgctgcccggcgtcccctgcgtctactacggggacgaggccggcctggaggggtactccgacccgtactgccgcgccaccttcccctgggggcacgaggacgcggactgcaagaccatctatcgcaacgccatcgctatccgcaagtcgctcccggtgttcgtggatggagacttcgagcccttcgccatcggcgacgacgtgtttgggttctggcgccgcgacgacgagagctcggtgtgcgtcctcgtcaacgcgagcctcaagaagtcccacaccgtgaccgtccccgcagcgggcccctgcgtggacgacgtcgtgaccggcaacgtgccggaggtgggggacggcggcgcccaggtgttcctctggccgctcgggacctccgtgctgtactttcacgaggagcagcgccttcagcagtccatgccccacggcatgggcgtcctcgcccacatcacctccgtccccaacccggacaagccgggcaggcacggcaccctgggcgagcccacccgcaggttcatcgactacctcgcggcgggtaagcagtgctactggcaggtgcttcccgccaacccgaccgactcgtttggctcgccgtacgcgggtctctccgcctttgccggcaaccgagagctcatgtggggcatcgaggacggtcgcacctcgttcagggccgactttgaggagacacccagcttccgtcgcttcatggagaagaacgagcgctggctgatgccgtacgccacgttcctcgccatacgcaagcaggagggtggcatcccctggcaggagtggccaaagcgttatcgcgagtggtcgcccaagcttgccacgagggaggagctgaggagcgaggtccgtcgtgtctgcgccacgcaatacgagttccagcgccagtgggacgagatgcgacactatgccaacgagcgtggcatccagctcataggcgacatgcccatgtacgtctcggctgactccgccgacgtgtgggccgagcgcgagatcttcgagcttggcccggacggcacgcccgccctccgagccggctgcccacccgacagcttctcggccgacggccagctgtggggcaacccaacctacaggtgggacgtgctgcgccagacgggctacgactggtggatgcgccgctttgagcgtgcgttcgagctgtacgactacgtgcgcctggaccacttcctgggcttctcgtcgtactacaccatccccaagggcaagaccgccctggagggctcgtggaactttgggcccggtctggacctcttccgcgaggcgcggcgtcgctttggtgacctcccgttcattgccgaggaccttggcacggtcacgccggcggttcgcgcgctgctggcggcgaccggcttcccgggcatggacgtgatccagtttgcggacgaggacgtgcggaagggcttccatcccaagccgggcaagatggcctacacctccacgcacgacacccagacgctccttgggtggtgtgagtcccgctttggcggcggggccgtcgaggacggccttgggcgagagggtctgtcgtactcccgcgtggaggagatgcgcgagctggccgagcggctgcgcgccgccacgctcgccaccgacgcgaacgtcgcgatcgtgtctctccaggacgtcctgatgctggacgactcggcaaggatgaacgtgcccggcgtggcgaccggcaactggtcgtggcaggcgggtctcgccgacgttgagcagtctcagggcctgctgcgacagcttgcggaggagagcggcagggcatagggcgtgttagacgcccgcatggcgcgggctggcggagggcctcggggcggcgtcccggagccctccattgttttgcggctccgtttgcgcagcgagggcgcactccggggcccctcgtgtcgccgtggctccgtttgtgcccgtgcggccgcgtgtcagccgcggagtgcttggcgagcctggtccccatgcggatttgggggagaggtgcttagcgtcgctggcccccgtacggactgacgacccgggcgctttacaaacctggccccctgcaggcgcgagactctgggactgcttaacaaatctggggctggtatgtacgcgcatgcgcgggtgcttagaaagtccgaggcgcgtatgcgagtgcgtgcgcgggtgcttagaaagtccgaggcgcgtatggatttttgccaatatgacccatacgggcaccggcaggattaagcattttccaatggaatccgtccgagcaccgacatctctaagcaggggccatattgcccctgcggacacagccctcactaagcttctgcgcctagtcgtgtggcgggagcggatgagattggtgcttcctcgtaaagccccgtgctctgtcgaccttcgggcatgggggtattccgcatgctactcgcgcggggcgctcgatctctcgtcgtctcttggactaccacctgcgcgccaatcgtgcttcacgcgtcgatttcgctatctgcgacgactacgcttgatctgcagagaagccgccctgcacccatgctgagccttgctttacggtaggttacatatttctgctcaaaacataagcctacgaatcagttttgtaggtgacacgcaggtgcaggctacatgcacgcaatttaagtgcggagaaatctgaaatagtcccttcgccttagaagcagcgaacctaccattcgtggcatggacattctcttctcacacttcagcgctctcacggttttgcgcagctatcgctgtcgtgccgtcgacggcgtgccacctgacaacggcgccgtgcctgccgtcacgccggggaaagacgagctgttgcgggaggtccgttcgagcgggctgttgagaggcctcgagcttcccatagagttgttggcggggagccataagcagaggagcaagacaatatacgcccataggttgcaatatcctcttccgaggcgagcgatactcaacctaggaggcttcaaatgcgtctcccccgagcacgtgattgtccagatggcttccaggttggacgatctgcggctcgcggtgcttcttggcgagctcatgggaacctatgccatcgacccaatccttggcgagatgtgccaggtcaaggagccgatgacgacacctgatgcattgcaagcgtacctggaggatcttggcggcttccccggaacatcacgggttcgccgatgcttgaggatgatgcctccgggctcgggctctccccgagagaccaggttggctcttcggctctcactgccacctgcccttggcggataccatcttcccgttgctgcactcaacatggtcgtgaacgtgcagggcctgcgggcggatttgccgcttcatactcgcaggccggacatccttctcgcggtattgggcgtgggccctggtcgggagggcaggcatcggtacgtcgctatcgaatacgacggcgcgacgcattatggcgaggagagacacgcgcgagacgtcgaacgtcagaccgagctcatggcagcgggactcaaggaatacgtcgttggccgccagcagtacgcggacctggagtatatggacggcctcgcctctctcatacgaaaagacctcggcatgtcccgcatagggctaacgcgagacgccgaaaggagaaggcgagagttgcgccgccaactatacctgcggctcgaggcaattgacgagaggggtctggggtcgctgctgccgcaggcggagcttggttcggacaaagatgggggcgaaccccgagacgaagacgtggtgccggtctcggcctatggcctggactgacgtgtgatgttagtgagcgggcgtcgctcgcacgaataagccgaggagcacgcgagtcggtttcggtcttttgggcggtgtacgggtcgtcggtgctccgcgcgggtgcggctggccgtgacgattggcgttccgccgtgcagccattgtgagttttggtacccgcgtgggaaagggttacggtgcttaaagattctggtgcgcgaacaatcagaagggcgatggtgcttaaagaatccggtgggtgaacgagtttttgatcgaatagcccattctcgcctcgatgaaattaagcattcggtcatgaaatccgacctacccccagagaagttaagcacgccgtcctcgtcgcttgggcaagcaccgaggagattaagcactcggttgcaaaatctgaacgagcgccgccaagccccccgccaagaagcttgcgaagatttgtctcccccgcgtcggctccgcgaccaacgccgcctacaatgtgtcccatgtttatcaacagagtctcaagacagctgctcgccgcccccgagttcgtgcccctgctgcacgggctcgacgcgggtgacgacgtcacgctcggcgtgtcgcagagcgcacgccccctggtcctcgcctccctctgggcgcgggacccccgcccctgcctcatggtcgtcgccggcgaggaggcggccgaccgaacggcgcgctcccttgccgcctggcttggcatggacgtggtctgccgctatcccgaccgcaaggacctgccctggtcccccaaggccccggacgacgcggcggtgggcgcccgctgctccgccgtcgcgcgtctttcggcaggggagaggtgcgtggtcgtcgcaagcgcggcggcgctcctccgccgggttccgcccgtgggctcgggctactttgcgtcgagcaccttctcggtgggcgaccaggttgactttgaggacgtgggacaccttctggtgggcatgggctacaccgacgccggcgactccgccgaggtcagcgaacccggcatgttccacgtgcacggcgacagcgtggacgtgttcccggcgcaggcgacctcgcccgttcgcatcgagttctttggcgacgaggtcgaccgcgtgcggcgcatggtcccctccacggggcagaccatcggcgagctggattcggtcacggtctctccctgccgcgagatcgcgctcacgcccacgaccatcgacgccgcccgccacgccctctacaagcgggcgcaggacaactcaaaggtcgcggcggacctcgagctcatccaggcgggttccgccgagccgtcgctcgagaagtacctccccgccctctacggcgggagcgcctcggtcatcgaccacgcaagcaaggacacgctcgtggtgctcgcggagcctcgcgcgctcttcgacgactgcatgcacgcctacgacgacgtcacggcctcggccaacgcggcgcgcgtgaagtcggatggtctgttctcctctccccgggagctcgactttggcaggcagcagcgcctctcgctctcgtcgatccagcgcgccggcacctccgccacttcgcagctcgccgtgcgccagccgggcattgcggggagcgacgcaaagctgctcggtcgccttcgccagttggtgggggagaggagcgcggtggtctttgccgtgcccgatcgcggtgcccgcgaggcgctggagctcaccctgagcgacgaggggattccctttgaggagtcgctgggggccgcggcgcccaacaacgtgcccgtgacctcggacgccgccaatgaccacgtggtcccgctctcccgcggcctcgtcaccttcttcgacgcgcccgttcccgccggtatcgtggtcccctccgcgcacctgggcgtgctcagcgtgagcgacctcacctcccgcatggcgcgccaccgtgaccacgcccgccgcgtggaccccaccacggtcacgttccccttcaagccgggggactacgtcgtccacgccacgcacggcatcgccctcttctcccagatcgtgcgccaggaggtcggtgggcgccagcgcgactacttcctcctggagtacgccgggggagacaagctgttcgtcccgctcgagcaggtcgaccgcatcacccgctacgtggggccggacggctcgagcccccgcctcacgcggctcaacaccgccgactggtcgcgcgccacgggcaaggcgcgcaagagcgccaagaagctcgccttcgacctggtagatctgtacacccggcgctcgtcggtgtcggggcacgccttctcgcccgacacgccggcccaggccgacatggaggcgagcttccgctacgagctcacccccgaccaggcgtcggcggtggcagacatcaaggccgacatggagtcccccaagcccatggaccgcctcctctgcggcgacgtgggctttggcaagaccgaggtggccctgcgcgcggcgttcaagtgctgccaggactccaagcaggtcatggtgctgtgccccaccaccatcctggcgcagcagcacttcgagacgttcttcgagcgcttctcgccctttgacctggacgtgcgcgtgctctcgcgctttgtgaccccctcccagcagcgcaaggccctcgagggcttcgcctcgggtgacgtggacgtgctcatcggcacccaccgcctgctctcggcagacgtgaacccgcacgacctggggctcgtgatcatcgacgaggagcagcgctttggcgttcagcacaaggagcagctcaagaacctgcgcgagcaggtggacgtgctcacgctctcggcaacgcccatcccgcgcaccatgcagatggccatgagcggcgtgcgcgacatgagcctcatcctcacgcctccgcccggccgccttccggtgaaggtcaccgtgggcgagtgggaccccgacgtggtgagcgatgccatacggcgcgagctggagcgcaagggtcaggtctactacgtgagcaaccgcgtcaccaccatcgaggacgccgtcgaccgcgtgcacgaggcggcccccgaggcccgcgtgggcgtggcgcacggccagatgagcgcctctcaggtggaggacgtgatgatggagtttgacgagcacgagatagacgtgctcgtggcgacgaccatcatcgagagcggcatcgacaactcgcacaccaacaccctcatcatcgaggactcgcagcgcctggggctggcgcagctctaccagctcaagggtcgcgtgggtcgcggcagggtgcaggcctacgcgtacttcatgttcccaggggagacgcccctcacccccgaggccacggaccgtctcaccgccatcaacgagtaccaggacctgggaagcggcatgcgcatagccatgcgcgacctcgagattcgaggcgccggctccctcatgggggcggaacagcacggcaacctctcgagcgtgggctttgacctgttcacccagatgctgggacaggccgtgagcgaggcgaggggcgaggcgccagacgtggagcaggcggaggttaccatcaacctcccggcagacttctaccttgcggaggagtacctgcccgacgtcgaccgcagagtgctggcctaccgacgccttgccgcggcgacggagctggcggacgtggacgccctgcagcgcgacctggaggacagctacggggcgctcccgctcgcgggcaagaacctgttcgaccgcgcgcgcatccgcatccgctgcgagcgcctgggtgccacgagcgtctcgctcaccaacgggcgcctgatctaccagggcgtggacgtgccccgagacgtcgtggcgaggctgcgccagcaccgggcgatcgtgtaccccaagaccaggaagctcgcctatccgttccacaccggcaaggaggagctgctgccggcggccctgggggtgctggaggagataggcggggacgacgaggagtaggagcgggcaacgcccgcggaggggagtgccaatggctgacgtcgagagggatcgcgagggcgaccgctggcaggaggccacggaccgcgcggacgcgcagaactccgggcgcgagggggcgccgggcgggcaccccgagttcgaccgcctggtgcgcaccatctggcggctgcgccagcccgacggctgcccgtgggacaaggcgcagacccaccgctccatcacgcgcaacatgatcgaggaggcctacgaggcggtcgacaccatcgagtccgacgacatgccgcacctccgcgaggagctgggtgacgtccttgagcaggtgcttctccactcgcagattgcctcggacgagggcgacttcgacatagacgacgtgtgccgcgagctcaaccagaagctcgtgcgcaggcacccgcatgtctttggcgaccttgcctccagcggcgcgggctccgtgggcggggtcctggacatctgggacgacgtcaagcgacaggagcgcgaggcaaggggcgcggggggagaggagcctggcctcctggactcggtgcccaaggcgctgcccgcgctcatgcagtgccagaagatctcgaagcgcgcggcgaaggcaggcttcgagtgggcgagcgaggacgacgtgtgggcgcaggtccagagcgagcgggacgagttcgaggccgaggagccaggcagccccgagcgggcggaggagtttggcgacctgctcttctccctcgtaaacgtcgcccgctgggagcacatcgacgccgaggaggcactggccgcagccaaccgcaagttcaggcgccgctgggccctcatggaagacatggcgcgcggggagggcgtcaggctcgaggacgtgggtgtggagcgcctcaactgcatgtgggatgccgcgaaggcgcgcgagcgctccggcggggaggcctctggtgacgctgcggaggcctcagggaagtaggtccgtcgcgtcgtcggctgctatagtatgaggtccacggggcggattggcgccccccgccaaacgaaccagaaacgaagcatggcatgagcagacccagtcgttcccaagcgggcgagtccatcgccctccccagatatggcaccccgcgccagccggtcgcaccgagcaggcggcgtggggagcgaggcgcgcgcgagcgcgtcactcccgtgcctgagtcagtgcggccatcgcgcggcagggcccaggagtcccgccgtggcggtcgacgcgtcccggcccaggcggcccgcgaggccacccgtggcaaaagtcgcgcaagcgcaggggagaggatcctctccgccggagactgggcagcccgccatcgcatcctcgtcaccttcgtcgcggtcgtcctggtcgcattcgtggggctgtacggtcccgtgcgcgactactacgtggcgcgcaggacgggagaggtcctgcagcagaagtacgacgacatttccagccagaactccgccctcaccgcagacgtccagcgcctgcagaccaaggagggcatcgaggacgaggcccgcaagcgcgggtatgtgtcgcagggcgagacggccgtgaccgtcgagggcctgagcgacgactcccagagcgatccctcggcggtggacgcctaccaagacgaccgcagcacgaccaccaagctgctggacacggtgtttggctacgacccggaggcaacatggaacgcgtagcatgcattgacatcggcaccgtgacatgccgccttgccgtcgccgaggtcgagggggacggggtccagaggctcgccaagagctcgaccatctgcaacctcgggcaggacctcaccgcgacggggaggatctgcgacgaggcgcgcgaccgcgtgctcgcatgcgtcgaccagtacctcgcgaccatcgccacctcgggtgcgcgggcggcgtgctgcacgctcacctcggcggcgcgagacgcgagcaactcgggcgagctcctctcggcgctcgagggccgcggtcttaggcccatggtcatcccgggcgaggtcgagggatccctcacgttcctgggggttgcacaggacttccctgggcagcgcatcctcgtggcggacaacggcggcggctccaccgagctggcgttggggaccctctcaagggacgggctcgacctcgaggcggtgcgctccgagaacgtggggtgccgcaggatcacggagcgcttcctctcggcgggcgacccgccgtcgccggacgacatcgcagccgcccgggcgttcgcggatggcccgtttgccgcggcggctgccgaggagagaatcgcacagaggcgccccgccaggctcgtcgtcacgggtggcacggtgaccagcctcgtcgccatcgagaagcgcctgcagccctatgacccccgccaggtccacctcgcaaacctgagtcgcacgcaggtggagggcctggtcaccaaactcgcctcgatgaccgttgcccagcggcgcgagctgccgggcctgcagcccaagcgagccagcgtgatcctcggcggcgccgtggcaatcgccgagctcatggcgcagaccggctttgacgagctcaccgtgagcgagagcgacctcctcttcggcctctcgctctgcgcggctgccgccatgcgcgacgaccagacctccgtgggctggaagccgctcctcgcgcccgtctggtagcccgcctgcgggcttgcgcgggggagaggggcccgcgggcctctcgtcgcgatatcattgcatgggcctgggggcgtggcgaaattggcatacgcagcagacttaaaatctgcctccgagaggattgcgggttcgagccccgccgcccctaccacacatttccctgcgatataaagagggcgacgcgccaagccggcacgccgccttcagtgctccatggtgcccccaacgagactcgaactcgtgtcgtcgccttgaaagggcgatgtcctgaccgctagacgatggggacgcatcggccagtataacagagccgatggggcaccccatgccatgcccctccacaaatcaaagtgaccacttgtccaatacttgaccgtatgagtaggatgaagtgagaaattcaatacagaaggaccaatgaccgacgggacgagggcgacaagcagcatgcctacggacgagaccgattccagcgatatggaaaaccccataccaaccccagcgctgaccagggcggttccgcccctgtacaagggcagtccgcaagaggttgccgggaccacctaccactcgcggctctccgagatcttccgcgagaagatctattcccgggagtggaaggccaactccaagataccctccgagcatcagctcatggaccagtatggcctcagccgcgggaccgtcaggcacgccatcaagacgctcgtggacgagggacttctggtccagcggcacggcaagggcacgttcgtgacagagtttggcatctctcaccctgccggcatccggcccatctcgtttgcccagtccctacgcgaccagggcaaggacttcatcacgctcgtcctggacaagaaggtcctcccagcccccgccgatgtggcaagggagctcgagatgggggagggggacgaggcgctcttcctcagaagggttcgccttgtggagggagtccccctcatctgccaggagagttggacaaacctagcggtctgccccggatacgagaaggtcaggttcgaggaggagcccgccttcgatgcggcgcagcgttgcagcgggaagaggatcgcctattcacgcatccgcaccacggcgcgactggcctgggtggagcacggcaggtacctgcgctgcgacgagtcggcgcccctgctcgttctggaacagacaattcggttctccgaccggacgccatttgagtggagcctgacctggctcagttccggtcaagcagtggtgggagatgcgattcaggagtgacgctcgaccgcgctctctgcgtctgtatccgcgaaaccgcctttgggactcttgttcattgaagggtgtacaagtagcccttcgagttgctatactcctctcgacagttccttcacattcttttcgtcaggaggagaccggtatggaaaaggcaacgctcaggagcccgttcctcgtagtgaacccaaagtcctacacctatggagaggatcttcacaagctggcccagcgggccgaggagcttgcggcaaagtatgacctcgactgcttgttcaccgctcagttcatcgatctcccctgggtcatcgagaactgcccccacctcacgccgtgcgcccagaacatggagagcctgaagcccggtcgtggcatggggcacatccttcccgaggccctcgcggcggcgggcgtcaaggcgacgttcctcaatcacgccgagaaccccaagaccgtccacgagcttgcggcgaccatcgctcgcgcaaacgaggtgggcatcctcacctgcgtctgcgccgactccgtcgaggaggcccagatcatcgccgaacttcaccccgacatcatcacctgcgagctcaccagcctcatcggtaccggccaggttgcgggtgaggactacatgaggtcctcgaccgaggccgtgcgtgcggtctcgcccagcaccaaggtgctccaggccgctggcatccactccggccagaacgtgtacgacgccatcaggctgggtgccgacgccacgggcggcacctccggcatcgtgtgcgccgatgacccgcttgccaagctcgacgagatgttcgaggcgcttgaccgcgcccgcaccgacttctacaaggaggcatagggatgactgtctacaagggccaggtgaccgttgacacccaggcggggaagcccacctacatcgacgtgaccgacgaggtcaacaagatcgtcgaggagagtggcgtcaaggagggcatcgtctcggtcatctcgtgccacaccacctgcgcggtgttctctgacgagtacgaccacgaccgcaacggagcgggtgacctcttcctacacgcggacctcaacaatggcctccagaagatcttccccgagcagcacgactggaatacctacaactacccgggcgagaagcacctggaggaggtcgagtcgtggcccaaccccgagaagtatcttcccggcggcgacaggaccatgctctggaacggtgacgcccacctgcgctcgaccctcatcggcggcagccagaccttcgaggttgccgagggcaagctccagatgaacggcctagccagcatcttcttcgtcgactatgaccgtacgcgcgagcgcacccgtcgccttcgcgtgatcgtcatgggggagtagtttcacaccgcctacctgtcaggcgtcacttgtaatcaaaaaaatgtacaagtggcgcttgatttttgaacggaaagtatatactttatggcagatgtatgaagcagttgctttttggcggctgaacgttcgtccgtataggaggaatttctcatgaagaccatcatcgtcgcttgtggttctggggttgcgacatccaccgctgtcgtcgcaaagattaccgacctgctcgactcccacggattcaacggcgaataccagcttcagcagtgctccatcgcggaggccgtggcaaagtccaagactgccgacctcctcatcgccacaaccgcgaagccccagggcattgagtgccccttcatctcgggcattccgttcctcaccggaattggcaaggccggggtcgagcagcagattctcgacttcatggcaaagtagtcttcggcactagcaagccctcaataatctaggttccactggggcccttgcggaggggtcctgggaagtgtacgcaaaatggaaggagaacagcacctatggatgcaatcgttgcgttcttcaacgggctatccagcctgggcgtttcggtcgtcatgccgatcgtcctcaccatcatcggttgctgctttggagccggctttggcaagagcctcaaggcgggcctcaccgtcggcatcggcttcatcggccttaacctcgtcatcaaccagctgatgggaaccgatctcgcctccgcggtcaccgccatggtcaaccgcttcggtctcgagctctcggtcatcgacgttggttggcctgcggcctccgccatcgccatgggctctgtcgtcggaaccatcatcatcccgctggccctgctggtgaacgtcgtcatgctgctcaccaacacgacccagaccgccgacgtcgacatctggaactactggcacttcgccttcaccggtgccctcgtcgccatcgtcaccaacaacgtgggccttggcatctttgccgccatcatcaacgaggtcgtcgtcctgatcatcggcgacgtcaccgccccgctcgtcgaggagtccctgggccttcccggcgtctccatcccccacggcttctctggcgcatacgtgcccatcgcgtttgcggtgaactggctccttgacaagattcccggcatcaagaacatcaactgggacgtccgcagcatgcagaagaagttcggcgtgtttggcgaccccgtcatgctcggctccatcatcggccttgtcatcggaatcctcgccggctatggcctgcttcccgtcaccaactccgatggcaccaccacccagtccgtgctctacatcgcggtcgcaatgggcgccgtcatggtcctgattccgcgcatggccgcactgctcatggagggcctgctccccatctccgacgccgcctctgccttcatccagaagcacttctccaaccgcggcaagatctacatcggccttgactccgccgtgggcaccggtcaccccgtgaccctgaccatggccctgatcctcgtgccggtggccgtcttcctggcgttcatccttcctggcaacaaggtcgtgcctctcgccgacctggcgtgcatcccctacatgctcgtgctgatcaccccgatcgtccacgagaacggcttccgcggcctgctcgtcggcatcgtcgtgctggcagtcggcttctacatcgcgaccgacctctcgccgctcatcacctccgctgcggcaaacgtcaactttgacatgggtggcgcggctgcgatttcgtccatctgcgatggcgctaacccgctcacctggctcatcgtccgctttggtacgattggcacctacatcggcctggtcgtccttgcggtgggtgacgtcgcgctcgccctctggaaccgcaagcgcatcctgcgcgaggcggcggagctccacgaggagagcgccgaggcggctgcgcagaagtaaggtggcttgtctccgtaacgagcttcccggtctggaagggacgggtcccacggctgctgtcgcgtggggcccgtcctcgtttggaggagcatggaagagaggacctacacatacgctcgcggccacttcaattgggaggtgacggcccaaggcgtcatctgcctcgccatcgctatcgcctgcgtgttcgaggcagcgaggggcgtcctggttgggctcatggccgtgattgccgtcattggggcttatggcgccttcaagacctttgtggcgcgcgcgtacccgcactccgtcactttcggcgatggcttcgtggaatttgagtgctacggtaggcgcgacaggtacgacttcgacgaggcccatgacgtccgggtgagggaatacccaagccagatgcgcctgtatgtccgcatggacggggacaccttccttcgcgggcgctattgggtccatgcccagtggtttgatgacggacgggagctctttgaccgtctcgtcaacctggaaaacgacctcaaccccaccagcctgagggcgcgtgcccggcgtgggggtgggttcgtggacctctccgatgacccggcacccttaaagccaaggtccaaatcaaagcgcaagcgtcgctaggcaaggcttgggcaaaagagacgaggtggcccgcccgagagactcctctcgtgggcgggccaccttgtttgccgtgcggattgatggtctccgacttccctacaccaggggctcggcgccattcgcgaagaccttcacgaccttctcgaagtcatcgcggagcgtctcgtaggcggcggtggtcatgtcgtgccagtagacgaccttgccacccttctcgctcacgagcttctccactgcctcgccggcgtacttgacgccgtaggtgtagtagttgatcttcctgatgccggcgttgatggacttgacgtagtcctcgtccgagacgcccgagccgccgtgcatgaccaggggcacgttgttgcgcttgcgaatctgggtcaggacgtcgaagttgaggtgcggctcgcccttgtacaggccgtgcacggtgccaaacgagcaggcgaggatgtcgaggccggtgcgggcgatgaagtcctgcgcctggtcggggtcggtgtagatggcgccagactcctgcgcggtgccaccctcgtcgcgcgaacctgcctcgcggctgcccatcgagcctagctcgcactcaaggccggcatcgaagctcgcacacatgtcggcggcacggcttgagttggccacgttctcctcataggggaggaaggacccgtcaaacatagcgccggtgaagcccatgtcgagcgccttgtacatgtacgagaggtgctcgcagtggtccaggtgcacgcagagggttgcgctggagcgctcggcgagggcgaccatggcggggccaatcttgtcgagcggcgcaaacgggtcgtgtccctcggcgtgggaaaggatgaccgggtagccggtctgctccgccacgtctacagccgcgcggagcgcctcaaagctgggtacgttgaaagatgcgattgccatgttgttctgctcggcgatggagcagatgtctcgaaggttgatgagcattcaacactcccctccagtcgggtggcttggatgtcaagccactatcttgtatatgctagtatatacaagtacagagtaagagacggcacgagttagactgtggaagggagaacgaatgattctcaagaaggagctcatacagattgggcttgactgcccggatgcggacagcgcgctgcgtgaggccgcccgcgccttcgtcgacaatggttttgcgaccgagggatacccccaggcgatcatcgatcgcgagcaggtctatcccacggcgcttccaggcgccgcgttcgacatcgcgatgccccactgtgacgcaaagtacatcaacaagactggcgttgcagtcatcacgctcaagaatcccgtcgagatgaagatgatgggtgatcccgacaccacgctgcaccccaagatgttcttcatgctgggcatcgccgatccccacggccaggtcgagatgctccagaggcttatcgccgtcatccaggacgcggaccttctcaaccaggcctacgcctgccaggatgtcgacgcgctctacgacctcatggcgcccaagctgggtgactaggggagagttgcttcgaccatagggctcacatagggcgtggcagccagcggatccactggctgccacgccctttctcgtatcgattgcgagcgctcccaactaccagtcgagcccgtgctcctccgcaaacgacttgcccgcagaggctatgtcctcctggcgctcggcccacagggcaaagtccggcacgtccaggatgattgggtccgcctcgtgcacggcgagcgtggcctcctcaaagctgtagggggcatactgggggcggtccggcatgtacgtgtcgatgaggatgggacgtagcagcgcgtaggcgccgccgtcgcacaggctgcacatgccgcgcagcgcccgacgggcggcggtcatgcggcccagcttgtacagcaggatgaccctcgagagcgcaaaccacgagtccccccggtgcgagaagcgcgcctcgagccggttgagcccctcctcgtcctcgagccttgcgcgcgagagcgcgcaggcccgtcttgcccccacgccgtcggcaggggagagggacagggcattctcgcccgcctcgtcgcacatccggtagcgacccgagtcaagggcggcaaactgtatgcgcgagagcagcctgagccacggacgggcaaacacgtcgttccaggcgtcgcccgtgccggtggtgtcggacgtccacgggccgcctgcgagctcgtcgcgaaggtccaggagcaaccctagctccacgtccgggtccttgtcgctggcgatgatttgcaccacgcgtgcgtccacgcaggtggggcatgccttggtgatcttctcgcaggcgatggagagcttccccatgcgctttgcgcgcgccgtagcgaactcgtcgtcctccaagaggtcgtcgccctcgcggtcttccgcgaacttgtccagcagcctccccagcgcgaggaacgtggcgtcctcacggttgtcgatgaactcctccgggttcttgcgaaccgccaggagcagctcggcgtaggcgctctgggagaggcccatgcgctcgcccctcctgcgggcgacgcgctgtatcagctcttccctcgcgtccaagctacctcccctccccggagtcgccgttgagctcgctgtcctcgcgcgccacgagcgcgtcgatgtcctccttgggggcgagctccttcgcccgctcggcgagccaggtgcccagcgagccgtgaccaaacctcgcccggccctcctggaacaggaccgtcgcctcggagcaggccacgatgagctcgtcctcgctgtacgggggcacggcaagccggtagaagacgccgtcgggcagctcgtgctgcagaaagatcgtggcggcggcgtaggggtaggtgttgcagagcgtctcgagctggcgtcgggcttcggccattcggtactgcttgaacaggagtgacatgcgggcgatctgcatccacgcgtcctcggggcctctcgcccgctcgatcgagaggcgacgtgtccgacgcgcgagcgcgtccaggccgtcctcgtcctccagcttggcataggcgattgccgccgtgaacctggcgtctgcggtgtcgtcggggtcaagctccagcagcctgtcgcagacccctattgcctgccggttgcgcccgcagatgaccgcctttgacgcctgcatgcccagccagcggaggtaggggtgcatggcgatcttgctcgcaaggaccgcccggtccccctcgtgggtcgcaagcatcaggtcgcgctgctcccgacagtgggcgcccacctcgtccgcggcctcttccaggaacttgtagtagaggtcgaacgaggggatgtcagcggcgcgaagcatgcggatggcgtcgtagcagcgagggtccagcgaaatcgcctcgttgagcaggctgcgcgcgcgcttgaggaggtcctgggacgttccgccgcgggagaagggcaggtcgtagtcgatgatcgtcgccgcgagggagaccaggtgaaacgccctgtcctcgtcggtttggggaagcgagtcccggtcctgggcaaaccggcggccaaaggtcgcaaactccctggcggccctcagcgggtccgtcccgtcgagctggctcacaaagcgaagcgccaggcgctggtagtcctccctgctggggtcgaacgacatgtgcctcctcccaaagcgtgtctacgacattccatcgtatctcagctgtcgaccgcgcgcagggtgtgtcgcggtgcgtggcggtgacgccagccgctggctcgacctgttcgggaggatgcccgcctccgaagaatccgtgcggggccggggaggggtaagcacgctcccatcgaagccgctgggcaatgacgcgggtgacaccgcggacgacgtcgtgactcgggattgttgggggtgcggatgcgaaggcatctcatatcagatggtgaatgtattctatatagtgtacattcaaaaaagtcaatagaaacacaatcagtattcagtatacggtcgagaaattcggcgagatgattcctgagcgtgcattagaaccctatgggtattctctctagcggatgggatccgtgtcccatcccccatggttgaacagcgggcgaggggttcgcccgcaatcgtcgcattgggcgactcgttgtcggctccgctgggggcggttgccggcagaaggaggagagtgtaatgggacgttttaccaacccgcgtgacctgtactttggtgagggcgctcgccacgaggtgaagaacctcaagggcaaaaaggccgtcatcgtctctggtggccacagcatgcgccgcggcggcttcctgcaggatgtccagaaggacctggaggacgccggcttcgaggtcaagctgttcgagggcgtcgagtccgatccgtcgatcgagacggtgcagaagggcgccaagttcatggaggagtttggtcctgactggatcgtcgccatcggcggtggctcccccatcgacgcggcaaaggccatgtgggtgttctacgagtaccccgacgagaagttcgacaacatcatccagccgttctcgttccccgagctgcgtcacaaggcgcacttctgcgccattagctccacctccggcaccgctaccgaggtgaccgccttctcggtcatcaccgactaccagcacggcatcaagtatcccctggccgacttcaacatcacgcccgacgtcgccatcgtcgaccccgagctcacctactccatgccccagaagctctgcgcccacaccggcatggacgccctcacgcactgcctcgaggcgtacgtctcgaccgctgcctccatgttcaccgacgccgacgccctgcacggcatccgcgagatcacccagtggctgcccgtctcctacaccggcgaccacgagggtcgcaagcacatgcacgaggcccagtgcctcgccggcctggccttctcctcgggcctgctcggcatcgtgcactccatggcgcacaagaccggcgcggcgtttgagaacggccacatcatccacggtgccgccaacgccatgtacctgggcaaggccatccagtggaactcgaaggatcctcgcgcccacgagcgctatgcctacgtcgccaaggagatcctgcaccttcccggcaccaccgacgaccagctcatcgagtcgctggtgcagaagatccgcagcatgaacgacgagctgcacattccgcagagcatcaacaactacgccaacggcggcgtcaaggccgacgagaccggcgagcccgtcatggtctccgagaaggagttcctggagaagctcccgaccatcgcggccaacgcggtcaaggatgcctgcacgcccgagaacccgcgcgagaccaaggcagaggacttcgagaagatcctgaagtgctgctactacgacgagccggtcaacttctaaggaccgattcgcaggtaagttcatcccccaagagccccgtcggcactcgccggcggggcttctttcatggctttagcctgtgtcgcgccacgcgcgacacagagaaccacccgctcagcgggtggatggcactgacgctatgcaacgaaactccctcccctctaggatggcggttgttcaggtcgccggccgcgagaggaaggagaacaccatggcacagaaggcgaacagcctcgcgcacaccaagtggatgtgcaagtaccacatcgtgttttgcccaaagtataggagaagggccatctacaaccaataccgcgaggacctcgggcagatcctcaggcagctatgccagtggaagggggtcgagatcatcgaggggcacctcatgcccgaccacgtgcacatgctggtgagcatcccgcccaagatcagcgtgtcgagcttcatgggatacctgaagggaaagagctcgctcctcatgttcgacaggcacgcgaacctcaagtacaagttcgggaacaggaagttctgggcggagggctactacgtgtccaccgtcggcctgaacgaggccacgatcgcgaagtacatccgggagcaggagcgggcggacatcgccctggaccggctgagcgtcaaggagtatgaggatccgttcaagaggtagcctggcacagcccgtttgacgggcacgccacgagtcaagcggccatcgggcctgaacgaagtgaaggccagggacttgagtccctggccggcttttctgggttataccctaagagtaaaccacccgctatgcgggtggtaatgattccgctgggagccctctacgagaggcaggatgcaatccacgcgatgaggttctgcgtgtggtccccgctcctctcggcgaccgtatgcccctgcgcccagaccgtctggaagtcgaggttggacaccgacgagtcgtgggcgaggaccagcgccaggttgagttcggtggcaagtgaggtctcgccctgggtgatgccgctgcggattctccagtttggcgccacggtggaggtgccgtagccgtctcccgaggggcacaggtagtagagcgggctgtacatgctcaggcggacggcctgctcggtgcccagggcgtccttggtctggacgtcgcacgcccagtccgaggcgtagctggagtcatagccgctcagggaggagtactcgctggcgttgtcctccatcaggtcggccatggtcgcgtcaaagtggcgggcgtcctggtcgtggtcgcccatcaggaggttctccatggcgctcttgtcgggggcgtcaaacgcggcaacgactttggtcgggggcttgcagtgcctcacgaacgcgccgatgctcgagatcgtcgccgtgttggaggacgcgtcgtaggtcacccaatcctcgtccgagttgagcgagtcgacataggcctgtgcgtcgtcgtaggtggcgtcgtcggtggcatagggaaagctcgtgtcgccgaggaagttgtcgagcgagccctcgatggtcgagagcatctggtcgtagtagctgcccgaggtgtagatcccctctcccccctcggagagggtcaggcggttgccgtcggcgtcctcgatgtcggacccgtttatgtacgagacgaactcccgtgccatgtcctgcgacagcgccctggtccaggtgccctgcgcgcgcgtgtcgacggtcgagaactgtcccatcatccactcgtaggcctcgttgcccgagtcgagcgacgtcacggggcaccagcacgccaccccgcatacggcgtcggaggagccctcccccgtcacggcgccaatcgactggaggtaggggccatactccgacgcgttccccgtggaggcgaccacggcgctctgggcgccgccggcggacacgccaaagatgaagatgcggtccgtgcttcccggaagggcgtcgccgttgtggcggaggcagcgtattgccgccttgaggtcggtcacgccccacggggcgccgccgtcgtactccgacccgtcggagttggtcccgttgctccttccgcggcatcccgcaaggacgtacaccatgccggcggctgcgtaggtcttcacgtcgtcggagctgtacgaggtgggagggttctgcggggcgtagccgttggtggtgacgggcatcgcgatgggtgcgtccttggccgtgtagtccccaaccgtcccatcaacgttgacctcgcaggtgtaggtcggcccgtcggagtttgccgtggcgctgaggtaggcacccgggacgtagatccccatcgactcgatggcgggtgcggcggggctcaggcagtactgcacgccgagctggtagtagatgtcgttgtcggagtcgtactgccaggcggagtcatcaagcgcaaggctcgaataatccgtcgccgccgtctgggcgctcgtcccttgcaggttataggcccccagggcgccgatgagccccgccgagaccgctccggcggagagaaacgccctcctggtcatcttgccgcccatcgatggctcccttccgaggccgggacaccgccccttaccttggggagagcgtagcaacgcaggcttaacgccagctttgggaagcgcccctcgggccgatgcttgacccaaggggcgcaatgctttccgctaccttaagacaccgctccctacgagcgccttctcagctcgaccagggtgtgcatggcgtcgcagaagccgtccgtggcatccctcgacgagacccacgcgttgccgctcgtggcgagcgccgcctgggccttgggattgtcgatgccgttgcgcatgagaaggaaggtgcccacgtggggggccatggcgcagtcggcgggggagtcgccgcacgccatgacctcggcgggatcccagcccatgagctcgatgtagcgccgcacggccgagcccttgtccaggccgcgcggggtgatgtggtaggtgtgcacgtcctccaggtgccccgactgggcggcgggcaggatggtcttgccagtcacgcgcgagacgaacccgttgtccgccaggtagaggggcaggcccgtctcgtccagcatccgctgcgcctcgtcctccatgacggcgccgcgcagcgccacggtaacctcgcggtactggtagccgatgttgttgtcgttgtaggtctccaggcagtcgtaccagcggtccaggagacggcccaccacgcccgtcgccatgatcacgtcgtggggcgtcctcccgcaggaggggtcgtagggcatgtcggccgtgaagtagcgccagccgccctcctggccctcgtggaggcacaggatgccgcccatctcgcctatccagccggggagccccaggatgcgcgcgtcctcgcggatcatggcgcggttgcggcccgtgcaggggatcacgtccatgccggcggacgccatggccacgagggtgcgggggagctcgtcggacggcctccccgccgcgtcgcggagcgcggtgctgtggcagatcatggtgttgtcggtgtcactgatgacgtggcggatgcggccgagcgaatcggcgaggtcgctggggagcgacgcggcgtcggtcgggaaggtcgggagcgagagtgctgctggcacgtcggtgtcctttcgacaagagagtggcacccatcgggggcgccaccgtgggtacttcgtctcagttgtggtagagctcgcgcatcgcgcgggcgaagagcgctccgtcggtctcgcacggcacgtacgagtctccaacgtgctggcgcgtctcgtctcccttggcaagaaggcacacgacggcgccacgctcgccttggagtgccagctccacggcacgccggactgcctgggggcgatcgacgattacctcgtgggcctggccctcgggcgtcgcgtccgcgagctgccggcagatctgctcaacgggctcgccggcggggtcctcctccgtgtagatgaggacgtcggcccacttgctcgcctcctcgggcagctcgtggcggcgctcgtacgccttccccccgggtgcccccaggacggcgatgatggacctgcctgggaactccttgcttatggacgagaagaaacgctggtagctcagcttgttgtgggcgtagtcgacgattccgaccacccgtggggtgggggaggggagcagctccatgcgccccgggacgctcaccttggcaagaccgtcccgcacctggtcgtagccaacccccaacacctcgcacgcggcgacggcgcagagggcgttctcggcgttgaagaggcccggcatgctcaccacgagctcgccctcccagctgggggtgtgcgccacgaggcggatgccgcccatgaacggggcgacgtcgtccgcccacacgtccgccgaacggtcgccctcggtggagaaggtcacgaccctctcgcagcgggacgcgcgcgagaggacctcgtccacgtggtcggtccccaggttgacgacggcgacccgtgcctggtcaaatatgcgcagcttactctggaagtagtcctcgaagctggggtgctcgcgcggagagatgtggtccctgccgatgttgaggaagcaggccacgtccaggcgcaggtggtccacgcggtcgtacttgagcgcctggctcgagacctccatcaccatgtgggggaggccggcgtcacgggcgttggcgaggtggcgccacaggtccggagcctccggcgtggtgttgacgctctccgcccgctccctgccgtcaaaggtctcgatggaacccaggatgcccgcccgggaatacggctccccggcgtccaggatggttcgcagcatgtacgaagtggtgctcttgcccttggtgccggtgattcccaccacgtcgaggtcgtggtcggggtgcccccaggcctcggcggaggcgagggccatcgcgggcctcaggccgtcgtccgtcgcgaccagcgcgggcacgttccccgccacgggtgcgagggcgtccgcatgggactcgtcgcacaggtacgcgaccgcgccgtccgcgatggcggaggcgaggtactgggggcggaaggcggcgcccttgcacacgaacaggtggccgggtgcggcgaagcgggagtcgctgtccgctcccgtgacggaggtgctcgccgcgtcgcccaggctcggcttgcgtgcgaggaagcccgcccctcccaggagggaggctatggattcaagtgtcgtattcatgcgaccaagtatatgcgcgcgtggggcggggagggggctcggagtgccaccccgcgaaagccccaccggagtgtccgtccccgggcgtctctcccctgtcgaccctcgggagggccaggggctgtgtgctacactctgcctgttacgggcgattggcgcagcggctagcgcaggtgccttacacgcacaaggtcggcggttcgaacccgtcatcgcccaccagccatccacgggcccttcggggcccgtcgtcgtttggagccatcgcatggcagacagcccagccccccgcgagcgctcgtacgggcgcgccgcagaccagatgcgtccggtcaagctcacccgcgacgtgatgaagaacgcgcacggctcgtgcctcgccgagtttggtgacaccagggtcatgtgcaccgcgaccgtggaggagggcgtccccggctggaggcgcgggcagcggcttggctgggtcaccgccgagtacgcgatgctccccgcctccaccaacacgcgtacgcgccgcgagtacggcaggcgcaagggtcgcagcatggagatcgagcgactcgtcggcaggagcctgcgtgcggtcgtggacatggagcgcctgggcgagttcaccgtcacctgcgactgcgacgtgatccaggcggacggggggacccgcaccgcatcgatcaccggggcgtgggttgccctccacgatgcgctcatgtcgttcgtggagcgcggcgtcatcgcccgcctgccgctcacgggccaggtggcagccatcagcatgggcgttgtcgacggggtcgagctccttgacctcgactaccccgaggactcgcacgcgcaggttgacatgaacctggtgtgcaccggtgacggcggcatcgtcgaggcccagtgcacgggcgagcgggcgaccctctctcgcgaccagctcaacgacctgctcgacatggggcaggcgggcgtggccaagctcgtcgagctgcaggagagggtcaccaacttcaggtcgtagcgagtccgcccggcggccggtgccgtcggcgcggcggaggaggagaggcacatggagcacgtggacatctctgagctggacccggcgtcgaccgtggtggtcgccaccggcaacgcgcacaaggtcaccgagatcgaggcgatcctctcgcccgtgatggagggcgtgaggttcgtcgccctggggcagctggggagcttccccgacccggtcgaggatggccagaccttccacgacaacgcggtcatcaaggcgcgggcggccctggacgagacgggcctgtgcatggcggtcgccgacgactccgggctgtgcgtggacgccctggacggggcgccgggaatcttcagcgcccgctacgccggagagcacggcaacgacgccgccaacaacgagaagttcctgcgcgagctcgaaggcgtccccgccgagcgccgccgcgcgcgcttccacagcagcgtggtcctggtgcagcgcgacgaggacggcgaggaggtcatctcgggcgagggcgactgcgagggcgtggtgggcctctctccccgcggccagaacggctttggctacgacccgctgttccatcccgacgacacgccgggcaagaccatggcggagctttcgcccgaggagaagaatgcaatttcgcatcgcttccacgcactccaggatcttgctgctaagctgtagcggtattcgcaagcacatggtgtgagctggtattttgttgccacaccacttgctctggacggcgtcaggcgtcgttcggggaggaggtagcatgcgcatcatccgcaccgtcgactacagggacatgagccgcaaggcggcaaacatcatctcggcccaggtgatcctcaagcccgatagcgtcctggggctcgccacgggaaccaccccgctaggaacctacggccagctcgccgcctggtgcgccaagggcgactgtgacttctccaaggtgcacacgtacaacctggacgagtaccgcggcctcacgcacgaggacccgcagagctaccactgcttcatgcgcaagaacttcttcgacaaggtcaacatcgacatcgccaacacccacgtgcccgacggatccaaccccaacgccgacgaggcgtgcgccgagtacgatcgcatggtggaggaggcgggctaccccgacctccagctcctgggcatcggcaggaacgggcacatcgggttcaacgagccggacgacgtgttcagcaaggggacgcactgcgtcaccctcacccagagcaccatcgaagccaacagccgcctcttcgagcgcgaggaggatgtgccgcggcaggcctacaccatgggggtccagaccatcatgcgcgcgaggagcatcctggtgattgcgaacggcgaggcaaaggcccaggccgtgtacgacatgtgctttggtcccgtcacgcccaaggtgccggcgtccatcctgcagctgcacaccaactgcgtggtcgtggctgacgaggccgcgctgagcctctgcccgcacgactagcagcaccacaggcatatgagagaggcgcgcccccgcaggagctggcttcccgcgggggcgcgccgtccctctcgccctgcctaggcgtcgagcaccaccggctcgtgggtgtagtggttgaggacctcgcatccgtcctcggtcacgatgaccaggtcctcgatgcgcacgcccatgtcgtcgggcaggtagatccccggctcgatggagaagcactgccccggccgcacgggctcgtcgtgcgtggcgctcacgtcgccgggctcgtggtcggtgagtccgatctggtgccccaggcgatgggtgaagtaggggccaaagcccgcgtcctcgatgaccttgcgggcggtgaggtcgatctgcgcaaacgtgacgcccggacgtacgatcgcctccgccgcctcgtttgccctgcggaccgtgtcgtacacctcgagctggtgcgccgtgggctccgccgtgaagaacgtcctggtcatgtcggagcagtaccagtcctgcttgcagcccacgtcaaagaggaccatgtcacccttggagaggggcgtctggtcgggctcgtggtgcgggtcggcggcgtgcgttccgtagctgacgatcggcgggaacgagtggtcctgcgcccccagcgagcggtactcgcccagcaggccctcggcgatggagagctcggtggcaccctcccgcacctgcgaggcgagccaggacatcgcgaggtcgttggtcaggctcgcctggcgcatcaggccctgctcgcggtcatccttgatggagcgggcgtcatccaccgccttcgaggcgagcctgaagccgcttgccgccttggagtccatgaggggcacgagccagcgcgccgccaggtccttatccaccccaagctcggagccggggtcgcagtttgccgcaaccagggggatggggtcctcggtgtcgtcgaaggtcaccagccggtccgccgcgcccgtggcgtcgggaaagaggcggttggcaaacatgacggaaccgctggggctcaggtacagcgcaaggaagcgctccaggggctcggtgtaatagcccgtcaggtaccagatggacagcgggtcacagataagtgcctgcgagagccccatctttcgtaggttgtccatcacacgactgctgcgctcctggtccatggcgtctcctcactacgatgcctgtctacctttcgtgaacacgcacctgctgctatacacttgaaggctgcatgacacaaggcggcgggagggcacgccttcccgccgccgcttcatggaggtaccttcatatggaatcagagatcccacccgtcaacagggtagacgaaatccgcgatgaacttaagggtcttcagggcaagcgggtcaaggttcgcgccaacatgggccgttcgcgcgtcgtcgagcgcacgggcacgctcgtcggtgcctatcccaccctcttcgtcatcgaggtcgaggagcgtcgcggccgcaaggcgcgccagtcctaccagtacgtggacgtcctcacctccaccgtcgagctgtacgacccggacaccggcgagcgtgtgctcgacttctccgacatccaggagcagtaggccgtgcgctccgtcaccgtcctggcgcccgccaaggtgaacctccacctggggattcaccccggaagggacgagcgcggctatcacagggcagactcggtgatggtggccctgggccttgccgacagggtcaccgtgagcgaggccccgggcaatccccttcacgtcacgatggacgtggacgccggggtgggcgagagggacaacaccgcctacgtcgcggccgagcgcctctgcgcggccttcggtcgttctcccgagtacctggtctcgatcgagaagcgcgtccccccgcagagcggcctcggcggctcctcgtcggacggcgccgcaaccatcctcgcgctctgcaccctctgggacgtgcttcccgcaagtgacgcggtcgtcgaggtcgcgcgctcggtcggggcggacgtccccttcttcctcaacctcgccccctcgctcctcgagggtgccggcgatgtgctgtgcagggtgtttcccgccctgggcgacgttcccatcgtcctcgtcaggcccaggggcggcgtctccacggcccaggcgtacgccgagttcgaccgcgaccccattgaccccctggggaccacgggaatcctcagggccctgtccggcggcagcgtgacggacgtcgcaaggagcctgtacaacaacctctccggcgccgcgcggcgtgccgagggccaggtcgccgaggtcgagagatggcttgccgcgcaggatggcgtcaaagcaagcatggtgtccggatccgggagctgtgtctttggcatctgctccagccatgcggacgccgagcgcatcgcctccctcgcccacgacgagcagggactttggtcctgtgccacgcgcgtcgtctccagcagggacgagatcgcggggtaggacgtaggccgatttgacgcagcggcttccatccgcgtggcaaatctgctagattaagcaagctacgggacgtggcgcagtttggtagcgcgcacggttcgggaccgtgaggtcgctggttcgaatccagtcgtcccgaccagacatgcaggggcccaggtgtttctcccctgggcccttttgcgttgtcggcggttgggggtgaccgttgctccccaccctggcttccccagtgcgggcaccctcatttgttcaacgccccttaacaacagggcgatatagtgaatttcaacaattgctcaggttgggtgtccccgcctttgcgggggatagggggttccatgcgcatcgaactttcaacttggccacgcgtccaggcgtactttgctgggggagaggaccttgtggtccttgccgtcggcagcaccgaggagcacgggaggcacaatccgctggggaccgacaccctggcccccaacctcctgctcgacatcatcgagcgcggccttgccgagaggggcgatcccgacgtcctcgtggcgccgaccatcccctatggaaacgccgacgacctcgttgggtttcccgggaccctctctattggatatgacctgctgatgaaactggtgaagcgaatcacggaccaactctacgactatggggcgcggcgctttctcgtgatcaacggccacggccccaacatcaagccgctctccgccgtctgcgagggacttaatcggagggggtgccttgccgcactcgccaactggtggctcatggcgggggagctcaaccctgcttggggcggcggtcacggcggggcggaggagaccgccgcggtcatggcagtgaacccctctctcgttgaccgttctgcactcgggcccatggacctttcaaacgacatctcggacgagttaccgaccgacggctgggacaacgtgctctacaagggggcacacgttgcctttccacgtgatgcctgccgctatgccgggaacggttggattggccccgacgacccgtcgcatgccgaccccgagtggggccgccagatgatggagggtgtggggtcctaccttgttgacttcatcggcgcgatgcggcgcgcgcctcttccgcggccgatgccggtccgcacggtcgacgccttcgggtgcggcgcaagcgactgaccgtgtgaaaagatctgacacaagtggttcaagctcgtccaatcggacgagggatcggaggaacgatggaacttgaccgcagcgagacggtgggtctgctcggaagcttgagcaacgccaagtcaccctcgggcttcgaggacgagactgtggaggtcgtgagggagttctgcgaggggtgggccagcgtcgagaccaactccctcatggacgccctcattaccccgaacaactttacgggcaagaagcccgtcgtcatgctcgatgcgcacggggacgaggtcggcggcatggttcgctccatccgctccaacggcacgatgtccttcgtggagctcgggcgcttctctccccacgtgctcgctggccaggacgtcctcgttcgcgggacggacggcgtgtggcggcacggcgtcgtgggcatcaagcccccgcacttcatgtccaaggcagaggccgccgcgggcgacagccccatgatcctggacgtgggcgccacctccaaggaggacgcgatcgagcgcttccacatggggatgggcgagcccgtggttcccgccaccagcttctgctacgacgaccagacgggcatcgcctttggcaaggccttcgactgccgtgccggcgtgacggccgagctgctggcgctccgcgagctgtcccgccgcgacgacctccccttcgacgtcgtcgcgagcatctcgtccatggaggaggtgggcgagaggggcgtggccgccgcgatcaggcacttcaaaccccaggtcgcgttcatgttcgagggctgccccgccgacgacaccttccaggcgcctgacgacatccagacggcgctgcgccatgggccgatgttccgctactttgactgctgcatgatcaccaacccgcgctaccagcgctttgtcctcaagtgcgcgagcgaggccggcttggcatgccagaccagcgtgcgcgagggcggcgggaccgacggcggcccggcccacatgatggacgtccccagcgtcgttgccggcgtgccctgccgctacgtgcatgcgggcaccgccatctgcgcgctcgatgacgtggaggagacggcgcgagtcgccgtcgaggtagtctctcatctgacggtcgaggtcgcgaggggcttctagacaggaggggaacgcatgagcgtcaaggttcaggaagggtacatccccttcgccggatacaagacctattacaggatcgtgggcgagtgcgacacgggaaggctgcccatcctcgcgctccatggtgggccggggtcagcccattactatgtaacttctctcgacgacatagcggagaggtatggtcgggccgtcatctactatgaccagatgagctgcggaaagtccaagtctccggcccttccggaccagtggagcgctgccttcttcgaggatgagctcagggtcgttcgccgcgagctcgggctcgaacgcatccacctttggggccactcctggggtggcatgctcgccatgcagtacgccacgcaccgtcccgccggcattgcctccatggtcgtcgcaagtggccccgcgtcccttgacctgtggcttgaggaggcgaatcgactccgtggctatcttcccgttgacatgcagaaggcccttgtgcaggcagacgaggatggtgactacgagcggcccgaggtcaaggctgcgagcgacgaatactaccgtaggcacgtgtgcaaggtgagcgcggaggacgaggatcccaagctcaggcgtcccaaggacgagccgggcaaggagtgctatcacttcatgcaggggatgagcgagttcgtggtgacggggaaactgtcgcattgggacatcaccgacgacctccatcgcatctctatccccaccctcttcacctcgggggaggcggacgagtgcaccccctacattgccaagcaggtggttgacgggattcccaactgcgagtggcatcttttcaggggaggtacccactgcgtccactcggagcagcctcaggtctacaacgacgttgtcgaggagttcgtggagcgtcacgagtagggaggcggcatgtttctagagagaagcacgtggcctaaggtcgaggactactttgccaggaatgacctcgtcgtactcggctttggcagcacggagaatcatggcaggcacaaccctcttggaacggactggatggcaccgcagcgcatcctcgagctcctggacgagcggcgcccgcaggtcctggtggggccaaccctcaaacttggctcggcggaccacttcgttgactacccgggaacgctctccctgggagatgagttgctgttcgagattgtccggcgcatctctcgccagctctttcgctatggcgcgaggcacttcgtcttcgttaacggccacggaggcaacaccagggcgctgactcggacagggtacgagctaaacgatcgtggtgcccaggtggctctcgtcaactggtggaaactcgccgggcaacttgaccccaaatggggcggtggccatggaggggcccaggagacgtccgccaacctgtggattgacccgtcggcggtcgacctcggcgcaatcgctccgatggaccttgtcgatgacgggggagagcggcttcgcaccgtgggattcgactccgtggagttcgagggggcaacgccagcgttgctgcgtcgtgcgaggcgctatgcaacaaacgggtggattggtccggatgacccggcaggggcgagtgccgagtgggggagggacatgctcacgtcgatggcggactggctcgccgacttcgtcgatgcgttcgcggagtccccgctaccagatccaatcaagcgctgagcccacgacccggaatgacagcgcgccccggaggccatgtggcttccggggcgcgcccttctcccctcccctgccaggggggctatgccttcttggcggagtgcagctcggggcaacgcgccgcgtcaacaatcacgttggtgaagttcttggagcagaccttgctcaggcccttgtggatgatggggatgatgggcatgtcctcggccgcgattgcgtcggcctcgtgcatgagctcgatgcgcttgtcctcgtccaccgtctttcgagcctcgtcgagcttggcgtcgaacttgctgttcgagtagtgggacacgttgtcgcccaccccggtgtacatcaggggctgcaggaagttgtccatgatggggtagtcggcggtccagccacgcgaccccagctggaacgtcccatcggtgtacttcgagagcatggaggcgtactccatctggtcgatcgtcacggtgatcccgactgccttccagtcgttgatcatcatcgtgaactcgtccgtggagctcgaggacgacaccatgaagtctatgttgattccacgatccccgttggagtcggccttgtaaccggcctcgtccagcagcttctcggccttgtccttgtcgtaggcggtataggtccaggtgctctcgtcgttgcccttgatgcccgggggaacgatgtccccggcgggcttggcagtgccctcgtagagcgtgtcgcagatcttctggcggtcgagggctagggacatggcctggcgcaccttcacgttcgagaggaccttgtcgttaacgttgtaggcgaggtattccgtgtacagaacctctccggtgagggtctggttgcctggggtcgctgtgaagccgtccttggaggccccataggaatcctcggtctccttgattcggccggtgggaatgtcgcacacatcaaggtttccggcctcgaactcgcggaacgcggtgtcggcatccttctgaatcgagaagttgactccgtcgacgtttgcggtgtttggcccggcgtagtcgtcaaagcgcttgaggttgatgtactggtcgtccttccacgtgccatccatcttgaaggggccgttgcccaccggggccttggtgtaggtgtcaaagtccttcttcgcgcagtcagggatgggcgagaggggcgtgcacgacgttacgtaggggaagtcggcatacggggcgctcagctcgaccttcagcgtgtagtcatccgggcaggtgactccggcaagctcggttgccttgccgttgatcatgtcgtcgtatcccttgacgagctgcaggtggtacgagacgacggacggggccgagcccgccttggggttgcagaggcgctcccacccatacttgaacgactttgaggtgacgtcggtcccatcatggaacttcagccccttgcgaatcttgaaggtccacgtgtccgcggagtcgttggactcccaggactccgccgagaggccctcgagcttctcggtcgagaagttgaagatggtgagagggtcaaacagctgatacgagacggcaacgccgttgaactcctcgatatcatagggatcaatgctcgtggggttcgagatgtagtacttcatcgtcccacctgctgacccgccggcgctgtcggaggagcctgcccccttcttcccgcacgcagtgaggcccgcgatggctgcgagacccgccgagcccttgaggaacgtccgcctggtgaaactgttgccgcctgcctccatgaagctacctcccatatccaccaaactgcatcttgaaccaagcctgaacgtattcggacttgtttacgaagtgttgtaccagtgaattcggagctgtggcgacgtaggcgcactctcgatatgatgacgaaacaattcatttatacatttaacacgagcggcagggtatcgtcggcgaacggattgcagggccagaaggcgctatcatccacgaccgatggggttgctgtgaaccgacgcaagaggggagaggcccatgcgcatggataggagcacctggacgcaggtgagagactactttgacgtccacgaccttgtggtgatcggggtggggtcgaccgagtgccacggacgccacaatccgctggggactgataccatggcgcccgacgagatccttaggcaggtcgaggagagggacggtacctaccttatagccccgacgcttccctatggagccacggacgatctggtcgggtatcccgggaccatctcccttggggtggaggggctcgcgagggtccttgagagcatcacctcgcagctgtacgactatggggctcgacgcttcgtcttcctcaacggacacgggggcaacgtcaagtccatctcgcaggtttcgatggggctcaacgaccgtggctgcatcgccgcgatggtcaattggtggcgggtcgctccccagatcgatccgcgctggggcggtggccacgggggcgccatggagacctcggcgaatctcgccatcgaccccgattcggtcgacctctcgcaggtgtgcggcgagggtcttctctcggacgtgggagatgacctgccctcgactggctggtattccgttcgataccggggcgtggacgtggacgtcccgcgtcggctcgtgcgctttgcgagctcgggttgggtggcagagggatttgaagaccacccccgtaactcgtcggcagagctgggcaggcagatgctcgaggggactgccaactggctcatcggctttctgcacacccttgagggcgagagcctgcccgagcccctcgacccgtcacgcgcgaccgagccccttgaggggtagcggcggaaactaggttgggcgttccatcaagagggggcgtcccgcgtcgtgcggggcaccccctccatcacccaggtgggatgtcctccgcccctacacgcccccgggctcgacctcggctcgcacgaccacggggctgccgtccaggaccagcctgccgtcggacaccctcgcggtgccgccgtccacgaggttctcgtatgcgccatcggggagcgggacgtccaccgtcgcgcccttcccgccaaggcagaacgcgccaaccttccgcacgccatgggactctcgcctgaggacggcgacgtctgccccgtcgtccgcggaggagaagaacgcgtcgtccgcatccagggcctcccgcttgaccctggccatgcgcgccatcagggccgacaggtcgcggccgccctcccagtcgatggggtcgcggtcgaagaggctcggcctgtgctcgctcgccacctcctgcccggcgtacacgagcgtggtccccttgaggaagtagagcatggcggtgaagttctccagcgcccttgggccgcccaccctcggtgcgatgcggggcaggtcgtggttctccagaaagcggagcttgtcgtagttctgggggtacacgctctcctggaagtccaggaggtccaggtagcacgagagggggatcctgccctcaaggtagcggtcgaaggcctcctgcacgtcgtaggagtactcggcgtcaaaggcctcgaacgcctcggtgtcgcgcgcgcagtacatgcccgcggcgcggcaggcggcgccaaaggagcggtgcaccgtctcggcgagccacaggcagccagggtggaccctctcgacctccctgcgcgcacggacccagaagtcgacggggacaaacgacgccacgtcgcagcgaaagccgtcgacgatctgcgcccactggcagagcgtctggatctggtagtcccacagatcgtggttggagtagtccaggtcgacgatgtcgctccagtcgcccacgcggttgccggtgctgccgtccggcttgtggtagaagtactcgggatgctgggagaggagcacggagtcgggcgaggtgtggttgtacaccacgtcgatgatgcagcgcatgccgtttgcgtggatggcgtcaaccagggcgcgcaggtcgtcgagcgtcccgtactcggggttcacggcacggtagtcgcggatggcgtaggggcttcccagcgtgccctttctgcgggcctccccaatgggatggatgggcatcagccacaccacgtcggtccccagcgagcgaatcctgggcaggtccggaatcaccgccctaaatatcccctccgccgtgtggttgcgcacgaagacggaatagatgacgaggtcgcgcactgcgttgctggtgtctgctgccatggtgcctcccgttgacttgcctccgggtgccattctgccgcacggggagaggtcgtgcaaacaactttgccccagcggttggcgtgcgacgggttgggtcggaggcccccgcaacgcgtcagcttacattgcgcttacatgctgccgatagaatcggttctaggagagacatgcgaccgtccggctcggaccccgtcccgtcggcggcgccccaggttcggagggcacatggtcaagacgctcgtgctgatgcgccacggtagggcccgcgccgcgaggccgggcgaggacgactccgagcggcccctcaccaaggccggcagggtcgcgctcgagaggtcgcttcccaccacgctcgcgctcctgggtggccggggcagcgtggtagtgtggaccagcccgctgcttcgcgcgcgccagacggcgcggctcgtcgcacgtgcggcgggcgcccccgagcccgtcgtgcacggctcccttgcgtccgccgatcccgagcggctcatggcggagctgcaagaggcggagggggactgcgtcatcgcggtcgggcacgtccccctcgtcccagcggtggcgcgcggcctcctgggcacgagccccgacttcaagcccggcgccatgctcgcgctggagccgggtggccagccctcgggggcgctcgcgctctggtttgtcaacgggccggcggtggagccatgggaggagctcgacgcgctcgagtcggcgctggcggcctgctcgcgccgtatcgcgggcaggagagacgacttcctggaggagccgtccgcctccaacctgcatcgcctgcgcatctccctcagggaggcgcggtcgctcgcgcacttcgcctccccgtggctccgcggctcaacgtccctctgcgacgacctctccctggtccaggggcagacgtccaggttgcgcgacatggacgtgctgctcgccctggtggcgtccggctcgtttcgcgaggccgcctgcggagacgggacgccgagccgcctgccccaggtcgtctcgctcctggccgacgagcgcgagcgcgaggcgggaaggctcaagggggccctcgcgtccaagcgggtctcggcggcgctctcgtcctccctcaaggggctgggcaagccacgcctgactaaggtggcgcgcgagcatggggtcgcgcgggaggagctcgcgcagcgctttgaccggctggcgggaaaggcggacgcgctgagggcgcttccgcccagcacgccggacgagctccacacgctcaggaagcgcgagaaggagctgcgctacgtgatcaggcggctgggggaccagctggccccggggcaggcgtcgcgggcggcctcgctgagggaggcccaggatgccctgggcacggcgtgcgactacgcgtccgccgcgcggctttccggcgagcttgcgaggaaggggcgcttctccgaggtcaggggcgagctcgaacgggtctcctccgactgctcccaggcgggcgagagggccttctcccgtgcgcttggcggagcggagccggccgatgccccgtctcctgacggaaatctgtgaacggcgctccccccgccgcgcgttcgactaacgtctgatgggaagggacggcgccacgatgcgccgtccgcaaagcgtcgggaggagaccccatgggattcaggagctcgaaggtcgtcatagtgggcgttggcaacgtgggtgccaccaccgcctacagccttgcaaaccagcagctctgcgaggagctggtgctcatcgacgtcaaccgcgacaaggcggtggcggaggcgctggacatccagcagtcggcctacttcatggagcgcaacatgaaggtccgcgcgggcgactacgcggactgtgcggacgccgacatggtcgtgatatccgcgagcgcccccatgcccaaggactccgacgacaggctccagatgctcaagccctccatgggcctggtgcgcgggattgtggactccgtgatggagagcggctttgcggggatcctccttctggtctccaaccccgtcgacgtgatgacctactacgcctggcacctctccgggctgccgtccaaccaggtcatcggaagcgggaccaacctggacaccgcgcgcctctgcacgcgcctggcgcagatgtacgacctcgacgcgcgcagcgtccaggcctacgtcatcggcgagcacggagactccgaggtggtctcgtgggcgtccgcgaccattggcggcaagagcgtgaccgacgtcctggccgacaacgcgtcgcgcaccaaggggaccaccaaggacgacctgctcaagagcaccatccaggcgggttgggacatcttctcgcgcaaggggaacacctgctacggcatcgcctcgtccgtgaccgcaatagcccgctccatcctcaacgacgacaacgcgatcatgcccgtgagcgtccgtctcgccgggcagtacggggtggacggcgtgttcctctccgtccccacgatcctggatcacacgggtgccaaggagatcgtcgagatccgcctggcgcccgacgaggaggcggcgttcaagaggtcggcggaggtcctgcgctcgcagtacgagcttgtggactccacgctgtagggcggtcgcgcgggccatagttgtggaggggccctgttgccggggtgcctgggggagacgcgctgtgccccgggcgccccggcttcacatagaatcggtctgtcagatgagcagggggaggaaccatggcactcaagtactcgacggcgaggttcgtggcatcgtacggggagcccgagcagcttcccgagccaacggagcccgagatcgcattctgcggtcgctccaacgtgggcaagtcctccctgctcaacaagctcgtgggacgcaaggcgctcgccaaggtgtcgagccagccggggcgcacggccaacgtcaacttcttcgaggtcgacggggtcgcgttcgtagacctgcccggctacggctttgccagggtcagcaaggcggagcgcaagcggtggtcaaacctcattggtggctactttgagcagaaccgcagcttcaacctggtcgtcgccctcgtggacatccgccttgacgcgcagcagctcgaccgccagatgctgggctttctccaggagcgtgagctccccttcatcgtggcgctcaccaaggcagacaagctcgggcgcaacaagcaggcgcagcagcgtgtcagcctcgcgcggcagtttggcatcgaccccgaggccatggtcatcacctcgtcccagacggggcttggcatcgacgagatccgccgccgcatccagcgcgcggtggacgaccccgaggtgcccgagggcgccgaggtcgtggacgcgggcccgggagaggacctctggcagtaggaccgcgcagtcgctacttccgccggtactgacgggcgatcgccagctcgcggtcgcaggcgacaaagacgttgtccccgttgtggcgcgggtcctcgggccgctcggggatcacgtacacgtgggcaaactcctccgcgaaggtgcggacggtctcctccagcgtccgcgagcggcggccctccagggggcagatcacgtttgccaggtagacgcccctctcggtgaggtgctcgtggatgatcctggcgcccttatccgtccgcatgggaccaaggggccgcttcccgctgaaggcgtcgttcaccacgaggtcccagcgctggtcgctttcgcggagatacgcccaaccgtcggcgcactcgacgcgaagccgcccgtccctctcggcgtggtagtcctcctccagccggtcgaggaagaacctctcgcgcgcgacgcggatgatggcggggtcgacctccaccacgtccacgtgcgtgccggggcagtgcgccaccagccacttgggaaaagagaagcccccgccgccaatgaccagggccgagtcggcgcccccggcgatgtccagcacctcggcaaagtactggtggtacatgcaggccagctcggcgtagtcgtcgcccacaaagctcacgctctggaacgtccccctcacgttgaggaggcggacggtccccacctcgtcggtgggggagtcaaacaccagcgccgggccaaacttggtcctgatcatgtccaccccgcggagcctgaggaggcgcggcagcaggaggacgatcacgtcgaggatgcagacaaagacgaacagggccacgagtggcttgggcatttgacccctgctttcgtgttaggaacgtaaaagtaacacccgaggaatcgaccatcgggcgcctcggttatactagcgtttgccgtgaccgtcgggtgcagcgtgcgctcggcacaggtatctctaggaggaacacatgatactaggactgggcgctcccgagctcatcatcatcctgctcgtcgtgctggtcatcttcgggcccaagaacctcccgaagctgggcaagtcgcttggcaagacggtgaagaacgtccgcgagggcatggagggcaccgacgaggaggactcctccaagaaggtcgagaagcccgccgaggacgccaacgttgaggacgtcgtcgccaccgactccgacgaggatgccgacgcctccgaggcagaggccgaggacggcgtgttctgcaccaagtgcgggaccaagaaccctgccggctccgccttctgcagcaagtgcggcgccaagctcgccgagtaggcgcaggcgcgtagcacggaccttgcacgaaggaagaaagggcagcatggacaagaaggaaatcatcctcacccccgaaggccgtcagcgcctggtggacgagctcgagttccgcgagggcgagaagcacgacgagatcgtcgagcgcatcaaggaggcccgcggctttggcgacctctccgagaacgcggagtatgacgccgcgaaggaggagcagtcccagaacgagtcccgcatcaacgagatccgtcagatcctcgccacggcaaaggtcgtggcggccggggcggacgcgcgcctctccgtctccatcggcaccacggtcgagctcgaggacgcaaagggcaagcgcgtctccttcaccatcgtgggcaccaccgagaccgactcgctctcgcacaagatctcgaacgagtcacccgcgggttccgtgctcatcgggcacgtggtgggggacagcgtctcgttctccacgcccagcggcaaggttcgtgagtacaccatcaccaacatcacccgctaggaaccagacagagacttgcgtgcaccccgtgccctcggcagtaaggcgtggggtgcatttgtcatttgacgaggaacgaagccacacggcaggcagacctaggagcagccaatgtccgacacaagcaccaccgcggtagaccccaacgacgagcgcgcgcagcgtcgcgcgaggaggcaggccctcatcgacgctggcgtcaacccctatcccatcaagagcgaggtgaccgcgcacgctggtgagctggccgagcgctacgcctccctcgagcccgcgaccgacaccaccgacacctacacccttgccggcaggatccgagccttccgcaagcagggcaagatctgcttcatcgtcctcgaggacgtctcggggcagatccagctcttctgccgcgtgaacgaccttcccgaggacgactgggcgcttctctccaagatggacctgggtgacatcatccaagccaccggcaacgtgatccgcacccgccgcggggagctctccgtcgcccccagccacctggtcatgctgtccaagtccacgcgtcctctgcccgagaagttccacggcctcaccgatcgcgagatgcgctatcgccagcgctacgtcgacctgatcatgaaccccgacgtgcgcgaggtgttccgcaagcgcagccagatcgtcagcctgatccgccgctacatggaggcggacggctacatggaggtcgagacccccatgatgcacgcaatcatgggcggcgccaacgcaaagccgttcgtcacgcacttcaatgccctcgaccgcgacttctacctccgcatcgccaccgagctcccgctcaagcgcctcatcgtgggtggcatggagcgcgtgttcgagatcggccggcagttccgcaacgagggcatggacctcacgcacaaccccgagttcaccacgatggaggcgtactgcgcctattccgacctcgagggcatgaagaggctcaccgaggggctgttcaagaccatcgcgcgcgaggcctgcggctgcgaggagggtcacgaggtcatcacctaccagggccagcaggtggacatgagcggggaatggcgctcggtgccgctctcggaggtcgcctccgaggcggttggcgagcacgttgacatggacacccccgtcgagcggctgcgccagctctgcgaggcccacggcatcgagtgggaggagagctggggctcgggcaagctgctgttcaccctgtatgacgagctgggcgagggcacgctcgtgaacccgaccttcgtctgcgactatcccgaggaggtctcgcccctctccaagcgcaaggacgaggacccgcgcctgaccgaccgcttcgagctcgtcatctgcggccacgagtacgccaacgcgttcagcgagctcaacgatcccgtcgaccaggcgggccgctttgccgagcaggtcgcggccaagggctttggcgacgacgaggccatgggctacgactacgactacgtccgcgcgctcgagtatggcatgccccccgcgggtggcatcgggtacggcatcgaccgcatggtcatgctcttctgcgaccagccggccattcgcgacgtgctgctgttcccgcagatgaagcccgaggtcgtcaccagggcggacatcgcctcgcagctgcccgacaggaccgacaacgccgcggcgggggcagacgtgctgctcgacgacgcggagaacggtgcctccgcggaggcgggaagggaggccaaggtggccaagctgcagagcgggctcacccgcgagcaggcgtttgaactgctcaagaagtacaacgaggatgacttccacatcaagcacggcgagaccctcgagggcctgatgcgccactacgccgagaagtacgaccccgagaacgtggacttctggggccaggtgggccttctccacgacctcgattgggagaagtggcaggacgaccagctccacaccgtcaagacggccgagctcctggaggaggtgggcgccgacccctacctggcgcacgccatccagacgcacaactccgacgtcaacaccgacctccccaagcccgaggccaagatggagagggtcctcttcgcgtgcgacgagctgtccggcctcatccaggcggccgcgcgcgtgaggccgtctggctccgtgaccgacatgccgctcaagtccctcaagaagaagttcaaggacaagcgcttcgccgccggctgcgaccgcgacgtcatccgcatgggcgcggagctcaacgggctcgagctcgacgacctgctcgccgaggtgctcgacgccatgaaggccatcgccccggtcggagatatctatgccaagggtgacgaggcggagggttccgccgagtagctctggccctcatggctccccatggcgaccacgtggacgcccgtctcccctgggaggcgggcgtcttcaatatcccgtgctgatgccagagctccctcgcgcgcctggcaatgcgaaaggtggagaagtgctcatagaagagcggtgcgcgtcgtgagggggcgagggcgcaacgccgccccctagccgtgaggaaggctcctctcggctaggggccaacgaaggggatgtccgcgcgagttgcccctccgcatgcttaaggatgtcggggcgaaagcaggattgggcgggcctatgcttaagaattcggaagcgcgtgcggattctcgccgctcccgggcgtacggacaccggcagaattaagcattcggcctccagattcgtccgagttccggcgttgttaagcgggtctgtctctccgttcgtgcgagcctcggaaaagttaagcattggacctcgtggcgtgcccccgtgccgccgccccccgccttgcgggtgcggtatccctcccaaatgcgggagacgtgcaaacagatcgcggggattgacctcacggggccttgggtaaacaccaacaagcaaacgtagggccgcctcgccccgccgggcggggacctgagggcggccgcaggactcgagggggtcatagcccgcatgttcgagaagttcacagacaaggcgcgcaaggtcatgagcctcgcgcaagacgaggcccgcaacctcggcaagatgtacgtgggcacggagcacctgctgctcgcgctcatcaaggagggcgagggcgtcgccgccaaggcgctcgccagcctggacgtcacctacgacgagacccttgccaccatcaaggagatctcgagcgaggacacccagcccgtctcgggtgggcacatcccgttcacgccccgcgcaaagcgcgtgctcgaggacgcctaccgcgagaccatggcgcgtggccagacctacatcgcgaccgagcacctccttctgggcatcgtctcggagggggacgggcgcgcgatgacggcgctgtcccgcatgggcgtgagcgccgacgccatccgcaacgccgtgaccgagatcgcgcagaaggagcagcccgactctggcaggcagtcggaccccacggcgggctttggcggccagttcatcggcgccggcatgcccagtgcgtcgagcgactcgtccgaggacgggtccatgctcgagcagtacgggcgcaacctcaccaagcaggcggcggacggggtcctcgaccccgtcatcgggcgcgaccgcgaggtcgagcgcgtgatgcaggtcctggcacgccgtcagaagaacaatccgctcatcctgggcgacccgggtgtgggcaagacggcgatcgtcgaggggctggcgcagcttatcgcctccggcaacgtgcccgacatcctgcgtggcaagcagatctggacgctcgacatggcgtcactcgtcgccggctccaagtatcgcggcgagttcgaggagcgcctgaagaaggtcatctcggaggtcatggactccaacgacgtgatcctcttcatcgacgagatccacactatcatcggtgccggctccgctgagggctccatcgacgccgcctcgatcctcaagccgcccctctcccgcggcgagatccaggtcatcggcgccaccacggcggacgagtaccgcaagcacatcgagaaggacactgccctcgagcgccgcttccagccggtgtacgtgggcgagccctcgcccgaggacacccttgccatcctccacgggctccagtcccgctacgaggagcaccaccacgtgcgctacaccgaggcggccctcgcggctgccgtgacgctctccaaccgctacgtgcaggaccgcttcctccccgacaaggcgatcgacatcatcgacgaggccggtgcgcgcacccgcgtgcacaagaccagcctgccccctgagctcgcccaggtggacgaggagctcgcccgcaccaaggaggagaaggacaaggccgcggacgcccaggagttcgaggaggcggcacgtctgcgcgacaaggagcgcgagctcacctcccgcagggacgacctcgaggccaagtggcgcgagaagatggacaagaacgtcgtggtcgtggacgagcccgacatcgccgacgtggtgagtgaggtcaccggcgtgcccgtctccaacctcaccgaggcggaggcgtccaagctcctgcgctgcgaggacgccctgcaccagcgcgtcgtgggccaggacgaggcgatctcggctgtctcgcgagccatccgccgcagtcgctcgcccctcaaggacccgcgccgtcccggcggctccttcatcttcctggggccgtccggcgtgggcaagaccgagcttgccaagtcgctcgccgagttcctctttggcagcgaggacgccctcatcagcttcgacatgtctgagttcatggagaagcacgaggtcagcaagctcgtgggcgcgcctcctggatacgtggggtacgacgagggcggcgagctcaccaaggccgtccgcaggcgcccctactcggtcgtgctgttcgacgagatcgagaaagcacatcccgacatcttcaacatcctgctgcagatcctcgacgaggggcgtctcaccgacggccagggccgcacggtcgacttcagcaacacggtggtcatcatgacctccaacatcggtgcacgcgagatcgcccagacctcgcccatggggttcagctcccagggcaacggcggcctgtccgacaaggagatcaagagcagggtcgagggcgagctcaagcacctgttccgtcccgagttcctcaaccgcgttgacgagatcgtggtcttcaagtccctcacgggcgagcagctgaggaggatcgtcgacctcatggtggtcgacctccgcaaccgtctggtgggccagggcatgtccatcgagctcaccgacgccgcgcgcgactacgtggccaaggagggcgccgacccggtgtacggtgcgcgcccgctgcgccgcgccatccagacgctcatcgaggaccctctcgccgagcagatgctcatgggcaagtggaaggccggcgacgtgatccaggtggacgccggggacgaggggctcaccttcgcccgtggcgagggcgagatccccagcgtcacggagcgcgtccacatggacctgccacgcgcccgcgaccactggtcgcccgcggcgccgtcgacggagggcagcgccgcctcgggcgcatagccccgagtttgtgggtcgcggagtcgtccgcgcgcgtcatatactgtgagtgacagtccggccggtccgcactgcgggccggccgatcatttgaagggggtagcatggacgcagctcgcaaggacgcccagccggcagacggctcggcgcgcctccgggaggccatcaagctcaccgctccggggaccgcgctccgcgtggcgctggacatgatcatcgccggtcacatgggcgccctcatctgcatcggcgatacggacaacgtccttgccgcgggggacgacggcttcaggctcgacatctcgttcaccgcaaaccgcctcttcgagctcagcaagatggacggggcaatcgtcatcgacaaggacctcacgcgcatcgtgcgggccaactaccacctcaaccccgatccctcgctccccacgagcgagacgggcatgaggcaccgcaccgccgcccgcatgagcctgctcaccaaggccctcgtcatctcggtctcggagcgccgccaggtggtcaacgtcttcgtggacggcaagggtcaccagctcaggtcggtgcaggagctcatggggaccgtcaaccagctcatggtctcgctccagtccaccaggacgcagctcgaccgcaacctgctgcgcctgaccaccctcgagctcgacaactacgtcacgctcgcggacatctcgcagaccatctacctgttcgaggtcctctccaccgttgccgaggagctcaacgagctcgtgctccagcttggcagctcgggcaagagcatcgccatgcagcgggacgagatcatgggcaacatggacgaagagtacacgctcctcgtgcgcgactacgcgtcagactccagcgaggagaacgcaagggcgatacgcgcccggctccataagacggacaaggaccagctcagggtgcccaagcacgtcgccgagatgctggggtacgatgacaaggacgaggactccatcatgacctcgctcggcctcaggacgctttcgagcatctcggtcgtgcgcgagggcatggcggacaagatcgtggacgagtacggctcgctccagcagctgctcgacgacatcgagcagaacccctcccgcctcgacagcctgggcgtcgacaaccccaacatcctcgccgacagcctgtatcgcctgtgggggaagcgggcatgagggagcggggcgcagccacgtgcacgtgcccggcgcgcgtgggggagcaaactcgggaggcagacacctgcgccgtcatcgttgccggcggggtcggccttcgctttggcgacccgaggggcaagcagtacgtcaccctctgcggcatgccgctcatgtgctggccgctcctggcgctcgaccgcgccccatccatcggccacatcgtgatcgtctgctcggacgagcgcaggggagaggtgcgtgacgccgtgctccccgcggtctcgctccggcatcaggtcaccctcgccccggccggtgccaccaggcaggactccgtgtacagcgggctccaggcggtaccctcgggattccagatggtcgcgatacacgacgccgcgcgcccgctggtgaccacggaggacgtggagacctgcatcgccgccctccgcaacgacccctcgctcggcggcgccatctgcgccgcccgcaccaccgacacgctcaagctcgtggaggggcagaccatcgtcgccacgcccgaccgcagctactactggaacgccctcacgccgcaggtgttcaggacggcgaccatcagggcggcgcaccgtgccgcgcggtgggacgcgtaccagggcacggatgacgcgtctctcatcgagcgcaggggcgggcgcgtgctctgcgtggagacctcgcgggcaaacatcaaggtcacggtcccggaggactacgtcatcgcccaggccctcatggagcgtcggctcatgtcggagggctgcgggctcgacgacgtggtcccccagggaggcgatgtgcaatgacgctcaggatcggccatgggtttgacgtccacgcgttcgccgaggggcgccccctcgtcctcggcggggtgcacgtcccctctcagcgcgggctcgagggccactccgatgccgacgtcgtcgcccacgcgctcatggacgccatcctcggcgccatgcgcgccggcgacataggggggctcttcccggacaccgacccagcctacgagggcgcggacagcatggtcctcctggcgcgggtcgcggaccttgcgcgcgagaggggatttcgcctcgtggactgcgactgcaccatcgcggcgcaggcgcccaagctcgcaccgtaccgcgacgccatgcgggagcgcatggcccaggcgatgggggtcgacccctcgcaggtgggcctctccgcaaccaccaccgagcgcctgggcttcgtggggagggaggaggggatcgccgcctgggcggtggccctcctcgagcttgatgagtgtaccggcggggcggtcccgcgctagcggggcggtcccggccaaacgccagaacgtcacacgtgcccccgggcgcacacacaagggagattcggatgctcgtctacaacaccaagtcacgtcgcaaagaggagttcaagcccatcgagccgggcaaggtccgcatgtacgtctgcggccccacggtgtacgaccagatccacatcggcaacgccaggaccttcctggccttcgacgtcattcgccgctacctggtgtacaagggctacgaggtcacctttgcgcagaacctcaccgacgtcgacgacaagatcatcaaccgcgccaacgagcagggtcgcaccgccgccgaggtcgccgacgagttcagcaaggcgttcatcgagcagatgcatcgctttggcatcctggaccccgacatccgcccgcgcgccacgcgcgagatcgaggccatgcaggagatgatcaagctcctcatcgagcagggcaacgcctacgtggcggacaacggcgacgtgtacttcagcgtcaggtccgacaaccactatggcatcctgagcggtcgcgatatcgaccagctcaaggtcggcgcgcgcgtggaggagaacaccgacaagcgcgacccgctcgacttcgccctgtggaaggccgccaagcccggcgagcccagctggcccagcccgtggggagacgggcgtcccggctggcacaccgagtgctgcgccatgatccaccgctaccttggcacgcccatcgacatccacggcggcgggcaggacctggtgttcccgcaccacgagaacgagacggcgcaggccatgtgcgcctggcacgccccgctcgccaactactggttccactcggggatgctgcgcgtggacggcgagaagatgtccaagagcctgggcaacttctacacgctcaaggaggtcctggacaagtatcccgccgatgcggtgaggctgctcatgctgcagacgcactaccgcgccccgctcgacttctcctacgaccgcctcgacggcgcggtgggcacgctcggcaggctctccggttgcgtcgccaacctgcgctgggcggccgagaactcgcccctggacggcgagctgaaccaggcggaccagaccctctcctccgccgtcaagcagacgatggccgagttcacggcccagatggacgacgacttcaacaccgccggcgccctcgcggcgatcttctccctcgtcgcagccgcaaacaagtacctggccgaggctgaggggaaggcgtcgaccgcggtgacgctgcatgcggccgacgccctcaccgagctgtgcggcgtcctgggcatcgacctcgagcgcgactccgccgagacgggcctcccgcccgagctcgtggacctcgccagggagcacgcgggctacgaggggtccgaccccgaggaggcggcgcaggcgcttctcgacgcgcgccagagggcccgtgccgagaaggattggggcacggccgacgccatccgcgacggcatcacggccctggggctcgtggtcgaggacaccgcggccggggcgcgtctgcgcgccggaagggagtagcgcatggcatcgcgacccaacggcaggggaggcaggcccggttcccgcggccaggccccccgtggcagacagggcggcaccaggcagggcaagggtgcgccctcccgtccggggaggggcgggcggccgcagggccgccgccaggacgcagggcgcccgcagtctccgcgccggggcggggtgccgcgtccgaccggcgacgtcgtcgagggcaggcgcgcctgcgcggaggccctggagacgggcgtccccatcaagcgggcgctcatctcgcccggccccgacgcagaccaggcgctctcgtcgctcgtgaggaggctcgacgaggcgggcgtccccatcgagcgcgttcccagggcgcgccttgactcgctcagctcgcacggcgcccaccagggcatcgtgctccagaccaagcccttcgaatacgcggagctcgacgaggtcatagcaaacgccggctcgggagacgcgctcgtgctcgtgctcgaccacgtcaccgacgagggcaacttcggcgccatcgtgcgcagcgccgaggtcgtgggcgccgcgggagtcgtgattcccaaggctcggtccgcacgcgtggggacggccgcctacaagacctccgcaggtgccgtgctgcaccttcccatcgcgcaggtgccaaaccttgccacggcgctcgacaggctgaggaaggcgggcttctgggccgccgcggcgagcgagcacgccgatcaggacgtgtgggacgccccgctctcgggacgcctcgccctcgtcatggggtccgaggggtccggcgtgtctcgtctcgtcatggagcactgcgacttctcctgccgcctcccgcagcgcgggagcgtggagtccctcaacgtggcgcaggctgccacggtcctctcgtacgagtggctcaggcgcgtcacgaggggggagggcgcggatgcctgagtctgccaggggcgagctgctcgtcgtggacggctacaacgtcatcttcaagtcgtctcggtacatgggccaggtggacgagggggacgccgacgccggggaccccttcgaccgggcaagggagctgctcgtctcggacgtggcaacctacgcccagggcaggtacgagcccgtcgtggtcttcgacgccgccgggaacctctcgcccgagcgccccgacctcagcacggcgggcgtgcgcgtcgtcttctcccagacgggggagagcgcggactcggtcatcgagaggctggtcacggagtcacgccaccagatgcgcagcgtcacggtcgtgacgtccgacaacaccatccgcgccacggtgggcggaattcccgttaccaggctctcgagcgacgtcctggcggcagacattaacgtgctcgcagacgacgtcgagacggcaaggtcagagaggtcgcaccagcgcctcacggtcgaggaccggctctcgcccgaggacagggagaagctctgggccctcatgggcaagcgggggtccttacgctagaatgcgtacccaggctggcgtagctcagttggtagagccctagtcttgtaaactagttgtcgccggttcgagcccggccgccagctccagcgcagtcaaggccacggcacatcgccgtggcctttttcctgtcttggcgacgttgcgggaaagtgtgcaagaagaatttttcaccaacctccagcccgcccaccgcaaaagcgttcacgccttcgcaaaaatatgcacctagctgggcatgtgcaggaatcgtggggaggatacgcccggctgcgtggaaacgattgacatccccacccccacgtcgtaagattcactccgcttgcaagggacaacacccaagcaggcaccttgaaaatttggaatggggacgtggcacagcggcaactgcggcggactgtaaatccgctccctctgggttccatggttcgagtccatgcgtccccaccattccaggcccgtgtagctcagtcggtagagcacttcgttggtaacgaagaggtcaccagttcgaatctggtcgcgggctccattttcaagacggcaccacgccggtgtagctcagctggttagagcacgcggctcatacccgcgatgtcactggttcgaatccagtcaccggtaccaggagttctagcggcccgtcactgggccgcttgacatataagggcacaatggccgagaggttgtttcttaaggaggacggcaatggccaaggagaagttcgatcgtagcaagccgcacgtaaacatcggaacgattggtcacgtcgaccacggcaagaccacgctgaccgcggccatcactaaggtcctttccgagaccgagggctgcaaggccaagtacgaggccttcgaggacatcgacaaggctcccgaggagcgtcagcgcggcattaccatttccgtcgcccacgtcgagtacgagacctgggagcgccactacgctcacgtcgactgccccggccacgccgactacgtcaagaacatgatttccggcgctgctcagatggacggtgcaatcctcgtcatcgcagccaccgacggccccatggctcagactcgcgagcacatcctcctcgcccgtcaggtcggcgttaagtacatcgtcgtcttcctgaacaagtgcgacatggtcgacgacgaggagctcatcgacctcgtcgagatggagacccgtgacctcctgtccgagtacggcttccccggagacgacatccccatcatccgtggttccgctctcggcgccctcaatggcgagcagaagtgggtcgactccatcatcgagctcatgcacaccgttgactcctacatcccgaccccgccgcgtgacaacgacaagcccttcctgatggccatcgaggacgtcatgaccatctccggccgtggcaccgtcgttaccggccgtgtcgagcgtggtgagctcaagatcaacgagcccgtcgagatcgtcggcatccgcccgacccagacctccactgccaccggcatcgagatgttccgcaagacgctcgacttctgcgaggctggcgacaacgtgggcatcctgctccgcggcatcaagcgcgaggacgtcatccgtggtcaggtcctctgcaagcccggcagcgttaccccgcaccagaagttcacgggcgagatttacgtcctcaccaaggaggagggtggccgccacaccccgttcttctccggctatcgtccccagttctacttccgcaccaccgatgtcaccggtgacatcaccgagctcaccgacaaggacggcggcaaggtcgagatggctatgcctggcgaccacgtcaccatcacctgcgagctcatccaccccatcgcaatggagcagggccttcgtttcgcaatccgcgagggtggccacactgtcggcgatggccgcgttgccaccatcatcgactagcctcagggctaactagtcactaacaaaagggcccggtgcctcacagaggcatcgggccctcttgtgtcccgagagggcgatcggcaaagcagggcgagccgctttctcgcctacttgttttgatggttttgttgagggcccctaccaacgcgtccacctgttgacacaagtgggcagtggatggtagcgtattccatcgcgtcgccgttgcattggtcttacggcggcagactacaggaggatcaatgcgtacactggttacccttgcatgcaccgagtgcaagcgccgcaactacaccacgacgaagaacaagtccaatactcctgaccgtatggagctgaagaagtactgcccgtggtgccgcaagcataccctacacaaggaaacgcgctaaagtagggtaacaacacaggccagtagctccaatggtagagcggcggtctccaaaaccgtttgttgagggttcgagtccttcctggcctgccagctaacaccaccggctttcccttcggggttagccggtttctatgaagagcgtttttaaggggtacgagggatggcgaagaaagagcgtcagaagagaagcgcacgccaggcacgccagcgcgagcgtgaggagcgcgaggccgcccaggcggttaccgccgagaaggcggacaaggcttccaagaagggtgacgccgtcgctgcttctggtaccgccaagaaggagacgaagcctgccaaggccaagaagcccggcaggattcgctcctacttccgggaggtccgctccgagatgcgtcgcgtggtctggcccagcaggcaggagacccgcgattactcggttgccgtgattctcatgctcgtggtcttcgggctcgcggtgtgggcggtcgacaccggcttcatcagcctgctcatcggtttcacgggcctgagggggtagagatggctaagcactggtacgtcgttcacacctactccgggtacgagaacaaggtcaagaacgacctagagcaccgcatcgagacctatggcctcgaggaccagatcgtcgacatccagattcccaccgaagaggtcaccgagatcaaggatggcggcaagagggagaccaaggagaacaaggtctttccgggctatgttctcgttcgcatggagctgactgacgacacgtggtcggtagtccgcaacacgccgggcgtgaccggctttgccggcaccaacggcagcaagcccacgtatctgcgtatctccgagttcaacaagatcatgcgcaagaccaaccgccgtggtgcccagggtgcccccaagcgcaccatgaccaccacgaacctcgaggcgggtcaggcaatcaaggtcgtctccggccccctggccgacttcgacgggaccatctctgaggtcatgcccgagtccggcaaggtcaaggtcatgctcaccatctttggccgtgagactcccgtcgagctcactctcgaccaggtgaccacgatcgcctagagttccatcggccccgtaatcggtgaggattgcttctcggggccggttatcgatagcaaacagcaccccatccccagcacgtcaggagagacagatggcaaagaagaaggtcgtccacttcatcaagctccagattccggctggcgcagccaaccccgcgcctcccgttggccccgccctgggcgccgcgcaggtcaacatcatgcagttctgccaggccttcaacgctgcgaccaaggataaggccggtgacatcatccccgtcgagatcacggtctacgaggaccgcaccttcgacttcatcaccaagacgcctcccgcggcccagctcatcaagaaggagctcggcatcaagagcggctctggcgttccccagcgcgacaaggtcggccagctcacccaggagcagctcaccaagatcgccacgatcaagcttcccgacctcaacgccaacgacatcgaggccgccaagaggatcgtcgccggtaccgcccgctccatgggcgtcaccatcgccgagtagcgcacgccacccggtaacgtctacgtgggagggcatcagcccgcttgaccacataggaggaagaaatggcaaagcacggcaagaactaccgcgacgccgagaagaagcttgaggagggcaaggcgtactcccccaaggaggccctcgctctcgtcaaggagctctccagcgccaagtttgacgagaccgtcgaggtctccatccgcctgggcgtcgacacccgcaaggccgaccagaacgtccgtggctccatctccctgcccaacggcaccggcaagcaggtccgcgtcgccgtcttcgccgagggcgccaaggccgaggaggccaaggccgccggcgctgacatcgtgggctccgacgagctcgtcgccgaggtccagaagggcaacatcgacttcgacgcagtcatcgccacccccaacctcatgggcaaggtcggtcgtctcggccgcatcctcggcccccgcggcctcatgcccaaccccaagctgggcacggtgaccatggacgtcgagaagatggtcaaggagctcaaggccggccgcgtcgagtatcgtgcggaccgctacggaatctgccacgtgcccctgggaaaggtgtccttcacccccgagcagctcaccgagaactacgctgctctctacaccgagatccttcgcgtcaagccgtctgcctcaaagggcaagtacgtgaagagcgtcgtcgtctcctccaccatgggccctggcgtcaaggttgactccagcgtcacccgcaacttcctcgaggcctaggccaacgggcaatgcgcatgaggggccgttccgttttgcgggacggccctttcttcatctgtggagccggtgtcaagattccttttggggaggaggcaccgttgcgtctcgcttgacaggcgtccgagcggctggcacaattcatatgctcgaaagggcgtacgtcacaactgcacgtccgctgccaaagacagccggtgccgcaaggctcaatggggtttcccgcctgccgaggtggtctgagattgattccctgaccccgctttggctgcgcgccttgcggggtcttttgctaaggcccgccagcgtcggcggttcgtgccctagcgcaacagggaggtgtacatatgccagcacagtccaagatcgacatgctcgagaagatcaacgagaccctcggtgcaagcaagggcgtgttcttcatcgactaccgtggactcaccgtcaaggagaccgaggcgcttcgccgcgacctccgcgatgccggtgcgcacatgaaggtctacaagaacaacctcgtcgacatcgccgtgaagaacgcgggcctgcccgacgtgagcgacaagctcaagggcaccatcgcctacgtcttctacgagaacgaccccgtcgaggccgccaaggtcatcaagaagcactccgaggccctcaagaagatcgagtgggtcggagcgattgccgacggccaggcactcgacgccgagggcgccaaggcctacgccgagctcgcgtctcgcgaggagctcatggcgcagctcgtctacgtcatggccagccccctcacgggcatcgcacaggtttgcgccggtcccgcgcgtggcctcgccaccgcgcttcaggccgtcgtcgaccagaagaacgctgcctaaggccgcgtgattcaaggcaccacaagcaagaagttgtaggggcaccaagcgtgccccccgaaaaaggagaattgacatggctgtcaccaaggatgagatcatcgaggccctcaaggagatgcccgccctcgagctttccgagctcgttcacgagctggaggacgtcttcggcgtctccgctgccgctcccgttgccgttgccgccgctcccgcggccggtggcgctgccgccgaggaggaggagaagaccaacttcgacgttgagctgacctccttcggctccaacaagatcgccgtcatcaaggtcgtccgcgccctcaccaaccttggcctcaaggaggccaaggaggccgtcgagtctgcccccaaggtcatcctcgagggtgcctccaaggaggacgccgaggctgccaaggccaagctcgaggaggccggcgccgaggtcaagctcaagtaactcgacttccacaggctgtttcagagaggggtcggaccagaggtccggccccttttttctgcctctggttccacgctgcgacaggggtctcagaggacatttcacagggtgaacacaagggcaatttcccaaaccgcaggtagggggtaccggcctgcccatacaaaataacgtagccaatgtcaagactttatcattgaccgaggttgagcgtttcggtaccttattagattgcgacaactgccgcttttaaacgtagaaggaggaagtgcctggtgcctaccgcaaagtcttcccaagctgaaacgcaggagcagcgtcaccgcgtgagcttcagcaagattccgcccgcaatggagctgcccaacctcatctcggttcagaaggagtcgttcgagcacttcatgggcgagggtctggcagactcgttcgccgagttctccccgatcgagaactccgccaagaccatggaggtcacctttggcgaccaccagtttggcgacgcccccaataccatagccgaatgccgcgccaaggacatctcctatcaggccccgctcttcgttgacgtccgcttcgtcaacaaggagacgggcgagatcaaggagcagctcgtcttcatgggcgacttcccgctcatgaccaaccgcggcacctttatcatcaacggcaccgagcgcgtggtcgtctcgcagctggtccgctcgccgggagtgtacttctcctccgagctggacaatggcgtgcaggtccaccacgtccagttcatccccgctcgcggcgcatggctggagtttgaggtggacaagcacggccacctggtcgtctccatcgaccgcaagcgccgccagaacgccacgctcttcctccgcgccctcggcatcgccgagtccgacgacgagatcatgaacctcctgggcgactcggacgtggtccgctccacgctcgagcgcgacaccgccaccaccagggaggacgccctcatcgagatctaccgtcgccagcgccctggcgagccccccaccgtggactccgcaaaggccctgctcgacggcctgtacttcaacaaccagcgctacgacctcgcccgcgtgggccgctacaagatcaacaagaagctcggcctcgacgccgactcgcagcagcgcgtgctcactagcgaggacatcgtcaccgcgcttcgctacctgctggcccttcacgagggcgatcctaccaagaagctcgacgacatcgaccactttggcaaccgtcgcgtccgcacggtgggcgagctcgtccagaaccagttccgcatcggcatgagccgcatggagcgcgtcatccgcgagcgcatggcctcgcaggacgccgacgacatcacgccgcagtcgctcatcaacatcaggcccatcgtggcggcaatcaaggagttctacggctcctctcagctgtcgcagttcatggaccagtccaacccgctcgccggcctcacgcacaagcgccgcctgtccgcgctcggccctggcggccttgccggccacaagtccggctccagccgccgcacgaacgtccccacggccgttcgcgacgtccacaactcccactacgcgcgcatgtgccccatcgagacgcccgagggacccaacatcggcctcatcggctccctggcgctgtatgcgcatgtcaacgagtacggcttcatcgaggccccgtaccgtcgcgttgtggacggcaaggtcaccgaccagatcgactggatgaccgctgacgaggaagagaaccacaacatcgcccccgccaacgtccccatcgaccccaagacgggccactttgtcgccgttgacgcaaagggcaacatctacaaccccgagacggttgtcgcgcgtacgcgcaacttcgatggctccttcggcgcccccgcccaggtccccgtcgagtccgtggactacatggacgtctcgcccaggcagctcctctccgtcgcggcaaacctcatcccgttcctggagcatgacgatgcaaagcgtaccctcatgggcgccaacatgcagcgtcaggcggtgcccctgatcaagtcgcacgctcccgtggtcggaaccggcctcgaggcccgcgccgcacaggactccggcgagctcatctgcgccgagcacgacggcactgtcgtcgaggtcgacgcggcccacgtggtcgtcaagaccgtgggtggcgacctcgagcgctacgacctgcccaagtacgagcgctccaaccagagcacctgcatcaaccaccgtcccgtggtccaggtgggccagcacgtgatccagggccagccgctcactgacggcccctccgtcgatcacggcgagctcgcgctgggcaccaacctcaccgtggcgtacatgccgtgggagggctacaactacgaggacggcatcatcgtctccgagcgcgtggtccaggacgacctcctcacctccgtcaacatctcgcgtcacgagatcgacgcccgcgacaccaagctcgggcccgaggagatcacccgcgagatccccaaccagagcgaggacatgctcgccaacctggacgacgacggcatcatccgcatcggcgccgaggtcggccccggcgacatcctagtcggcaaggtgacccccaagggcgagaccgcgctcaccgcggaggagaggctcctgcgcgccatcttcggcgccaaggcgcatgacgtgcgcgacacctcgctcaagatgccccacggctcctatggccgcgtcgtcgacgtggtgcgcttcagccgcgaggccggcgacgacctgccgcccggagtcaacgagctcgtgcgcgtcttcgttgcgcagcgccgcaagatccagcagggcgacaagatctccggccgccacggcaacaagggcgtcgtgtgcaacgtgctccccatcgaggacatgccctacatggcggacggcacccccgtcgacgtccttctcgacccgctgggcgtcccctctcgtatgaacgtgggacagctgctcgagtgccaccttggctgggcggcctcccatggctgggacgtggacgaccccgactccaagaaggtcgtggacggccccatgtacgtctccacgcccgtctttgacggcgcgaccgacgaggaggtcaaggaggccatccgccgcaccaacatcaacctcatgaacaaggccatgcgcgagtacggcgagcacaccaaggccgagttcgtgccccagctcaacgagcagggcaagaccaccctgtacgacggtcgcaccggcgaggccttcaagagccccatcaccgtcggcacgagctacatcctcaagctgggccacatggtcgacgacaagatccacgcgcgttcgacgggcccgtactccctggtcacccagcagccgctgggcggcaaggcgcagttcggcggccagcgcttcggcgagatggaggtgtgggcactctacgcgtacggcgcctccaacgtgctgcacgagatgatgaccatcaagtcggacgacaccaccgggcgcgtcaagtcctacgaggccatcgtcaagggcgagaacgtccccaggccgggcatccccgagtccttcaaggtccttgtcaaggagatccgctccctggcgctggacatcgagcccatctcctataagaaggaggaggccaagcagaaggacgaccagcccgagaagagcgcggtcgacgtgtttgccggtgcggacagcgccgacgacctcatcggcgagatctctgccggcggcgagagggaccaagccctcgccggcgaaaccaccaacgataaggagtagcgaacgtggcagatttcgataccaccgatttcgacgctataaagatctcgctcgcctccgcagacgagattcgcagctggtcgcacggcgaggtcaagaagcccgagaccatcaactaccgcaccctcaagcccgagaaggacggtctcttctgcgagaagatcttcggtcccaccaaggactgggagtgcgcctgcggcaagtacaagggaatccgcttcaagggcatcgtgtgcgagcgttgcggcgtcgaggtcaccagcgccaaggtccgccgcgagcgcatgggccacatcgagctcgccgctcccgtgagccacatctggtacttcaagagccctgcgaccttccccctggcccgcctgctcgacatgaagagcaaggacctggagaagatcctgtactttgcctcctacgtcatcaccagcgttgacgcggaggcccgcgaggctgacgccgacgacctcaaggaggagctggccgccgacctcgaggagctcgacgccgagcgcgacgacgagatcgagcgcctcaaggcccagggcgagcccgccgaggatggcttcgacgacgtcgagcccctctcgcaggacgagatcagggccggcatcgtcgacctcgaggaggagtacgaggaggagaagcagctccgcaaggacgccttcgataagttcatgagcctggaggagcgcgagctcatctccgacgagcagctcttctccgagatgcgtcgctattactccatctacttcaagggcggcatgggcgccgaggccgtccgcgagctccttcgcggcatcgacctgggcgaggaggccgaaaggctccgcggcatcatctcgtccgaggactcccagaagcagaagaaggagcgcgcggtcaagcgcctcgagatcgtggacgccttcctgcagggcggcaacgaccccgccaacatgatcctagacgtcatccccgtgatcccgcccgacctgcgccccatggtgcagctcgacggcggccgcttcgcggcgtccgacctcaacgacctctaccgtcgcgtcatcaaccgcaacaaccgcctcaagaggctgctcgacctcgacgcccccgcgatcatcgtcaacaacgagaagcgcatgctccaggagtccgtcgacgccctctttgacaacggccgtcgcggccgtcccgtcaccgggcgcggcgggcgtcccctcaagtcgctcgccgaggccctcaagggtaagcagggtcgcttccgccagaacctgctcggcaagcgcgtcgactactccggccgttcggtcatcgtcgtcgacccgcacctcaagctgcatcagtgcggcctcccctctgccatggcgctcgagctcttcaagccgttcgtgatgcgccgcctggtcgaactcggcaaggtggagaacatcaagggtgccaagcgcgccatcgaccgcggcgcccccgcggtgtgggacgtccttgacgaggtcatcaagggccgtctggtcctgctcaaccgcgccccgaccctccaccgtctgtccatccaggcgttcgagcccgtcctggtcgagggcaaggcaatccacctgcacccgctggtctgcgcgccgttcaacgcagacttcgacggcgaccagatgtccgtgcacgtgccgctgtccacccaggcgcagaccgaggcccgcgtgctcatgctctcgagcaacaacctgcgctccccggcatccggcaaggtgctcaccgtgccctcccaggacatggtcttcggcgtgtacttcctgaccacagagaaggacgccctcaagggcgagggccgcgtgttcgccagctttgacgacgcgctgctcgcgtacgacgagcttgccggcgtcgacatccaggccaagatctacgtgcgcgtctctgccgcggacgcaaacctggagaaggacggcagaaagtacttccgcgtgaggcagggcaagtccgacttcgaggacttcgacgtcacggacggcaccgtgcgcttcgagaccaccgtcggccgcgtgatcttcaaccgccagtgcctgccgcacgactacccgtacatgaactacaagatggtcaagggcgacatcgccgccctggtcaacgactgctgcgaccgctacagcacctctgccgttgagcccatcctggacgccatcaagcaggtgggcttccactacgccacccgcgcgggcctcaccatctcggtgtgggacgccgtcatccccgacgacaagccccagctcctggaggaggcgcagggcaaggtcgacgagatcaacgagtactacgaggacggcttcctgtccgagagggagcgccacgccgaggtcattaacgcctggacggagtgcaccgacctcctgggcaccgagatgctccagggcttcgccgaggacaaccccatctacatgatggccgactccggcgcccgtggctccaagacgcagcttcgccagctcgccggtatgcgcggcctcatggccgatatgtccggcgacaccatcgacctcccaatcaaggcaaacttccgcgagggcctgcagccgctggagtacttcatctccacctacggcgcacgcaagggcctcgtcgacaccgcctcccacacctccgactccggatacctcacccgtcgcctggtcgacgtcgcgcaggacgtcatcgtgcgcgaggaggactgcgggaccgacgaggccgtgacctacgacctcatcaagccgggcgagacggacgtggataccgacctcatcggccgctgcacgctccacgacgtcatcaaccccaccaccggcgaggtcatcatccccgctggcggctacgtggagtcgaaggacgacctgcagcgcatggtcgatgccggcctcaagaaggtcgagctccgcgccctgctcacctgcaagtccaagtacggcgtgtgccagaagtgctacggctgggacctctccacccgtcgccccgtcaacatcggcacctcggtcggcatcatcgccgcccagtccatcggcgagccgggcacccagctcacgatgcgcaccattcactccggcggcgtcgcgggcgctgacgacatcacgcagggcctccccacggttgcccgcatgttcgacgtcgtcggcaacgtcaacgagaagatcctcggccgcgaggccgacctcgcaccggtctcgggcatcctgcgcatcacgcccgagcagtccgagtacctgatccagatcaaggacgccaacgacgagtctcgcatcgtcgccgagtggcgcgtccccgcgtccgtgcgcttcatgccgggcttcgaggacggctgcgaggttcgtgcgggcgaccagatcacccgcggcttcgtgaacttccgcaagctgcgcaagctcaccgacatcgagtcgaccatgcacacgttcgtcaagtccgtcaaggacgtgtacacctcgcagggcgtcgacctcaacgacaagcacatcgaggtcatcgcgcgtcagatgctgcgtcgcgtccaggtgaccaaccctggcgactccacgtacctcctcggccagtacgtcgaccgctacgtgttcgcggagaccgtgcgcaacatcgcgctcgccggtggcacgccccccgaggcggagcccgtcatcctgggcacgctcaaggtcgctagctccatcgactcctggctgtccagcgcctcgttcatccgcaccgccggcgtcctcaccgagagcgccatcaagggcgaggtggaccacctgctcgacctcaagtcgaacgtcatcgtgggcaagaagattcccgctggcaccggcctcaaggcctacgacgacgtggagctcacctaccacggccagaagatcgacggccccacctccccgctggctaagagcctgcccgagtgggcgcccgacgagctcaagggcatcgaggagcagctgcccaagcagctcgactggatcggcgacgactacggctatggcggggtgtactccaagaacggccgcacgctctccagcgaggacgcgaagctgtacctgttcgacgacctcggcgtctcgcagcgttggaccaacaagttcagcgaggtgggcatcgagacggtgggcgacctcatcggcaagaccgaggacgacctccttcgcatcgacggtatcggcgccaaggcgatcgaggagcttcgcgagggcctcgaggcccgcaacctcctctacatcctcgagcccgacgaggacgaggccgacagcgaggacctctcccagctacttaacatggtcttctcgcctgatgccgacaacgacatcatgctggggaccgcggcgccggccaagcacgactccgccggcgacgacgagctcatcggcgcgccctccacggacgacgccgaccagggccaggtcatcaacgaggacctgggctccctgcacgacctcctctcgcaggtcgagaagaacgaggcctccgaggacggcgagtagcgtcccggtggacacgtaaggtaggaaggggaggccccatcaccgccagggtggtggggcctctctgcatccgggccacccggcccggcagaaaggggtgtgccgatggcaggcatggacgacgacatgtgccccctcgaggagtacctggcaaacgacgacgtcgtgtacagcgcgacgcagatattcgatgccctcagcgactccaccaggtttcagatcctcggggtcctcacccggggcgacagggcggtgggggagctcaccgaggtctgtcacgtgtcgcagagcgccatttcccaccagctccgcctgctgagggaccgtggcctcgtcgcgtctcggcgcgagggccagcgcgtgatctactcgctcgcggacgaccacgtgaggatgctcatccgcacaggccttcagcacgccgccgaggaggtcacgcccgccgagtaggctgcgagaccatctgtgtgcgtggcgtgtagaggggatacgcccggtaccgtggttttttgacaactgcgaaatgcgcgcgtaatctgcaacatcggcttgttttgggcgtgaacgtgcgcacacaacgatccagggcgtcggtgctgaggcgtccttgacacataggtgctcgcgcaccaccaaccgtacgtctcaagaaggagagaagctttgcctaccatcaaccagctcgtccgccagggccgcgtttcccacaaggccaagtccaagaacgcagcactgcagcacaacccccagaagcgtggcgtgtgcacccgcgtcttcaccaccacccccaagaagcctaactccgcactccgcaaggtcgcccgtgtgcgcctcgtcaacggcatcgaggtcacggcctacatccccggcgagggccacaacctgcaggagcactccatcgtcctcatccgcggcggccgcgtgcgcgacctccctggtgtgcgttacaagatcatccgcggcgcctatgactgcgcggcagttcaggaccgcaagaaggctcgctcccgctacggcgccaagcgccccaaggagtaggcacttcccaacgtctgaattagctctcgaacattaggagatacaacatgccgcgtcgtgcagcagcagtccgtcgcgaggtcactcccgacgccgtctacaacaaccgtctcgtgacccagctgatcaacaaggtcctcctcgatggcaagaaggccaccgccgagcgcatcgtctacggcgccttcgacatcatcaaggagaagaccgagcaggatcccgtggccgtcttcaagaaggccatggacaacgtccgccccaccctcgaggtcaagcctcgccgtgtcggcggcgccacctaccaggtgcccatggaggtcaactcccgtcgtgccaccaccctcgccatccgctggatcgtcaacttctcccgcgcccgcaaggagaacaccatggcccagcgccttgccaacgagctcatggatgccgccaacggcgttggcgcgtccgtcaagaagcgtgaggacctcttcaagatggcagaggccaaccgtgcgttctctcactaccgtttctagttcgggacacgaggagtaaccacacatggcaaaggttaagtacaagctggaagacctccgcaacatcggcatcatggcccacatcgacgctggtaagaccaccacgacggagcgcatcctctactacaccggcaagacgcacaagattggcgaggtccatgacggcgctgcgaccatggactggatggtccaggagcaggagcgcggcgtgaccatcacctccgcggccaccacgtgcttctggaaggaccacgtcatccagatcatcgacacgccgggtcacgttgacttcaccgccgaggtcgagcgctgcctgcgcgtcctcgatggtgccgtcgccgtgttcgacgccgtcgccggcgtccagccgcagtccgagaccgtctggcgtcaggccgccaactacggcgtcccccgcatcgccttcatcaacaagtacgaccgcgtgggcgctgacttcttcaacgcgatcgagaccatgaaggaccgtcttggtgccgtcgccgtcgcggcccagatccccatgggcgccgagtccaacttctggggcctcatcgacctcgtcaccaacaccgcgtgggacttcaaggaagacgccaagggcatgatctaccccgagcccatggacgagattcccgacgagttcaaggaccttgccgctgagaagcgcgaggagctcctcgacgcggcctccaacttcgacgacgagctcatggagctcatcctcgaggagaaggaggtgcccgtcgatctgctcaagaaggccatccgcaagggtgtcatcgccaacgagctcaaccccgtcttcgtgggctccgcctacaagaacaagggtatccaggagctcctcgacgccgtcgtggactacctccccagcccgctcgacgtcaaggagatcgacggcaagaacctcaagggtgagcccgaggtccgtcacgcggacttcaaggagcccttctcggccctcgccttcaagatcatgaccgaccccttcgtcggcaagctcacctacatccgcgtgtactccggtcaggcggaggcgggcagctacgtctacaactccgtcaaggacggccgcgagcgccttggccgcatcctcgagatgaacgccaacgaccgcgtcgaccgtgacgagtgctccgccggcgacatcgtcgcctgcgtcggcctcaagaacacctccacgggcgacaccctgtgcgacgagaagcaccccatcgtgctcgagtccatcgacttcgccgaccccgtcatcgacgtcgcggtcgagcccaagtccaaggccgagcaggacaagatgtccgttggcctcgccaagctggccgaggaggacccgaccttccgcgtccacaccgatcatgagaccggccagaccatcatcgccggcatgggcgagcttcacctcgagatcatcgtcgaccgtctgcgccgcgagttccacgtcgactgcaacgtgggcaagccccaggtcgcctatcgcgagaccgccggtcacgccgtccagcacgtccagggcaagttcgtccgccagtccggtggccgcggccagtacggcgacgcgatcatcgacatggagcccatggagcccggctttggctacgagttcgttgacgccaccgtcggcggcgccatccccaaggagtacatcccctcggtggacaagggcatccaggaggccctcgagagcggcgtcatcgccggctaccccgtccaggacatcaaggtgaccctggtcgacggctcctaccacgaggtcgactcgtccgaggccgccttcaagatcgctggctccatggccatcaagaaggccctgcaggagtccgaccccgtgctcctcgagcccgtcgagcaggtcgaggtcgagacgcccgagcagtacatgggcgacgtcatgggcaacctctctggccgtcgcggcaagatcgagggcatggaggatcgcaagaacaccaagctcatccgtgccaaggtgcccctgggcgagatgttcggctacgccaccgaccttcgctcccagacgcagggccgcgcctcgtacaccatgcagttcgactcgtacgagccggttcccaagaacatccgcgagcagatcgtcgccaagaacggcgggaacgagtaagtaacgtagccaacggcggcgcggccgacaccgcgccagcccatcgatggaggtattacaagtgtcaagccagaagatcaggattcgcctcaagggctacgatcacgaggtcgtggatcagtccgcgaagctcatcgtcgacaccgcccagaagaccggtgcccgcgtttccggccccatccccctgcccaccgagcgcaacctctacacggtcatccgctccccgcacaaggacaaggactcgcgcgagcagttcgagatgcgcacccacaagcgtctcatcgacatcctcgacccctccagctccacggtcgactctctcatgaggctcgacctccccgccggagttgacatcgagatcaagctctagaacctaaggcaaagtcgttctggaagcctcccgcgccgcgggaggcttccttcgtttgtggggtccatttccgggcgagtccatggctttacgtgggaaattgttgtttcattgtgaacacggtcccgggagtgtacactagtcaagctgcctcgattacgggacacttgtgtgccttgtggtcgggccaatgtcagatgtggtccgctgggggagggcaatgggttgcccgtcggtcccatgaccaccgagggttaggaaagagcatggtcagcacgattcttggccgcaagatcgggatgacgcaggtctgggacgagaacgacaacgtcgtccccgtgaccgtcatccaggccggcccctgcgtcgtctcgcaggttaagaccaaggccacggatggctacgacgccgtccagattggctatggcgacatcacttccaagcacgtcaacaagcccatgcaggggcacttcgacgcccacggcgtcgcccccatgcgcttcctgcgcgaggtccgcgtcgagaacggcgaggagcacaactgcggcgacaaggtgaccgttgctgacttctccgaggtcaaggctgtcgacgtcactggcacctccaagggcaagggcttccagggaaccatcaagcgctggaacttcgcctgcggccccatgacccacggctctcgcaaccagcgcgagccgggctccatcggccagtgcgcgtatcccgcgcgcgtccgcaagggccttcacatgtgcggccacatgggcaacgagcgcgtgaccgtcaagaacctcaagctcgttcgtgtcgacgccgagcagaacctcctgcttgtcaagggcgcggtccccggcgcaaagaacgccttcgtctccgtccgcatggcctaagggcccagcacgaccagaagccccaaggctaacaaggaggacagaatgtccaagatcgaagtaaagaacgttgaggggaaggcgaccggagaggtcgagctccccgacggcgtctatggcatcgagcctaacatccccgtcgtgcaccgcgtcgtggtggcctacgaagcctgccagcgccagggcacacactctaccaagaaccgcaagcacgtctccggtggtggcgccaagccgttccgtcagaagggcaccggccgtgcgcgccagggcaccattcgcgccccgcagttcaggggaggcggcgtcgtcttcgggcctacgccccacagccacgccctccgcgtcaacatcaaggagaagaagctcgccatgcgctccgtgctctccggcaaggtcgcagactccgagctcgtgctcgtcgagggcatgcagtttgacgcccccaagaccaagcaggccgtctccgcgctcaacgcgctcggcctctccgacaagcgcgtgaccgtcgtggtccccgacgacgacgtcaacacgtacctctccttccgcaaccttcccaaggtcacggtcgtcggccgctccgaggccaacacccgttacctcatcgacaacgccgctctcgtgatgtctcccgagatcgccaagttcttcggggaggtgctcgcataatgaactccgtctacaacgtgatcgtccgcccggtcatctccgagcgttccttcgacctcatggcgcagaacaagtacaccttcgaggttgcccgccaggccgccaagggtgagattgccgatgcggtcgagaagctcttcaacgtgcacgtcgagaaggtcaacaccctctgggtcaagcccaagaacaagcgcgttcgctaccagtacggcaagacccgtacctggaagaaggccgtcgtcaccatcgccgatggtgagcagatcgagatctttgctaaccagcagtccgacgaggactagctagtatttggttgcccgagcctcctccgggaggccgggcaaccatgccgcgcactagggatacgcgcggtaccgtggtaatccggtgtcgtctcaccggggcccttggccccattccctgagcgagacggccaacggaaaagaaagggaaacgcaatgggagtcaagcacctcaagcccacgagcgcgggccgtcgttggcagaccgtctccgacttctcggagatcaccaccaacaagcccgagaagtcgctcctcgagcccctgcccaagaaggccgggcgcaacaacaacggccgcatcaccacccgtcaccagggcggcggccacaagcgcatgtatcgtcgcatcgacttcaagcgccgcaaggacgacgtgcccgccaaggtcgctaccatcgagtacgaccccaaccgcagcgcacgcatcgcccttctccactacgttgacggcgccaaggcctacatcctcgcgcccgagggcctgcacgtcggggacaccgtcatctctggcgagaaggacatcgacatcaagcccggcaactgcaccacgctggcccagattcccgtgggcacgctcgtgcacgccgtcgagttccagcccggccgtggcgctgcgatggcccgcgccgctggcacctccgtccagctcatgggcaaggacaacggctacgccgtcctccgcatgccctcctccgagctgcgccgcgtgctcctcacctgccgcgccaccatcggcgaggtcggcaacgccgagcacagcaacatcgtgatcggcaaggccggtcgtcaccgctggatgggcgtccgcccgaccgtccgtggtacggtcatgaaccccgtcgatcacccgcacggcggcggcgagggcaagaaccacacctccggccgtccctcggtcaccccttggggcaagcccacgaagggctacaagacgcgcgaccccaagaaggcgtcgaaccgcctcatcatccgtcgtcgctcgaagtagtcggaacacgagtaataggagaaaccaagaatgagcagaagtctcaagaagggtccgtatgtggagactcgcctccttgcgcgtgtcaccgcaatgaacgaggcgggcaagaaggaggtcgtgaagacctggtcgcgctcctccaccatcttccccgagatggtcggccacacgatcgccgtccacgacggccgcaagcatgtccccgtctacatcaccgagtccatggttggtcacaagcttggcgagttcgctcccactcgtaccttccgcggccacaaggctaactaggagggcatgagagatggctaagaacaccgccgccaccaacgaggtacacgccaccgccaagtacgtgcgcatggcccctcgcaaggttcgcatggtcgttgaccagattcgcaacaagtccgtcgacaaggcgctggagacccttcagttctccacccgcgccgctgccgagcccgtcgccaaggttgttcgctccgccgtcgctaacgcggtgaacaacaacaacctgcgcgaggacgacctcgtcatcaagtacgcctacgttgacgagggccccacgctcaagcgcatccgtccccgcgccaagggctccgcttcgcgcatcaacaagcgcacgagccacatcaccgtcgtcgtcgcacctcgaaaggaggcgtagggaaagcatgggtcagaaggttcagcctaccggcttccgtctcggcatcaccgaggagtggcgttcccgttggtacgccgataagaaggactacgccaagaagcttggcaacgacctcgagattcgcaagttcctcgagaagcgcctcgcctccgccgccctcgcccgcgtcgacatcgagcgcgccggcgacaaggtgaaggtcaccatctacaccgcgcgccccggcatcgtcatcggcaagaagggcgccgagatcgacgccctccgtggcgagctcgagaaggtcgccggcgtgagcaagggcaacatcaacgtcgacgtcatcgaggtcaagcgccccgagctcgacgcccagctggtcgctcagtccatcgccgagcagctcgagggccgcatcgccttccgtcgcgccatgcgcaaggccgttcagtccgcccgcaaggccggcgccaagggcatccgcatccagtgctccggccgtctcaacggcgccgagatgggccgccgcgagtggtaccgcgagggccgcgtgcccctgcacaccctccgcgccaagatcgacttcggcgtggccaccgcccacaccaccatgggtgcctgcggcgtgaaggtttggatctaccagggcgagcagcttcccggccagcccgcgctgcacccgcagctcgagggctccagccgtcctcgccgtggtcgcaatgagaggaggggccgctaatgctcgcacctaagcgcgttcttcaccgcaaggttcagcgtggctccatgaagggccacgccaagggcaacaccgagctgcactttggccagtacggcctggttgcgctcgaggctcactggattaccaaccgccagatcgaggccgctcgtatcgccatgacccgccagatgaagcgtggcggcaaggtctggatcaccatcttccccgacaagcccatcaccaagaagccggcagagacccgcatgggttccggcaagggcaaccccgaggagtgggtggctgtcgtgaagcccggtcgcgtcatgttcgagcttggcgagatcgacgaggctaccgctaaggaagccctgcgtctggctcagcacaagcttcccatcaagaccaagatcatcacccgcgctgagcaggacggggaggcaaagtaaatgaagtacaaggagatccgcgagctcagtgacgaggagctcgcccagaagctcgaggacggccgcgcagagctcttcaacctgcgcttccagatggccaccagccagctggacaacaccgcccgcgtcaccctcgtgaagcgcgacatcgcccgcatccagaccgagatgcgcgctcgccagatcgcggccgaagccgcgaagaactagatcgcaggagataagaaatggcagagaccgttatcaggaacgcgcgcaaggtccgcaccggtgaggtcatctcgatctccggcgacaagaccatcaccgtgcagatcacgtaccgcaagcaccaccccaagtacggcaagatgatgaccgtgcacaagaagcttcactgccacgacgagaagaacgagtgcggcctcggcgacaccgttcgcgttatggagaccaggcctctctctaagaccaagcgttggcgcgtggtcgagatcgtggagcgcgccaagtaaggatttatcagcccattaccagccatgtgcctcgcaagcgtggtcgcacctctggctgggatgagtgttcggaggaacagcaatgattcagatggagaccatgctcaacgtcgctgacaacagcggcgcgaagcgcgtcaagtgcatcaaggtcatgggtggctccaagcgccgttatgctggcctcggcgacgtcatcatgtgcgccgtacaggaggctcagcccggcggccaggtgaagaagggcgacgtcgtgcgttgcgtcatcgtccgcaccgttaaggagacccgtcgccaggacggcagctacatcaagttcgaccagaacgcctgcgtcctggtcaacaaggatggcgagcccaagggtacccgtatcttcgggcccgtcgcccgcgagctgcgcgatcgcaagtacatgaagatcgtctcgctcgcacccgagacgctgtagggagtgagagacgaatggcaaagatgaacgtgaggaccggagaccaggtcgaggtcctgtccggcaaggacaagggcgttcgcggcgaggtcatcaaggccatgccgaaggagggcaaggtcgtcgtccgtggcgttgccatggtcaagaaggcccagcgccccacccagcagaacgagcagggtggcatcatccagaaggaggctgccatcgacgtgtccaacgtcgccctggtctgcccctcctgcggccagcacacccgcgttggccatgagcgcgacgagaacaacaagcccgtccgcgtctgcaagaagtgcggtgccaagttctagtccttggcacaaaggtagtagggccccctcccatggagggggtcttttttatcgccgattgtgtggagactcttcaaacccgcatcagctggcacgaggaatgcgggcaagtagtagagtgaagaatcgcgtctgtagacgggataggtatgtctcggacgcgtgggcccccgggcttgccaggctcgggtcgtgcgagaccggaccccgcacgcaatcccgccaggatctagaagaaggagttcacatggcagaggaccagaactacgtaccgaggctcaagaccctgtacttcgacaccattcgcgacgagctgcagaagcagttcaactacaagaacgtcatgcagatcccgaagatcgagaagattgtcgtgaacatgggcgtcggcgaggcagccacggattccaaggccatcgagggcgccgttgccgacctgcgtgccatcaccggccagcagccgctcgtgacgcacgcccgcaagtcgatcgcgaccttccacctgcgccagggccagcccatcggcgccaaggtcacccttcgcagcgaccgcatgtacgagttcctcgaccgcctcatcgccatcgccatcccgcgcatccgcgacttccgcggcatcagcgccaagtcgttcgatggccatggcaacttctccatgggcgtgaccgagcagctgatcttccccgagatcgacttcgacaagatcgaccacacccgtggcatggacatcaccatcgtgaccactgcccagactgacgaggagggcaaggcgcttctcgacgccttccacttcccgttcaagaaggactagtcaataggtagtacgtagccccgggatggacccgaggcctcttcctgaaggaggatttgtggctaagacatcgatgatcgtcaaggcttcgcgtgagccgaagtactcgacgcgcaagcagaaccgctgccagcgctgtgggcgtccccactccgtctatcgcaagttcggcctgtgccgcgtgtgcttccgcgagctcgcgagcaagggcgagcttcctggcgtccgcaaggcgagctggtaggccagggctctcgcgtgtaggcgtccgggccatgggctcggatgaaccaaacgcgcagtttcatcactaacgaaggagaaggaatcaatgaaggttactgatcccatcgcagacatgctgacgcgcatccgtaacgctaactccgccggcaagcctgaggtctccatgccctcgagcaaggtgctggtcgagatcgcccgcgtcatctgcgaggagggttacatcgagtcctacgaggtggaggacaccaagccccagaagaccctccacatcaagctcaagtacggcgcacgtcgtgcccgcgtgatccagggcatccgccgcatctccaagctgggcctgcgcatctactcctccgcggctgacctgccgcgtgttcgtggtggcctcggcactgccgtcatctccacctcgaagggcatgatgtgcgaccgcgacgcccgcaagctcggcgtcggcggcgaggtcatctgctacatctggtaacccgcggcaggaatagataggaggagacaatgtctcgtattggtaagaagcctgtccagattcccgctggggtcactgtgacagtcgagggctcccacgtttccgtcaagggccccaagggcgagctggatcgcacgttctccgagctcgtcaccatcagccaggagggcgaggagatcctcgtcacccgtaacgacgagtccaccgagtccaacgcccagcagggcctgacccgcaccctcatcagcaacatggtcgagggcgtctccaagggctttgagaagaagctcgagctcaccggcgtcggctatcgcgccgcgctcaagggcaaggacctggacctctcgcttggctactcccaccccgtgatctacgtcgctcccgagggcatcagcttcgaggtccccgacaacacgcacatcaccgtgaagggcatctccaaggagcaggtcggccaggttgcggccgaggttcgcagcaagcgtcctcccgagccctacaagggcaagggcatccactacgagggcgagcacatccgcaggaagcttggcaaggctgccaagtagcctcgtaggtatagggagaagaccagcaccccgtcaggtgctggcaacttgaaggagaagtaatggacaagaacaaggcaaagcgtgcgggtctcaagcgccgtcagcgccgtgtccgcgccaagatctttggcactgcggagcgtccccgcctttccgttcaccgcaccaacgcgaacatctacgcccaggtgatcaacgacgtcgagggcaagaccatctgctccgcgtccaccctgtcgcccgagttcaaggagaccggcaagctcggttccaacaaggaggccgcagagttcgtcggcaagctcgttggccagcgcgccatcgaggccggtgtcacccaggtcacctttgaccgcggtggtcacatctaccacggccgcgttcaggccctcgccgatggtgcccgttccgcgggcctgaagttctaggaggaatttagatgccacgtgatcgtaagcgccagaatgactccgatcttcaggagcgcgtagtctacatccaccgtgtttccaagaccgtcaagggcggccgtcgcatgacgctcgtcgccctcgtggtcgtgggtgacggcaagggcaatgtcggcctgggcatgggccgctccaccgaggtgcccctggcaatccagaagggcgtcgacgacgcgaagaagaacatgttcaaggttcccgtcaccaagagtggctcggtgcctcacgcaatcgagggcaagtttggcgcaggccgcgtcctcatcaagccggccgtcgagggtaccggcgtcatcgccggcggccccgtccgtccgctcttcgagcttgcgggcattaccaacgtcaccgccaagtcccttggcaccgacaacgccctcaacatcatcaaggccgcagccgagggcctgaaggggctcaccagccccgagcaggccgccgagcgccgtggcctcaccaccaaggagctcttcgcagggaagggggagtaaccaatggcagacaagaagctcaccgtcaggctcgtccgtagcgccgtctgcaacgtaaagaaggaccagacccgcacctgccgtgccatgggcctccgcaagatcggcgacacctcggtgctgcccgataacccgagtgttcgtggaatgatcttcaaggtcaagcaccttgtccaggtcgaagagaactaggagtcacccaaatgcagcttcatgatcttcaccccgcggagggctccaagaaggcccgcaagcgcgtaggccgcggtaactccgccggccagggcacgaccgccggccgcggcaccaagggccagctgtcccgctccggtggcggcaagggcgcaggcttcgagggcggccagaccccgctcgcgatgcgtctccccaagctccccggcttcaagaaccacaaccgcgtggagtacgcccccgtcaacgtctctcgtctcgagaagctgtacgaggacggcgagacggttgacgccgagagcctcctggccaagggcgtcatcaagcacgactacatccccgtcaaggtgctcggtgacggcgagctcaccaagaagctcaccgtcaaggtcgacaaggtttccgcctctgcgaaggccaagatcgaggcggccggaggaaaggtcgagcaggcgtgctaaagggaatcgccaacgcgttccgcattcctgagctgaggaagaagatcctgatcaccatcgggatcctcctcctgtataggcttggtgcctacctgccggcccccggcgtgcccttctcgagcatgctgaaggcctaccagaccgcagcggccggcagcggcgccattgccgtcctcaacctgttctcgggcggggcgctctcgcgcgtctccgtcttcagcctgggcatcatgccctacatcacggcccagatcatcctccagatgttccaggccgtgatcccctcgcttggcgagcttgccaaggagggcgaggccggccagcgcaagatcacgcagtacaccaggtacctcacggtgctcctcgcgctgatcaacgcgattggctacctcttcctcttcaagagctatggcatcgacttctccaacatggggttccccgagatcatcgaggacgtcatcatcgtcggcgtgctcctcaccggtgccatgatcatcatgtggctcggtgaggtcatcacccagcgcggcatcggcaacggcatgtcgctgatcatcttcgcgaacatcatggcagggcttcccaatgccctcagcagctccgtcgccacatccggcaccggtctgctctggaccatcatcaccctcgtcgtggtcatcgcgatcatccccgtgatcgtgtacatcgagcgcgggcagcgcaggattccggtccagtatgccaagcgcgtggtgggtcgtcgcatgatgggcgggcaggccacctacctccccatcaaggtgaacaccgccggcgtcgttcccatcatcttcgcatccgcgctgctgtacatcccggcgcaggtcgccatcttcttccccaacgtggggtgggtgcaggcgttcgccaacgcaatcagcacgggttggatcaactggatcctctccgtcctgctgattgtcttcttcgcgtacttctacacctcgatggtgttcaacccggacgagacggccgaccagcttcgcaaggccggcgggttcattcccggcgtccgccccggtggcgccaccgccgcgtacatcaagaacgtgctggatcacatcacgctccccggcgccctcttcatggctgccctggccgtgatcccgtccatcctgttcacgattaccggcaacacgctgatgcaagccttcggcggtacctcggtgctgattctggtcggtgtcgccatggacacgatctcgcagctcgagtcccagctcaagatgcacaactacgagggctttttcaagtagctcacccaagggacgctcaagggggacggatggggccaacgccccgtccgtccccctttccatacgggcgagttctgggggagaggcgagaggggcttctcccgttgaggtcccgccaagtgcatttggcggctacactaggtgcaacgttccaacggatgtggcctggggcgtctcccgggcgtcttcaagaggaaggcaatctccatgaacatcgttcttttgggcgcccccggcgccggcaagggcacccaggcacagaagctcgtcgaggagtacgggcttccgcacatctcgaccggcgacctgctcagggcagccgtcaaggcgcagagcgagctgggcgtgaaggccaagtcgtacatggacgcggggcagctcgtccccgacgccctggtggtggacctcgtgaaggagcgcctctcgcaggatgacgccaaggatgggttcatcctcgacggcttcccgcgcaacaccgcacaggccgaggtcctcgacgccgagctctcgaaggaggggctcaagctggacgccgccctgctcgtgagcgtcgagcccgaggtcatcgtcaagcgcctgagctcccgccggacctgcaagagctgtggctataccgcccccgccggcgttgacacctgcccgcgctgcggcggtgagatgtaccagcgtgacgacgacaagcccgagaccatccagcgccgcctggacacctacgagcgcgagaccgcgccgcttgttggctactaccgcgagcacggcatcctcaaggaggtcgacggcgaccgtcccgtcgatgacgtgtacgccgacgtcaaggtgctgctgggactatgattcgcatcaagagtccggagcagatagagcagatgaagtccgcggggtcgctctcgaaggcggcgctcaggcttgccggctcgatggcgaagcccggggtcacgaccaaggagatcgacaccgcggtcgagcgcttcatcaggctccatggggccatccccaccttcaaggggtacggcggcttcccggggagcatctgcgcatcggtcaacgagcagatcgtccacggcttcccctcacagaagacggttcttgaggagggggacatcctgagcgtcgacaccggggcaacctttggcggctgggtgggtgacaacgcgtggacgttcgccatcggttccgtctcccccgaggtcatggggctgtgcgagtgcactcgcgactgcctcaaggccgccatcgagcaggctgtccccgggaaccgccttggcgacgtgggctttgcggtccagtcgcttgcggagagcaacgggtacggcgtcgtgcgcgagtatgtggggcatggcgttggccacgagatgcacgaggaccccaacgtccccaactacggcaagcgggggaggggggtccgcctccaggcgggcatggttatcgcgatcgagcccatgatcacgatgggaacgtactccaaccacgtccttcccaacggctggaccgtcgtgacggacgacgggctccccgcggcacactacgagaacaccgtcgcgatcaccgacgacggcccggtcattctcacccaggacgaggatggcccctggtgccagatacagggtggggagcagtagcctcccggcttgatgctacgacgacggggccggccccatgccagggttggccccgccgtttacgtgtgtgcatgtcgtgcaacgtggaatcgacgtgagattttctgtatgataatcaatcgctgtgattcacagggagaaagcgggaacggtgagcaagcaaggcggaatagagcttgagggcacggtcgtcgagcccctgcccaacgcaatgttcaatgtcgaactggagaatggcaagaccatcctctgcaccatctcgggcaagatcaggatgaactacatcaggatccttcccggcgacaaggtcgtcgtggagatttctccctatgacctcaccagggggcgcatcacctaccgctacaagtaggagaggcgcgcccaacagccggaattcacgccagcggctgggcgagtagatagttcgtatcagcactaaccggaaggaacaagcagatgaaggtacgtccttcggtcaagaagatgtgcgacaagtgcaagatcattcgtcgccatggcaaggtttacgtgatctgcgagaaccctcgccacaagcagcgtcagggctaagagaggagctcgaagttggcacgtatcaacggcgtcgatctgccgcgtgagaagcgcgtcgagatcggtcttacctacctgtacggcatcggccacaccagcgcgaagaagatctgcgctgagaccggtgttgaccccagcacccgcgtgaaggacctcaccgaggaggaagtcaccaagattcgtgactacatcgacgcgaacttcaccaccgagggtgaccttcgccgcgaggtccgtcagaacaccgcccgcctgatggagattggctgctaccgcggcctccgtcaccgcaagggcctccccgtccacggccagcgcacccacaccaacgcgcgcacccgcaagggcaagcgtcgccagatcggtgcaaagaagaaggcctaaggggagaacagcatgccgcagaagaagaaccagcgccagcagcacatccgccgcgccgagcgcaagaacatcgccgtgggccaggcccacatcaagagcacgttcaacaacacgatcatctcgatcaccgacccccagggcaacgtcatcgcctggcagtccggtggcaccgtcggcttcaagggctcccgcaagagcaccccgttcgcggctcaggtcgcggccgaggcctgcgccaaggcagccatggagcacggccttcacagggtggctgtgttcgtgaagggtcccggctccggccgcgagaccgctatccgctccctccaggccgccggcctcgaggtgtcgggcatccaggacaagacccccatcccgcacaacggttgccgtccgtgcaagcgtcgtcgcgtgtagtaaggaaggacagtagcaatggcaattgataggacccctgtcctcaagaggtgccgccagcttgacatcgacccgattgtcatgggcatcaacaagaagtccaacaggcagcccaagcgcacacgtcgccagaagagcgagtacggcacgcagctccaggagaagcagaaggccaagttcatctatggcgtcctggagaagcagttccgcagctactacgagaaggccatcaaggaggagggcatcacgggtgacaacctgctctccatcctcgagcgccgtcttgacaacgtcgtcttccgtctcggctttgcccgcacccgcaaggaggcccgtcagaccgtctgccacggccacatcaccgtcaacggcaggcgcgtggacattccctcctaccaggtgaaggctggggacgtcgtggccgtggccaacaaggccaaggaccttctccccatcaaggaggccctggtctcctccgagcacatggccgtccccgcttggcttgaggtcgacgtggagaagctcaagggcaccgtcctgcagctccccgttcgcgatcagatcgatcttgacctcgacccccagctcatcgtcgagctctactccaagtaagtaaggacggtaggaggttttcatggcagaattcatccggccgcaggttactgtggaggaagtctccgagaacgtcgcccgcatcttcgcggagccgctcgagcgtggctatggcgacaccctcggcaactccctcaggcgcgtgctgctgtcctcgctcgagggcgctgccgtcgaggctatccagatcgatggcgtccagcacgagttcaccacggttcccggcgtgtacgaggatgtcgttgacatcgtcctcaacgtcaagggcctggtgttccgctccatgggtacgggcgacgaggccacggcctccatctccatcgacggtccctgcacggtgaccggcggcgacttcaaggtccccgcggagttcgagctcatcaacaaggatcaggtcatctgcacccttggtgacggcgctcacctctccatgcagatgcgcatcggcaccgggcgcggctacgtctcgggtgacgacaacgagcgcgagggcgaccccatcggcctcatccacgtggactcgctgtactccccggtcaagcgctgcgccaaggccgtcgagccttgccgcgttggtcagcacaccaactacgaccgcctggtgctcgaggtcgagaccgacggttccatctcgccccgcgacgccgtggtcgaggctgccaacatcgtcaaccagcacatgagcgccttcatgggcctggccgacgaggaggagcccgccgaggacgtctccatcttcgccaacggcgaggaggaggagaacaccgagcttgacaagcagatcgaggacctggacctctccgtccgctcctataactgcctcaagcgcgctggcattcacagcgtgaggcagctcgtggagttctccgagaacgacctgctcaacatccgcaactttggcgtcaagtccatcgaggaagtcaaggacaagctcgagaccatgggcctgagcctcaaggactagacaaacgcatttctttagaggagtttcaagaccatgagacacaacaagaagaggggcatgaagctcggcaccgacgccgcccacaccaaggccatgaagaagagccttgtgtgcgccctgcttgccaacgaccgcatcaagaccctcgatgcacgcgccaaggccattcgtcctgacgtcgacaaggtcatcacctgggccaagaggggcgacatccactcccgtcgtcttgccatcgccaaggttggcgacaaggaggtcgtgcgcgaggtcttcgagaaggccgctcagggcatgtgggccgaccgcaacggtggctacacccgcatcatgaagcttggcccccgcaagggtgacgcctccgaggtcgtcatcatcgagctcgtgaccgagccggtccagcccaaggccaagaaggtctcccctgtcaccaaggtggagcccgtcaaggtcagcgaggaggccgcggagcccgagcaggccgaggagcctgccgaggagaccgccgaggccgaggagaaggccgagtagccttctctcacaacgcgagacgctcgagggaggcctgcgcatgcgggtctccctcgctttgtatggggtgccgctggaaggtggggcatgctggagctgagggacatctgcgcgtcgccggcgctcggggggcatgcccaacgggtgctcgattgcgtatgcctgcacgtctctcccggggagcacttggcgctggtgggtgccaacggctcggggaagtcgacgctcgcgagggtgtgcaacggtgcgttgccgcccgactccggaggcgtcgtcgtggatggggacgcggacctctctcgcgccgacctcgctcgccttgtggggcgggtgaggcaggaccccctctcgcagctcgtgagctccgtcgtgtgggacgaggtcgcgtttggcccgaggaacctggggtgggcgagcgagcgcgtcgagggggcggtgaggtccgccctggcggagtgcggcatcgcgcatctggcggaaaggtccacgtcgagcctctctggaggcgaggcgcagcgcgtcgccctcgcaggggtgcttgccatgcgcccgtcgtacctcgtgctggacgaggcgctgtcgcagcttgacccaggggcaaggggagaggtccgcgacatcgtgcgggcgcttctctcccatggagtgggcgtgctcgacatcacgcacctggaggaggacgtgctctcggcagacagggtggtggccctgagcgccgggagggtctgctgggaggggaccccgagggaacttgcgacgagcgagggggtcgtgcgtctctccgggctccagggaggacgcctgagggtcctgggggcgctgggatggccgtcccttggcgagggcgccccctggcccccgagtgccggaaaactggctctgatggcctcggagcgcggcttggggcgcaagctgtctgatgcctgcctgcgggtgcagggcgagcccaaggccgcaagtgggggtgcgcgcggcctccgcctggacggggtcacggtctcgtacggggcgggggagcccgcgcttgccggcgcgacccttcgcgtggagccggggcgggtgtgcctggtggtcggtccctcgggatcgggaaagagcacgctcgccctggcggcagcgggtctggttgcgccggactcgggcgtcgtctccctcgacggctcccccgtgcgggcaggcgacgtcggcctggcgttccagaggccagagaaccagctgttctgcgccactgcgttggaggacgttgcctttggtccgctcaaccggggccagtcgcgggagcaggcgcttgccaaggcccgggatgccctggggctgctgggcgttggccccgagctgtgggaccgcgcgcccctctcgctctcggggggagagaggcgtcgcgtcgcgctcgcgggcgtcgtcgccatgggccaggcggccttcgtgttcgacgagcccaccgccggcctcgatggcccgtcgcgcagccggatgcgcaacctcgtgcgcaggctcgcggggcggggcgccgcggtcctcgtggtgacgcacgacgtgggggagtggctccccgtggcgacggacgcttgcctgctccagggtggcgccgtcgcgtggtccggtcccgcgcgcgggctcctcgaccccgcgacgtacgggcacgccggtctggagcctcccttcgaggcgaggctgtgggaggccctccatgggtaggacgctcgccatagggacctacctgcagcggaggacctggctgcatggggttgagccgggggctaaggcgctggcccttctcctcctcaccgtagcgacgtttggctcgcgtggccccctggggctcgccctggttgcgacggagctcgtcgcgggcgtcgtcacctgtcacgtgagtccccgcacggtggcgagggcgattgcgccgactgccgtcgtgctcgcctttgcgctgctggccaacgcgttcgtggcggacggctccggcgacgtcgccctcgtgggggcgctgggcgtgtccaccgcgggcgccgtgcgcggggcgctcgccgtcgcgaggattgtgctgctggtggggctggtctgcctggtgtcctcgaccaccacggcgccgcagctcgcgggcggcctggtgcgtctgctcgccccgctcggggcggcgggggtgcccgtgggcgacgtggcgatggtcgtctcgctcgcgctgcgcctgataccagagaccgtgggggagttcgatcgcatcgtgcttgcccagcgcgcccgtggcgtgcggtttgaccagggcggcccccttcgaaggctggggaggtacgcctcggtggtgattccgctgaccgtcgcgctgttccagcgctcggacgaccttgccggcgccatgcgagaccgctgctattccgggagggcgctggagcgcgtccgctggggggcggggtctcgcggcctggtcgcggttgcggcgctgacgatggcggcttgcctgtggctggcataggcgggtaggattttccggatgcttgggcgagaggggatgggcgagatgtgcgagggccaggggtgtgaggccatggggccggggacgctcgtcgtctgcgtgggctaccggggcgaggggttcagcggctttgcggagcagcccggccagcgcacggtcgccggtgagctgcgccacgcgctccagactgcgctccgccgtcccgtggagcttgcctgtgccggcaggaccgacgccggcgtgagcgccctggcccagtacgtgagcgtccccctcgccccgggcgaggacgggctggcggggcggcgcctgtggtcgtcgctggtcgccctcacccccgatgacatctcggtgaggggcctctaccgggcggccccgggcttctccgcccgctttgacgccacggcgcgctcctaccgctaccgcatcgcgtgcggtcccgcccggcccgtgatggcctgggaccacgcctggtggctgcgctcgtcggcgctcgacgtggacgccatgaaccgggcggccagcccgctgctgggcgagcacgacttcgcgagcttctgcaaggccagctcggcgcagctcctgcgccaggacggcaggtcgacctcgcggttcctctcgcacgtggagatctcgcgcgtcatcgaggcgggcgaggacctggtggcggtggacgtggagggcaacgccttcctgcacaacatggtcagggccataacggggaccctcgtggaggtgggccgcggccaccgcgaccccgcgtgggtctcgtcggcgctggaggcgcgcgaccgcagggcggccggtcccaccgcgccggcgcgcgggctcacgtttgagtcggtcagctacccgcagggcgcgctcgtcccctgggactaggggagagggaccgcccacgcccctcgtgccgctcccgttgggggcttcgccgtcgcgctcgcgggcgtggcagccggccagctcctcgtgcgccggcgtggcgacgtcaccgagccggcgccacccgcctctcccgcccggtggctggcgtccctgccgcggttcgcccacctctcacccaatatgtgtcggttttgtgcaaacatgcacaacatcgggaattagaataccctcaaaagccgtcaaataaggcactctacctgcgtaaacgtaagctcataggtacatgggagcatatgctcatatattggataagaaagcgaagtgaaccatggaggtcataatcgacgcgctgatcgactcgctcaaggacaccctcgagctcgtgcccttcctcttcctcacctacctcgccatggaggcgctggagcacggcatggcgggcaggaccgaggacatcatccgcaaggccgacaagtccggtcccatcgtcggggcgctcctgggcgccctcccgcagtgcggcttctcggccatggccggcaccctctacgcgggcggcgtcgtgaccgtggggacgctggtcgcggtcatcctctccacctccgacgagatgatccccgtgttcatcgcgcaccaggagccggtctcgcgcctcctctccatcgtgggggtcaaggtcgtggtgggcatggcggtcggcctggtgctcgacgcggtgctgcgcctgacgcaccgctccggcgacggccacgcccacatccacgagctctgcgaccgagcgcactgccactgcgacgacgagctgggggagagcgacgccgcgcacgacgccgcggcctcatccgacggcgtggcgggccatcaccacccccacgcctaccacgccgcctggggcatcgtccggagcgccgccatccacacggtggaggtgaccttcttcatcttcctggtgaccatcgcctttggcctggtgttctccctggtgggccagaacgccatcggcgagttcctgggcgtccaccccgtgcgtgccacgttcctggcggcgctgatcggcctcatccccaactgcggcgcgtccgtggtcatcgccgagctgtacctggacggctccctcgccgccggccccatgctcgcggggctgctcgtctcgggcggcatggggctcctggtgctgttccgcaccaaccccaacatgcgcaagaacgtcacggtcaccctgttcgtctatgcggtgggggtcgcggtggggctgcttgccaacgcactgggtatagtcttctgaactggagggagcgtgcccacggggcggcaggggggatagatgcaccgaccaaggaagagggagaggttcgagcgcaccgacgtcccgcggtacaacccgcatcgcacgcagatcgccatcgcggtcctggtggcggtggcggttggcctggccctcctggtgcacgggctgtgggagcgcgcgaacgcgagcacgcacgtgggcaaccagaccctgagcgcggcaatcggcgagcagagcgagaccacggcggcggacggctacaccgtgtcgagcgacgtgttcaccaacgtcctcatgctcaccgtggacgacatcaacgccgactcgccgcagctccagaaggcgcagctgctggtgatggatgcctcgacgcacaagggctacctggtcaccatcccgcttgacgccaaggtgagcgtcaacggcggcgacaccacgctcgcctcgtgctacgcctcgcagggcgccgcgggctgcctcgcgcccctctcgacggcgaccaacgtgaaggtgtcccacgtggtggtcgccaccgatgccgtatgggagaagatcgcgtcgttcaagggctcgggcctctccgccatactggggagctcggccgacatcctcaagaccctcgagaccgacatgagcatgggtgacgtcacggacaccgccgagctgctgcagtccatcggcgtgggcaacctctccaagcaggacgcccccggctccgagggcgacaacggctcgggcggcacctggttcacgatcgacgcgaccgcgctcggtgtcaacgtcgggctgctcacggccaacgcgtagggcgtcgacccgggagggcggcccctctcgcctgccaatgacgcggttttgtaatctggatgcttcatcttcccatcacaacgcatggcgaggggtgggggataattcagaaacgcggcgcccgctggcgcagcaaactgcaagcgttcggaacacgcggtcgggggaattcctgggatgacacccaaggcgccaaagatttcggtcatcatgcccgcctacaacgtcgacaagtacgtcgcacgcgcggtgagcagcatccagaaccagacgctcgacgacttcgagctcctggtggtggacgacgggtcaaaggaccgcaccgggtccatactcgactccatcgccgagcgcgacatcagggtgacggtgttccaccggcagaacggcggcgccccggcggcgcgcaactacgccctcgaccacgcccacggcaagtacgtggtcttcttcgacgcggacgactgggccgagccccgaatgctgcaggacatgtacgagatgtgcgagaaggaccacctgcagctggccgtcgcggcgttctacatcgacacctactacgggtcggagggcgagcacaccgaggaggtcaagggctgccccacgcggatctatcccactcagcaggagttccgcgccggcgcgtggaagctgtttgacaagaacctcctctacacgccctggaacaagatgttcctccgctcgcgcatcgaggagatgggcatccgcttcaagcccaccttctgggacgacttccccttcgtgctcgactacatccgcgacgtcgagcgcgtgggcaacacccagaccgcctactatcacttcatccgccagcgcagcgagtccgagacctcccgctggcgccccaacatgtaccagaagcgcgaggaggagcatggctggatgctcgacctctaccgccactgggggctcgacggcgacccggcgagcatggagatggtccagcgcaggtacgtggagcgtctgattggatgcatagagaacgtctgtaatccaatgtgcgacctcgaccaaaagcagaagctggccgagatcgaccgcatgatcagcagcgagcgggcgcagctggcagtggcggtggcgcagccgcagtccaagatgatggcgatgatgctgcagcccatccgcacccgcaacgtgagcctggcctaccaggagggtcgcctcatcagcttcgtcaaacggcacaacaccaagatgttcgccacgctcaaggccaacaggtaggggcaggggagaggggcacttcccctctcccccggccttttcccacgtaccaaaggcggccccgggccctctgtcgagaggtccggggccgtttcagtggcatgcgtccctggtggctatgccttcacaccgtactgctcgtagtaggcatcgagcgccgccttggtcgcgtcgtcgatgaccacgcgaccgtccacctcgtggttgtggagcgcctgcgtgacctcccccatggtgacgatggagctcacggggaagccgtagcgatcctgaatctcctcctgcgcggtcttgaccccgccgcgccccacctccatgcggttgagcgagaccatgaggcccacgacctgcacgtccgccgccgccttgagcttggggtacgtctcgtcgatggacttgcccgaagtcgtgacgtcctccacgatcaccacgcggtcgccgtcgtggagttcggcgcccagcagctggcccttgtcggcaccgtggtccttgacctccttgcggtcgctgcagtagcgggcttccttgccgtacagctcgtcgagcgctatgcaggtcacgaccgagagggggatgcccttgtaggcggggccaaacaccacgtcaaagtcgaggccaaagctcttctcgatggcctgcgcgtagaagcgacccagctggtggagctgggctcccgtcacgtaggcgccggcgttcatgaagaagggggactggcgcccgctcttcagcgtgaactggccaaacttgagcacgtcgctctggaccatgaagtggatgaagtcgcgcttgtagtcctccatgagttcccccctgccgccgcgcggacgcgaaactgaatgattgatttccgtcttgggtcaaatgccattctagcgcgggaaaaccgctcgccgctttgttgggcgcggttaggattattgaatagtttctgttccttttgttagcttatttttggcaatgacccggcgagttagtccgggagaacaaggaggccgcacagcggcagacaagggggatcggatgattggacgaacgggggagggtcccaccacgacggggggtcgcctcgcgcgcgtggcagtcggggcggcgctcggccttgccatgacgttcggcacggccggcgttgcgctggcaatgcccgcctacaaccaggcggtcacggtcgagcagccagacgggtcgaccgcgagcatcacccagcacggcgacgagtggttccactacgccaccaacgccgacggcgtcgtggtgcagaaggacccctccgacgggacctggaggcaggtcgtggggtcgggctcctcgctcaagctcggcgctagcgcccaggacggcaaggcggacggcgccatcgccgccgacgacctctccgacgaggccgcacgcaaggcctactacgagctcggcgggcagagctactcgggcaagaccgagagccaggccgaggaggacggccccgtcaccctctccgacatcgaggcgtcgcagggcaaggcgacgggctccgccgccgcgcgcccctcgaccggcacccagacgtcgctccccctgctcaccatcgtcgtcgggttcaaggacgaggcgtacagcaacgactacgactggaacaagaccttcttcacgggcgagtacagcgtctcgtcgctgtacacccagtcgtcggagggcaagttcacctggcgccccgcggaggagaccagcgccgacggcgtcgacggcaacaccaacaccgccgacaaggccaacgacggcgtcgtccacgtgaccctcgaccagagctacggcaagcctgacccctggggcgcccccggctctgacggctacaacgactacatcaacgacatggaggctgcgatcaaggcagccgccaagtacgtcgacttctcgcagtacgacaccaacggcgacggcaagctggaggccagcgagctcggcctgggcgtcgtgttcgccggctacgagcaggcgacgggcagcgtgcccgccgggcataacagcatctggtcccaccagtcgtcctttggcgagatgaccggctccgcctaccaggtcacggacgcgagcggcaagaccatcggcatcgaccgctacatcgtccagtccgagaacgagtcaatgagagccggcgagcagcaccagagcggcatcggtgcgctgggccacgagctcggccacttcctgggcctccccgacctgtacaacgtctccgcgagctcgggcgcctggagcaactactccaccatgtacctctccaccatgtacctctccatcatggacgtgggctcctacggctgcgtcgaccacgaggacgggacccgcgagtaccgccccacgttcttcgacccctatagccgctacctgctgggctacatcacgcccgaggagatcaccaaggacggcacctacaccgcgacctccgagaccgattcctccggctacaagtgctacatcatccacgtgagcgacgacgagtactacctgatcgagaaccgccagtacgagtcgttcgacgcgggcatggagccctactacaagaagggtgacgggaagatcgagaacaagaccggcggcatcgtggtctggcacgtcgacaacggcatcgccaccagtcacgggtacaccaccgcgaccgaccccagcctcgccaacaccgtgaacgactgggatcaccgccccggcgtcatggagaactactttgagtacgcgggctacacggcctatcccaacctgtatgcgccattcctgaacgccaccgagaacgccgcctacggcgcctccaagctgtcgctgtacaacggctccgacgacccctccgccaggaccgacaccggcatcaccgtgacctcgaccgacgagggctccacctcgatgcagttcaccgtcgacttccctgacgtcaccattgccgcgcagccctcgggcgccctgtacaccaccggcgccaaggccaccgcgctctccgtcgacctctccggcaacaccgacggcgtcacctaccagtggatgaagtccaccgacggcggcaagacgtgggagaaggtcgccacctccgacacctacgtgccctccaccgccaaggcgggggacacccagtacaaggtcgtcgcgaccaacgccctcggctacaaggccgagtccgaggccgtcaccgtctccgtggccgaccccgtcgaggccggcggcatgtaccgcctgtacaaccccaacaccggcgagcacttctacaccgccagcgcctacgaggcgggcgccgacgtcaaggccggctggaggtacgagggcatcggctggtacgcgcccaagacctcgagcaccccggtctaccgcctgtacaaccccaacgccggcgaccaccactacaccaccagcgccgccgagcgcgacatgctggtgaaggccggctggagggacgagggcatcggctggtactccgacgacgccaagggcgtggccgtgtaccgcgagtacaaccccaacgccgcctccggtgcccacaacttcacgaccaacaaggccgaggacgagatgctcgccaacgccggttggaaccaggagggcatcgcctggtacggcgtgaagcagaagtagtcgagcgccactgacgccaactcatcgcgcaggagggggtcccggattgtcgggaccccctccttcttgcgaggagcggttctcctctcccccaggccgggcacaagaaggcgcccccgggatggaatcgcatcccgggggcgcccctgtgtggcgacttgtcctgtcgctgttgtctactcgcccagcagtgccttggtcatgctggcagcggccttcttgccggcgcccatggccaggatgaccgtggcggcaccggtgacgatatcaccgccggcccagatcctggggtcggaggtgcggccgtcctcgtcggcctcgatgtagccccacttgttgagcttctcgggaccaatgagcttggcgatggggttggcgttggtgccgatggcagagacgcccaggtcgcagggaagctcgtccacggagccctcgatggggatggggcggcgacgaccggaggcatcgggctcgcccagctccatgttctggaccttgacggacttgacggcgccgtcctcgcctgcgacgaactcgagcggggaggccagctcgtggatgatgacgccctcggccttggcgtgctcgacctcggcgcgacgcgcgggcatctccttctcggtgcggcggtagcacagggtgaccgtctcggcacccaggcgaagcgcggtgcgcaccgagtccatggcaacgttgccgccgccaaagaccacgacgttcttggcgcgcttggtgggggtgtcgtactcggggaacttgttggccttcatcaggttcacgcgagtgaggtactcgttggcgaagaagacgttgggcaggttctcgccgggcacgttgaggaacttgggcaggccggcgccggtggcgatgtacatggcgtcgtagccctgggcaaacagctcctcggcgttggtgatgcggcccacgaccgagttgtactcaaacttgacgccgagcttctccaggccgtcgatctcgcgcttaacgaccgccttgggcagacggaactcggggatgccgtagaccagcacgccgccgcccgtgaagaacgcctcgaacacggtgacgtcaaagccgttgcgggcaagctcgccggcgcaggtgatgccggaggggccggcgccgatgacggcgaccttcttgccgttcttgggtgccatcttgggctcggaggcaacctcgggcatgtcgcccaggaagcgctcgagctggccgattgccacgggctcgctcttcttgccgcggatgcagcgcccctcgcactggttctcctgcgggcacacgcggccgcagatggcgggaagcatcgaggcctcgtggatgatgtccaggccctcgccaaacttgtgctcgtagatcttctcgatgaagccggggatgttgatgttgacggggcagccctccacgcacagcggcttcttgcacctcatgcagcgggaggcctcggccaccgccatctcctcggtgaagcccttgtcaacgggcctgaagtccttggcgcgctcgtctgcgggctcctcgtttgcaggggtgcgcggcagcttcatgtctgcgacccagcgaccatttacctctggcatgcgcagttcgcctcctcataggccttgagggcctggccctcctcggtacggtatgcagcctgacgtgcgcgaaggtcgttccagttgaccttggtggcgtcaaagtcggggccatcgacgcaggcgaacttggtctccccgccaacctcgacgcggcagcagccgcacatgcccgtgccgtcgaccatgatcgggttgagcgacgcggtgatgggggtgccgtacttctcggcggtgagggccgagaacttcatcatggggacggggccgacgcagaacacgtggtcgaccttcttctcctgcaacaggcgctccagcggggcggtgaccacgcccttctcgccatacgagccgtcgtccgtggtgatgtggatgtggtcgtcgggcagggtggcgcggaactggtcctcaagcagcagcaggtccttggtgcgggcgcccatgattgcgtggacctcgtgaccggtcgccttgagctggcgcgcaacggggaaggcgatggcaaggccaacgccgccgccgatgacggcccaggtgccgtcacccatctcggttggctggccgagcgggccggtcacgtcgagcagggagtcaccctccttgtaggtgctgagcatctcggtcgtcttgccaacgaccatgaagatgaactcgacccagccctcctcgggattccagtccgcaaaggtgaacggcacgcgctcgccggtctcgttggcgcgcaccatcaggaactggccggcatgtgcatgcttggccatctggggcgcctcgatgcggaacttgaacaccttctcagagaactgcgtcttttcgaggattttgtacattaacgaactcctctcccatacaactctcttgccgtgcgccaccgagcggtggcgtcgttgcctcgtgccgtgcgggcacatcccccaatgcgcgcacacaaggccattctacaaaatgcccatgtggggacggggctaaatgcgtgctttggcgcaatatggggtcgcgctgtcgtgtgggcggcgggggagaggggaccatcgccctcggccgtggttggtaatgcggtggggagagggggcaacgtcccggctcgcacggactccgccgcctgggacgggggcaccgagccgctgctacctgtttccgccggtgcggttgacggcctcctccacgccgagctcgaggcaggtctccaccacgtcggcggcgtcctgggccgtcgcctcaaactcctccaggaagccgcccttgagctcgcgcagcacgtagtcggccacctgcatgcgtcccggcgggcgtccgatgccgcagcgcacgcgggcaaagtcgcgcgtgcggagcttgtcggcgatggagcgaagcccgttgtgggcgttgagcccgccgccaaacttggccctcaccacccccgagggaaggtccacctcgtcgtgcaccaccaggatctgctgggggctcacgtgtagctgacgcatgagcttgctcagggggccgccggaggtgttcatgtagctctgcggcttggcgagcacgacctcgcgcaactctcccccgcagcggtgcttcaggcgcgcgacctcgcagcccgcctcggtcttccagtagcccaccccctcgcgctgggcgagggcgtccacggtggcaaagcctatgttgtggcgggtgcgctcgtactctgcgccggggttacctaggccgcacacgagcacgatgtcttgtggcttggcgggtgagggcatgctgtctcctcagtcttcgatatgccgcagcaggtggttacggctccgaccagcgtagctcaaacggccggccgacacggcgcggcgtcaccagaccagctgcgccaccagcaccacgagggggatgctgaccactgagaacagcacggataccacgatcgtctcaaccgcataggcaaagtcacagtcgtgtagctgggcgtacaccgcaacgttggagccgaccgggcacgcctgcgcaaccaagatggccagccgcatgtcctggtagcctgcggggaggagcgagaggagcgcgagcgtcaccagggggatcaccagcaggcgaacgaccgccacccggtagagggcaagcctgcggagcatctcccgcaggttcacgtgcgcgaggtacacgccgatggtgaacatcgccaggggcgtgttgagggcggcgacaaacgagagcgagttggtgaccacgccgggaagctgggcttgcgtcaggtacagcgcgagccctaccagcacggcgatgatgaacggagagcgaagaagctcgcccgggctcaggcgctggggtttaccggtgagaagcgacacgccataggtccactggccaacgttcatggccgcgatgaatcctgtcatgtagaagaccgggccctgtcccaggatcgagaccacaagcgggatgccaaagaagctggggttggagaaggtcgcggcaaagttggcgatggcgtctctccccagcgtcaggcgcgcgatgatggcggcgagcaccacgcagccaactcccaccagggccgacacggctagggccacgtcggtctggggcgtacggtcgaccatgaggccctggatgatgaccgcgggcagcgagaggtagatgaggatgttgccgatgctgcggttgccctcgagggtgatcttgccgctgcggaacatgaggtagccgatgccagagagcaggaacatgaccagcacctgctgggcgagcgtgagggacatctgcatggaatggggccttcccggtggggttgtggggcacaccgaggatagtcccccaagggcgggacggggcgcgggaaggtgggcgggagccgcataaggcggcgacccgaggccaccgcatcgctgcggggaccccgggtcgcgggttgctcgattgtgggggggcatccccgtggcttgggctgctacaccaggtctgccacggccctctccaccggctccatgcctgcggtgggctcaaagcgggccacgacgttaccctcgcggtccacgaggaacttggtgaagttccacttgatgtcgtcgttgctctcccagtcggggtcgacctgcgcgatgtaggtcggcatcttctgggccgcctcggagtcgcccagacccttgaagccttgctgcgacttgaggtacgtgaacagcgggtccgcgttctcgccgttgacgtcgatcttcttgaactgggggaactcggtcccaaacttcatggtgcagaactggtggatttcgtcgtcgctgccgggggcctggcccaggaactggttgcaggggaagtccaggatctcgaaccccttgtcgcgatactcggcgtacagcctctccagctcgtcgtactggggcgtgaagccgcagccggtcgcggtgttgacgatgaggaggaccttgcccttgaagtccgcaaggctggtggtggagccatctcggttggtgacggtgtagtcgtagacgcccatgtgggacccctctcgatgaggttcgcgtatttggcaccgtattggtgtcagatacagtgtgcccatttcgcgttagggcagacgggggattttcatcgtcacgagcttgtcatggggcgtcgtcgccaccaccgtcgccttaagtgtgggctgcgccagcactggcccgaagggccgccgaatcatagggattgtcgccctcctgcacaggggctgctggggaaatgcgagctgtggcaatctgggtgccgtcggagcgatgagggggcggcggaattcggacttgtgacaatgcaaatgtcgtttcagctgagttatcccgagttgtggcagggttttccggtgatggagtcaccctcgattgccacggctcgagttttctcagcagcccattgcatgggtggccgtggagcttagaaaacctggtgtccgtacgggtggcgggcgaggtgtgcttaaagaacctggtgcccgcacgggtaacgggcgaggggtgcttaaagaacctggtgcgtgtacggattccgggaggtccgaccaatacgggcgccgggaaggctaagcattctgcttcgaaatccatgcgggcaccgacgaggctaagcatcgggggtctcgaagtgtgtgcaagctccggcgaggttaagcgcagggctcctcaacggtgcgcgtcccgatgatgccaagcgattggtttcggaaatcgtgccgacaaggcggtgccgacgggggtgggttactacaacccgcaccttccccaacagaccaagcgccaacgcgttgacgggtgagcggccgataccgcggcgcgccgggcacccccccacgcgcgtggcgttactgggccccacccgcgtcttcgggtgaccactcctgcgtcgcggggacgtcactcgtcttttccaactcgacggagccgccgtcagagagggtcacgtatgcggcgccgtccgtcctcccaaaagcggtgtatgcgtacgccaggtgaatcgtgccagcggcttttcccgaggcgtccaagagttcgtagacgttgggatcgtccgttgttctgactgttccgttgagctgtcggtccgacaaggtgagctgccatcccatcccgtctcgctcgggatggagtatggcaagggaggcatacgcgccgtgcgagtagccaccgacgtcatggctggggctctcgtacgttccaaccacgtcgtagccgcttgtcgcgcgtgtcgcgaatgcgttcacctcgccttgggcccgtgtccacagcgcgccaaacgcgatgcacagcacggcgaggaatgcgatgacgatgtccttgccgtgctttcgcgctgccaagccaatgccttggtagcttcgtccttcgaggccattcgtcccgctgcccatgccgacccccgttccgaagccgtgtcaaatccagattgccagccaacccaaaggccttgtcaggcgagaggatcgtatcctctgccaggcatgtgacctgcgtcacggtcgcgggaggtgaggggcgtcggcgagtgggaaacaccattgggcgaaggcatctagcgaagcggaataagctctgacctaaactatctagcttgcgagcttgtttgacttccgcaggaactttgccgggatgggccgcgacagccgccagacgatgctcatggggtgagagccgctgtggctctcgtggcaaaccaaccccaggaaggtaaacggctcggttccgtactggtccctgttgtactcgcgggcgaagagggcaaccttggtcggcgccccgctcttctcgtcccgttggtggatgtaacgctgtccggttggggactccggcgtcgtcttgttctggctctgccagtggaagtgccactcgtcgatcgaatagtcctcgtacatcgtggagggggagtactcgcgctccgacttgttgagggtattgatcagcacatcaacccccttgtccctgaggtaggcgacgccctggcggatgttctggggatccatgcggtccatggcgacgaagatctggtcgcgggtgtactggcaatgcaggtcgagcgggcactcaaacccaaggtcaacgggttcgtccacaaagtcgatcgaatcgagcctgacttgcagtagctccgtgatctcccgtgccatgacggggtttgagagaaccctgcgcacgcattgcgtggggtcttcaaacgtctcctcgcggaacgaactcggccagagcgtgatctggaacatgttgagcatgcgccgttcaagcggttcgagggatttccagtcaaggtccccggagtcactcagcgcttgcaacagaaagcggatccacctcctagagtcggcaagtgagaggcgaagcagcgcctttgtcagaacctcctcgtcacgctcgcggaagtcctccctcaccccggcagtgacgcagagccgtgcgaagcttgcgtgcctgtagatgtcgcggacgtccaggtggtagtgggcgacgaagttcttgagcgagaggggcaggccgctgtcggcctcgaacgtcgcgatgcgctcaaccaaggcggagcgcgtccccagtgcggagcggatgttgtcgagcacgtggcgttgcgccacccgttcgaggtgaatgtagcagcccttgggagctgcggggaagccgtccatgacctgcgtgcccatagtgctcgtggtgggttcgaggatcgccctcaggcggcatgcgaagtcatagcgccggttctgctggccgatgaagtccagtacggtgaggcactccttccctggggagagcctgaggccacgcccgagctgctggagaaagaccgtgagcgattgcgttgggcgtaggaagaggacggtgtcaacctcgggaacgtccactccctcgttgaagatgtccaccgagaagatgaacttgacctcgccggtcgagagccgcttcctcgcgctccggcgctcctcgttgggggtgtctgccgtcagtgcgagggagcggatccccgcctgctcgaatctctccgccatgaacctcgcgtgtgccttgctcacgcagaagccaaggccgtgaacctcgtcgacgtcggtcacgtatcgcctcactgcgtcgatgacgttcgaggcgcgcctctcggcaagcttcctgtcgaagacgtacacgttctccaacgcgctctcgtcgtagcctccccgcgaccacttgaggccgtcgaggtcgacggtgtccgacacgccgaagtagctgaacgggcagaggagcttgcggtcgattgcctccggaaggcggatctctgcggcgatcctgccatcaaacctctccaggatgctcctgccgtcggacctctctggggttgctgtcaggccaaggagaaccttgggcgcaaagtggtcgaggaatcgtgcgtatgttgccgccgcctcgtggtggatctcgtctaccacgatgtagtcatagaagcctgggtcgaggtggtcagccagactgcgcgagttgatggtctgtattgaggcgaagaggtggtcgaggctgtcggggcgggcctgccccacaaagagctggccaaagttgggatccttgagcacgccgcgaaaacatgccaggctctgcctcaggatctcctctctgtgggccacaaagagcatgcgtgccctacgcccgcccgcatacctcctgcagaagtcgcggtagtcgaaggccgagatgacggtcttgcccgtgcccgttgctgccacgacgaggttgtgccagtggttgccgacctcgcgctctgccctcagtctgtcgaggatctgctgctgaaaggggtacggtgtgatatcaaacgagtaggcgatcccttccgagccggcatccgcgcccccatggcgctcccggtcgatcgcacgctcaaggcgctccaggtcgtctgtcgtatactcctcgaactcgggtgacttccagtaggtttggaacgttgcctcaatcttggcgagggtgtcaggctggtcggccttgctcaccttcacgttccattccagtccgcttgtcattgccgggttcgagaggttcgaggacccaacgtaggccgtcgtgaagccggtgttgcgctcgaagacgtaggcctttgcatgcaggcgggtccggctcgtgtcgtacgagaccctcacgtgcgcgtttggcagcttggcgagctctgtgaccgcctttgggtcggtcgcccccacgtagctcgtcgtgatcacgtagagctcgccgccaccctcgcagaactccctcagctcgtccatgatgagccgcagtccgctccacttgacgaacgagacgagcatgcagatggtgcttgcggaggcgatctccctcttcagttcggtatagagctgcggctcgtgcgcggagcccgtgaagagggacgtcctggccaccgatgtgcttgggcggggcggaaagcggggacgccccccggttacggcagatgcgacgtttctcttcggtaccacggagaggagctctcgtgcgggctccacgaccgtctgcaagagcagctcgtccgatggaccttcctcaccgctcgccatggtcgcggcgattccgctcacgatggcgttggtgacctgcaccttcttggagacggaggaggcaccctcccctctgacggagtcgagggccgcgcgaacgaccttctcgacatagctggagaggatgcgcgatgcctcggctccatccaggtcacgctcttcggcgctctcgtcctccgacgaggcgtcgatctgctccctgagctgcctactgattgtctgctcgtagagtcctggctcaagcatgccgttcaccctgcacctcactcgcgtccaatgcgtccaggatcggggaacgatgcctcttgcacaagggggactccgccgccggtaggtgcgtttttgcaagaccagaacaagcgttccgctacaatcgatgcgagggcgcgaggggggatgcatgtacgggagcgggtacgagcggcagcgtccgcggttccaggtgggggagagggtcgaggtctcgtctcgcgcggggctcgtgccatgggtcacctcgggcgtcatcgccgaggtgggctgggtctacggcaagcccatctaccgcgtggacaaggtggacgtcagcggctgcgacaccaccttcaagaacgtgaaggagtggatgctccggcccgtgtcgcgccccgcgaggggatagcccagcccccgtggcggcgtgtgcccctccacctccagtgccgcggagcgatcccaggcgagacgagccccagcctaggcggtaagcgcccgtatcggtatcgcgtagatgccgtcctccacgcggtgcgcgtactcggacacccccgtgatgactgccatgaactccggcggcctcatgcgcgcggcgggttcaatatcgaaattccgcccaagccgatatcgtttttccaccatatgcgatatagattttccaccctattcgatatcgaaaatccaccctgagcggcatcgatcttccgtcttgcgagacgactgccgccgtccacgccgcatgccgctccgagtgcgaccgcggcaggtgcgggccatggcgctatcctctgacgggagaaacgccattgcccaaggctatgcccccaggagcgggaggtcgaccatgaccctgcagcagctcaggtacgccatcgaggtcgcggcaagcggctccatcacggcggcggcagcgcgcctctacatcgcgcagcccagcctgtccaaggccctctcagagctcgagggcgagatgggcatcaccatcttcgagcgctccagccgtggcgtggtccccaccgaggacggcaccaggttcctctcgtacgcccgccaggttgtggagcaggcagacctccttgaggcgcagtacaagagcggcaacccgccccgccgggtcttcgcggtctcgtcgcagcactacgccttcgtggtcaacgccttcgtggaactggtccgcgagtacggggagagccgctacgagttctccctgcgcgagggcaccacctttggcatcatcgaggacgtgcgcctccagcgcagcgagcttggggtgctgtaccgcaactcgttcaaccgcgaggtcctcaccagcgcgatccgccaggcggagctccgctttgagccgctgttcgaggcgcgcgagcacgtgtttgtgagcagggggaatcccctcgcctcgcgccggtcggtcgcgctcgtcgaccttgccccctacccgcggctctcgtacgaccagggctcgcgcaactccttctactttgccgaggagccgcacatcacccaggaggtcgacaaggcgatcgtggtcaccgaccgcgcgaccctgttcaacctgctcatcggcctcgacgggtacaccatctcgtccggcatcctgagctccgacctcaacggcaacgacatcgtgtcggtccccctggagggcggtgggaccatggagatcggctacgtgcaccagcctcgtcgtcccctctcgcccctggccgagagctacttgggccacctgagggggtacgtctcggcatatatagccaaaggctatgacgggcaataggggataggtacttccttatggctcccggctttgtcaccatggtcggcgacaacgacgagacgatcgggcgcaatgcgcccggagggggtaccaacatgagcgagccaaccaagcagccgccgtacatctatgacatcgtggggagcttcctgcgccccgagcgcctgaagcgcgcccgcgaggactggaaagccggtacgatcagccgggaccagctgaccgcggtcgaggacgagtgcatccgcgacctggtggagaaggagaaggctgccggcctgggcgtcatcaccgacggcgagttccgccgcgagacctggcacctggacttcatgtgggcgttcgagggcgttggccacgagtcggccgcctttggcatccccttccacgacgaggtcgccaagatcgacgacacctacctgaccggccccctctcgctcaagggcgagcacccgtttgtgagccactttcgctttgtgcaggccctggaggacgagcgctgcgtcgccaagctcaccatcccggcgcccgcccagttcctggagcagatgatcttccccgccaaccaagagagcacgagggtcgtctacgccaccgacgaggagctgtccgccgcggtcgcgtccatctacggcgacttcatctcgcaggtctatgccgctggctgccgcaacctgcagtttgacgactgctcgtggggcgtcgtggtggacccgcacgccaaggacatcctgggcgtcgacgacgaggggctggagcgcgtgaagggccagctgctcgcagtgaacaacgccgtcctcgacgccaagcccgcggacctcaccatcaacacgcacgtgtgccgcggaaacttccactccacctgggcgtgcgagggaggctacgacggggtggccgacacgctgcttgccaacgagcacgtggacgcgttcttcctggagtacgacgacgagcgctccggcagcttcgagcccctggcgaaggtacccgagggcaagaaggtggtcctcggcctggtcacgaccaagagtccccgcctggaggagccggatgccgtgattgcccgcatcaacgaggcggcgcgctacgtgcccctggacaggctgtgcctctcgccccagtgcggcttcgcctcgtgcgaatgcggcaacaagctcaccgaggacgagcagtgggccaaggtcgcgctggtgcgcaaggtcgccgagcaggtctggggctaggacggcgagggtccgtccgcaacagggcggggcgagacaaacgagacgatcgggcgcaatgcgcccggagggggtaccaacatgagcgagccaaccaagcagccgccgtacatctatgacatcgtgggaagcttcctgcgccccgagcgcctgaagcaggcgcgcgccgacttcgcggcgggcaggatcggccgagaccagctgaccgccgtggaggacgagtgcatcaccgagctggtccagaaggagaaggacagcgggatcagggccgtgaccgacggcgagttccgccgggccatgtggcacctcgacttcctcgctgcgctcgagggtgtggaggagatcgacgccaagacctggtccgtggagttcaagggccccaagcccaagggcgcccagctgcgcttcaccggcaaggtcgactttgggaaccacccgttcctgaagcactaccgccgcctgcgccagatcgcgggggactatcccaccaagctgaccatcccctctccctcgatgctgcacctcatcccctgcgtcagggggaggcagacctacgcccccgtcgatcgctaccgcgacgagtccgcgctgctccacgacatcgcgatcgcctaccagcacgccatcagggcgttctacgacgagggctgccgctacctgcagtttgacgacaccagctggggagagttctgcgaccaggacaagcgtgccgcctacgaggcgcggggcatcgacctggacaaggtggcccaggactacgtcgacatgatcaacctcgcgctcgaggccaagcccgccgacatgaccatcaccacccacatctgccgcggcaacttccgctccacgtggttctcgtccggcggctacggtcccatcgccaagacgctcttctcgcaggcaaactacgacgggttcttcttggagtatgactccgaccgcgcgggtgacttcgagccgctgcgccacatccgcgaccaggtcgtggtcctgggcctcgtcacctccaagttccccgagctcgaggacgaggacgcggtcatcgaccgcatccacgaggccgagaggtacgtgcccctcgaccagctgcgcctctccacgcagtgcggcttctcgtccaccgaggagggcaacgtcctcaccgaggacgaccagtgggccaaggtcgcgctggtgcgccgcatcgcggagcgcgtctggggctagctgccccaagccctgggcctccgcctaaatgggtccgaacaagcgagggagggggacgagcgactccgtccccctccctcgtgctacccttctcggtcgttggctacggagaggggagaccagttcatgaacggttcgagcgaggctcaggtgcgggagacgggcgggagggtcaccccgacccgagccaggctgtgcttggcgctgctcgtgctcctggggttctcgcttgggtgctcggagttcgtggtcatcggcatccagacggaccttgcacgcgacctgggggtgtccctctcgtccgcggggcagctcatcagcctgttcgccctgccctattcggtcatgacgccggtgctcgcgctgtcgaccgggcggtttcgccgctactccgtgatgctcgtctatctcgccctcttctgccttggcaacgtggtgtctgcctttgcgacgagctttggcgtgctgctggcggcacgcatactgctgggctccatctcgggcgcgctgcttgccgtgggtgtcacgttcatacccgagctggtcagcgccaagaggtcgtccctggcgctcaccctggtgtactccagctactccgtcgccatgatcgtctcgaccagcgtgggcaagatcctcgccagcacggtggggtggcacgtggcgatgtacgggacgctcgcccttgccgcggtggtgagcgtgctcctcgccgtgttcatgcccaggagtggccagaccgacgagcccgccacgtttgcggagcaggcacgcctcctgcttgagcccagcgtcgtcacgggcatcctcgtcttcgtgtttggcatcgggtccgtgtacgcgttctacgggtacgtgaccccctacctcgagcaggtgctgggcatggctacggtccgggtcagtgaggtgctgattgcctacggcgcgataaccttcctgtcgaacctcctcagcggctggcttgacgcgcggtttggcctccggtcgcttgcggtcaccttcctcgcccaggccttcgtgctcgcagggctgttcgtcgccgggccgtccgtgcctgcagccctggcgtttacctttgcggttgcgttgctgatgtatctcgcctcaatacccagcgtttcaaacttcatgggggtagcgcgcaggcaccaccccaaggcccttaccctggcgagctcgctcgagcccctgtcgttcaacgtcggcatcgcgttcggcacgctggtgggcggtgtggtggtgtccggccccggaatccggctcgtcggtgaggtcggggggctcctagccctcgtcgcggcggccatggtcatcctcacggtcaggctcgggcgttcccgggaggcgtagggctgtcaccgcggcgttactcctccggggtacaaacaaagcccctgccccgcccgccttattgctacaaaacgccagaaggtacaaataagaacgactctgagtgctccttatttatactatttgccgattagtacaaataacgagagggattttgtctcttgtttgtacaatgggggcattggtgtttcttgccgtgccgttcgattgcttgtcgggcgtatgggggtgaccatggcgtataagccactgtcaaagctcttctatatggacgcctcgtccgatcgctacaagaacaacgaggagcttgctgctgcgcgtctcggcgcagacgcgagttttcggttgggggtcaccacgggggcgggggagctattccttgctgtcccccatgagctctccgttctaaacgaacgcgtgctgagaatggagcgcaaggtctcgctctccctcaactcaatgccccccgttgcgcgcgggtcacttatccgtgacctggtgatcaatgaggtcgtgagcacaaacgagcttgagaacattcacagtacgcgcaggcaaatcaacgaggttctagaggacgcgggtggtgagggggagtctcttgccgtaaggaggttcagggaactcgccaagctttacctcggcctctccgatccttccgttaccgttccccagactctcgaggacatacgttccgtgtacgaccgcgtaatggcgggagagccgctagggaagtcggagttgcctgatggtgtcctcttcaggagggagagagtcgaggtgattggcaggggagggaaggtgctccatgagggcgcctatccagaggctgccatagaggaggggctcacaaagatgatgcagattgcgtcatccgaggagatgccacagacgttcggagcgattctcagtcactacatctttgaatacgtccacccgttctacgacggtaacggacgcacgggaaggtacctcctcgctctctatctctctaggccgctctccacgctcactaccctctccctttctcgtacgattgccgaaaacaagtctcgctactacaaatcgttccggcttgccgaaagccccctcaaccatggggagctgacgttctttgtgattgatatgcttcagagcattcaggaggcacagattgagatcgtggaccggcttggaatgagtgcccagaggctcaagagatcgtcggagttgctcgagggtcttgcctccgatttggggcttggggaaagggagcgggaacttctctccatgcttcttcaagttgctctctacggcgcattttccactgcgacaatcgaggagtgctcaaacttccttcggctgggaaggcagcagacgcgcaagtaccttcttaagcttgaggagcggggactcgttacggcggagaggcatcggccgcttctctttaggctcagcgacgacgcggcttcgaagctcgaagccaaaagagatgtgggcgagtaggctggggtgccccttcagcgttaccctccggagtatttacaagctatccggttggccagtcttattgctacaaaacgccagaaggtacaaataagaacgtctctgcgagcgccttatttgtactatttgccgattagtacaaattaggagagaaacttgcgccccttgtttgtacttggcggtaagtgctgcgaggcaagggagcgggtgcccccgatttggtggcacccagcatcttctacctcgcccccagcagctcgaagtggctgcggttggtgcggattacgttctccctctgcaggcgagagatgacggacgagagggcgctgcgatccacgcccaggtagtcggccagctgctggcggttgaacggtatgtcgaactcgcgtgacccggcgagcttggcctgggtggagaggtacgccatcagcttcccccgcagcgtcttgggggcggcgtcgcgaatcctgcggccgagggcgacgttcttcctggccaccgacgccagcaggttggtgctcaccgtggcgtggcaggcgcatgcgcgtgggcagcggcccacgatgtgcgctacgtccaggaacaggatgcgcgttggggtcgaggcggccaccacgcggtccagcagcggggtgtcgcccagcgccgcgtaggcgtccgcaaaggtctggccgcgcgagaactggcccatcacgctggtgttgccccacacgtcgctgctctccacgcgcaccgcgccctcgagcacgagcccgaccgagcgcgtggtgctgccctccgccagcacggtgtcacccttgcggaagctgcgcgcgtgcgtccccaggcaccccagcatcatctgcacctcgtctggcgaggtgcccgagaagagctcggtccccgcaaggaagtccgcgtccacgtcgttgtgggccatgtccgtctcctctcatttttgttgtgatgacaacatacaccaatctcgcgccacggcatcatctggagacaacgagagaggcgacggcggcggaggccgccagagggaggggacagcatggcagacgagaagatgttctgcttccagtgcgagcagacggcgggctgcaaggcgtgcaccggcaatgcgggcgtctgcggaaaaccgtttgacgtcgcgcttgcgcaggacgagctcacgggagccctgatcggcctcgcgaggacctgtcgcgtggcggggacgcgcagcgaggctgcggacgagctcaccgtggacgggctcttcacctgcgtcaccaacgtggactttgacatcgaggccgtgaatgcgatcaccgagcgggttcgcgccgagagggaccgccttgccgccgagcgcggggtccgtcccgccgtcgacctccagatgggcggcctgtggtccgctgacgaggacgtccgctccctcaagtccctggtcctctttggcatccgcggcatggccgcctacgcctaccacgcccgcgtcctggggcgcaggagcgagcgcgtggacgcgttcttctccaaggccctcgccctgctgggcgacgaactgaccgttcccgagctgctgccgctcgcgctcgaggtcggcgaggtcaaccttgagtgcatgggcatgctggacgaggcaaacacctccacgtacggcacccccacgcccaccgaggtgccgcttgcggtcgagcctggccccttcatcgtggtgagtggccacgacctgcgtgacctcgaccttatcctccagcagaccgatggcacgggcgtctcggtgtacacgcacggcgagatgctccccgcgcacgcctacccccgcctgaaggcgcacccccagctcaagggcaactttggcaccgcatggcagaaccagcgcaccgagttcgacgccatccccgcgcccgtcgtcttcaccaccaactgcctgatgccgcccaagccgtcctactccgacagggtcttcaccaccgagatggtggcctacccgggcctgcgccacattgacggcgacgccaacgagaaggacttcactccggtcatcgagcgcgccaaggagctgggtggctacgccacgaggcaggagcgccacggcatcaacggcggctccacggtgaccacgggcttctcgcatggtgcggtgctctcggtcgcggacaaggtcgtcgatgccgtcaagtccggccagctcaatcacatcttcctggttggcggctgcgacggcgcccgccccggcaggaactactacaccgagttcgtgcgccagacccccaaggactccgcggtcctcacgctcgcgtgcggcaagtaccgcttcaacgaccttgacctggggaccgtcgccggcctgccccgtctcatggacgtgggccagtgcaacgacgcctacggtgcgatccagatagccgtcgccctcgccaacgcgtttgactgcggtgtcaacgacctgcccctctccatcgtgctctcgtggtacgagcagaaggccgtctgcgttctgctcacgctccttcacctgggcatcaagggcatcaagcttgggcccacgctcccggcgttcgtgagtcccaacgtgctcaaggtgctggtggaccagtttggcatcgcacccaccaccacgcccgaggcggacctggcggagctcctggcatagcgtctctcgcctggtgggaaacaacaacggaataggggacgggggatcagtgcgtctggcccccgtcccctttgcatgccctggggaccgtccgggcctcagctctcgcatgcctcgcccctgaacgcgatgccatctgatcgctaacgccgttaggcaatggaggaactgtggacgtccgcataacttgctaacgacgttagcgaatcgcttccctcggggtagtatgcaacagctagttaacgacgttagcaaactgacgagaggagcatgccatggattgcgacgaggcaacgcacgccgatggcagcccgcgggaggtcgactggaagggccttgcccgggagctgatcgtctccggtcgtggaatgagaaggggtcgtggggtgcggccaaaggacatggagatgcggggagagacaaacgccctccacgtgctgcaccaccatcccgagggcgtcacgccaaccgcgctcgcgcatgcctgccaggtgtcgagcgcccgcatcgcgaagacgcttaaccagcttgagggccgtggcctggtgaggcgcgaggcgagcccgtccgaccgccgcagcgtgatcgtccacctgaccgacgagggcgagcaggaggtccagcggaggttcgagcgggtcaacgactacgtggcgggggtcctgagcgagctgggcgaggacgatgcccgcgagctcgtccgcctgatggggcgtctcgcacggatcgttgaggggcgcgccgagtgtggccgccccgcaagtggggagggggatgatgccgatgaggctcgttaggctactgcgcgggcatgtgggtgaggtcgtcgccgtgttcgcgctgctcctggtgcaggcgttgtgcgagctttcgctgccgcgctacatgtctgacatcgtaaacgtcggcgtggtggggtcccaggcgggcaactccgcctacctgggccacatggcgctcgtgatgttcgccttctgcctgggctcgctcgcggcggcgacgctctcggggctcatcgcgtcgcgggtggccgccgccgtcgcgcgcgacctgcgccgagaggtcttcgccaaggtgatgtccctctcgcctgccgaggtcaacgagttctcgcagtcgtccctcatcacgcgctgcaccaacgacgtgcagcagatccagaacatggtcgtgatcatgctgcgcatggtcatgttcgcccccgtgatgggaatcgtcgccgtggtgcaggtcatgaccatggggggagggctcgcctggatcgtgggggcggcgctcctcgccgtgctggggatcgtgagcgtcctgttcacgctcaccatgccgcgcttcaaggtcatgcagtcgctggtcgaccgcgtcaacctcgttgcgcgagagatgctcgacggcatcatgaccatccgcgccttcgggcgccaggaccacgagctcaagcgctttgacggggcgtcgggcgacctcatgggcgcccagctgttcgtgaaccgcgccatgaccctcatgatgccgctcatgatgctggtgatgaacctgtccaccgtcgcgatcgtgtggtttggctcgcgcggggttgccgctggcgccatgcaggcgggagacatgatggcgttcatcacctacgcgatgatgatcgtgatgagcttcctggtcgtctcgatggtcgccgtgatcctgccccgcgccgaggtctcggtgggccgcgtgcaggaggtgctcgacgtggagcccgccgtgcgcgaccccaaggatcccgtgtcgcccgctgccgatgcgccccggggccacctggagttcgaccacgtgagcttccactaccccgatgccgagggtgacgtggtctctaacgtcagcctcaccgccgctcccggcaaggtgaccgcgatcgtgggctccaccgggtcgggcaagtcgaccctggtgcagctcgtgccgcgtctgtacgacgccacggagggcaccatccggctcgacggcgtcgacatcaggaggatgtcgctggccgacctccgctcgcgcgtgggctatgtgccccagcagggcttcctgttctcgggcaccatcgccagcaacgtcgccttcggggcggacgaggcgggcgagacggacctcctccatgccatcgacgtggcccaggcgaccgagctcgtctcgcagaaggccgaggggctcgaggcgcccatcacgcagggtggcaccaacgtgtcggggggccagcgccagcgcctcgccatcgcccgggcccttgcgacccaccccgaggtcctggtgctcgacgactcgttctcggccctggactatgcgaccgacgcgcggcttcgccaggcgctcgcgcgcgaggagtccgacaccgccgtgctggtggtggcgcagcgcatcgcgaccgtgatgggggcggaccagatcgtggtcctcgacgagggccgcgtggtcggcagggggacccacgaggagctcctgcgcacctgccccgagtacctggagatagccaagagccagctgagcgaagaggagcttggcctgagggagggtgagtaggcatggcagagagggtcgagcagccccggcagacgccgcgtccccatggcccggggtcgcgcatggcgccgggcgagaaggcaaaggactttggcgggaccatccgcaagctgctgcgctacatggggccgtaccgcgttggcctggtgagtgccatcatcctcgccatggcatcggtggtgttctcggtggtgggacccaagatcctgggcaacgccaccaccgaggtcatccgtggcgtgcaggcgtccgccgcgggtaagggcggcatcgacttcgccctcatcgggcggatcctggtgacgctcctgtgcatctacctggcgagcgccgcggcatccggcatccagagctggatcatgaccggcatcacgcagcgggtcgtgtatcgcatgcgcggcgagatcgccgacaagatctcgaaggtgcccctgtcgtacttcgacggcaaggccatctcaaagggtgatgtgctctcgcgcatgaccaacgacgtggacacgctcagccagtcgctcaaccagggcctcatccagctcgtgacctccatcacgcaggtggtgggcgtggcggtcatgatgatctccatctcgctgccgctggcgggggtcaccttcgtgacgctgcccgtctcggccgccatcctcgccgtcctcatcaagcgctcccagcgctacttcgcgctgcagcaacagcagctcggtgccgtcaacggacgcgttgaggaggacttctcgggccaggtggtgatccaggcgttcgaccgcaccgaccgcgcggtccaaaggttcgaggaggagaacgaccgactgtacgagagcgcgtggaagagccagttcctctccggcctcatgcagcccctcatgaacctggtgggcaacatgggctacgtgggcgtcgtggtcgtgggcgcggggcttgccgtgaccggggcaatccagccgggcgacatccagtcgttcatccagtacgtcaagaacttcacccagcccatcacgcagcttgcgaccgtctccaacgtgctgcagcagatggccgcgtgcgcggagcgcgtgttcgagttcctggaggcgccggaggaggaagagaccgcacgccctgaccccgccacgggagaggtgcctgccatcggccgcgcaaccggcggcgtggacttcgacgacgtctcgtttgggtatctccccggcaagacgatcatccacgacttctcggccaacgtggagcccggcaagaccgtcgccatcgtcggtcccaccggcgccggcaagaccaccctcatgaagctgctgctgcgcttctacgacgtggactccggcagcctgtccgtcgacggccacgacgtgcgcagcgtgacccgcgccgacctgcgccagaacttctcgatggtgctgcaggacgcctggctgttcaaggggaccatacgcgagaacatccgctttggccgcctggacgccaccgaccaggaggtggaggccgccgcccgctacgcacactgcgagcacttcatcaagacgctccccggagggtacgacttcgagctggacgagggcgcgaccaacataagccagggccagcgccagctgctcaccatcgcgcgagcggttctcgccgaccgacccatcctcatcctggacgaggcaacgtccaacgtggacacgcgcaccgagtggcgcatccagcgtgccatggacaagctcatggccggccgtaccagcttcgtgattgcgcaccggctctcgaccatccgcaacgccgacaccatcctggtgctgcgcgacggcgacatcgtggagaagggcacgcacgaggagctcctcgcggcgggtggcttctacgcgcagctgtaccagtcgcagttcgacgaggtcgcgtagggagcaggggagaagtgcgttacccctggggtggggcgtcgatccgtcggcgtcccaccccttgttcttgcggcggcttccgttcgcgcggagggctgcgtcgtggtctcgcggattccggatgtggccgtatcggggcccctttgctgggactcggtttgagtgcttgaagcgctgatcctgacagttgccccctctaagtcaaagaaggggaggggggcggaggcgccgctgccggcgcctccccgcgcgcccccatcctcggtcggcggcagcgggggtcggccctggcccgtcgcggggccggcaatcagcattcaaaccatggcggcgggagcccgatatgagtgcccatgtcgagcccccgcttccgggactgccggacgcgcggggcataaccccagttgggcgctggccaagccctgggccgtggcggcaagcccccgaggtgagcactcacatctggggtcccctgccatttggccctccgctccctcccgggcggcggcaactgcccgacgtgagcgctcacgtcgggatcctgccgccgcccgtcgatgcccgggggctacatctggccctcccacctgcgtaaaagcaagggtggggctgactgcgggatgggggtcgcctggagaaaccgctcgcatcgggcctccgccgccacgagctgaacctcggcgcgacccgtccccctcgaggggctcggggagggggcggatgccgcagggccgggcggcgcgcggcagccggcgggccccgggccctcggccctgcgcatccccgccggcggagcgcagcgttcgtgcccatgccagaaactgcatcccatgcgtacacgcgggacgaactttctggcggcgccgaagtcccggcgtcccgccaactggggaagcgccgcgtcgcggcgggcacatgtcagaaatcgcgtgccgtgtgtacacgcgggacgcgttttccggcagtgcgcgaggcatctagcgagagctcacggtattccattctttggcctggtcacccggccgtgtccgggaacctgcggaccctcgcttctccctgccaattgggagggggcgtatctctcctgacgcccaacgacctttagggattctttagaccttgctcccatcctcgtaggtgtcagaaaccaagcgaaggggggagagatgcctagccatcttgtggggggcgccacgccaggggagccagtagacaaccgaccgtcgcccatagcacccaagcccgtcctccagaccaaggggctcaccaagtcctttggccgggggagaaacgctcggaccgcagttgaggacgtgtgtctcaccgtgggagagggccaggtgtacggcctgctcggccccaatggggcgggaaagtcaaccacgctcaagatggtctgcggaatgctacgtcccaccagtggtcagatgctcttttgcggacacccctgggaacgccgcgacctgtaccagatcggctccctcatcgagcagccgccgctgtaccccaacctcaccgcgcgcgagaacctacgcgttcgcaccacgctcctgggaatccccgaaagccgaatccctgaggtcctgcgccaggttggcctggaggatacgggccgcaagcgcgccggacagttctcgctcggcatgtgccagcggctgggcatcgctctcgcgcttctcggccaaccccggcttctcgtgctggacgagccgaccaacggcctcgaccccatggggatagaggagctccgccggctcatcctgtccctcccggagcagggggtcaccgtcatcgtctcgagccacattcttgccgaggtctcgcacgttgccgaccacgtgggcatcatcaccaatggtcgtcttgcctatcagggggcgctcgaccgctccgtggatcttgaggacctgttcatggacgtgtgcgggagggaggcaagatgagagacgcaacaaatgtgttccccgcaatctcggcttccgtcagcaggcgggaggagctgcgtcgcgcgcttgcggcggagacccagaagacgcgccatggcagcgcccgcagggtcgcggtacttttcccgctccccctcgttgcgctcgggcttgccattggggtcgcttcgggcaagtctggcccaatcggctattccacctgtggctggaactactggtacaccctcatgcttcctgtgtccgtctcgctccagtgcgtctcggtcgcggggttggactcccgccactccctcaggtctgtgctggggctcccgctcgaaccgtcgctctcgtggtggggaaaggtcacgacgtgcctcctgctcctcttaacgtccaatgcagtggtgcttgccggatccgtcgtcgtgtgggccttgggtggcagtgcgccgactccgctcgcgggaattgagtctacgctcgtcctgaccattgggtttgcgtggatggttcccgcgtcgctcctgctctccctgcggataggtactctcgccggcgtcgccattccctcgcttgtgcagattggcggcggtatcgcactgtgggggagtgacgcctggtgggcgttcgtgccctccgccgcgcttcgcctgccctccgcccctctgggtgtggacccgtcgggcattcccgtcgcgccccagtcgtacgcaacctacgccatcaacgggacctggtgggccgcacttgccctctgcacggtcgcgttcgtcctgctgtcactggtcggggcgcgcctcgcgcgtggaggtggggcgtcgtgacaacacgcatgaccctcctcggggcacttcgctccgagctcatccgcttgcccaggtcttccctggttccgctgcacctcgtgcttgccctggggctcggcatccttgcgggctggtactttgccgcgacgcgcacctgggactcgctgctgggaacagacgccttcgtccagctgctcggtgccggggctccgctgctcgcgggcatctcctgcgggctctcggtcgatgcggatcgggaggcaggtagctgtatcaacctgcttggggtcccctcgcgacgactggcgataggggctcgtctcatctcgctcctcctgctcggcatcgtctcggcggccgtcgcgactgagaccttcgccattctccttacgagcgccggcaggcagctgccccctctgcgagcgatggcccagtccgtcctgggcatgggtgttggaagcgtctccctgtacctggttttcatcctcgcggcgctgcgctgggggagagacgcctccatcgggctaggcgccatcggcgctggcatctcagtcgtctcgcttggcggccttgccaacgggctcgttacgggtacgctctcggggctcctcggtgctagcgtcgcggcgttcgtgccctttgcctggcccgctcgccttgcttcgctcgaggtcgagctcgccgtcgcccacatgggtgagcggtacgcggcggcgttgcccggtctcgtctccgcgaagtcggtcgttctgggcgcgtgcctcgccgtaacgctcgcattcgtggctctgacgctggttctggcggaccgcatcgagcttgggggacggcacgacggctgagatacatgtccccggccgagccagggggtggagtatcgaccagggacccggggcactctcgccccgttatccctcggatatcatggcgggcgaggcatcggtgcgacgacggaaggattgggggttatggtggcacgcatactcgtggtggacgacgagcgacccatctgcgacctgctcgtgcgcggcctctcgcgcgatgggcaccaggtggtcgcagagactgacccaaccaaggttctcggaatgaacctgacatgctttgacctcctgctttgtgacgtgatgatgcccggcgtggacggctttgagctcgtccgccagattcgtgctcgcgtggacgcgcccatcgtcttcctcacggcgcgcgtgggcgaggacgatgcggtgacgggattgggccttggtgcggatgactacctgcgcaagccgttcggcatggccgagcttcgcgccaaggtcaacgcccacctgcgccgcgaggggcgcgagcgtcacagctccctctcgttcgggcgcatcaggctcgacctctccgcgcggcagctgctcgtggacgacgaccccgtacctctcacccccaccgagtacgccatctgcgagcttctcgccaggagccccggccaggtctttgatcgcgagcagattcgcgagcgtgtcatgggctggggcagcggggcggggtcggacgacgtttcggtccacgtcagcaacgcgcgcgccaagctccgtcgcgcgggcgtggaacccatcggcaccgtatgggggatggggtaccgatggcaggggtaggggagaggcccgttcccccagcggaggacgccccaacggcggtgcgggtcaagtcgccggggaggcatcgcgtcgggcggcgcattcccctctcgctcctggtcgcacgatacttcctgtacgtcctggtgggcgtgctccttgttgccggctttcccctcctcgccttcgagcacgcactctccagcggtacggtcttcccggcaaactacggcgagacaaacgtgggctcgctctccaagtccctcgcggcgcaggggtcgttcgatgcgggcgagataccctcggcgttctggtacgcgcatctctccgccggcggggaggttctgcagaccgatatggatgccagcctccttgcgaccgcccgtcaggttgcttcgagcggggcgtcaggtgccgagccgtcgggcgcaacgcttgtccgcgtccgtctctccgacggcagtacgtgcgtcctcgcataccgcatcatgccccagtggtccgaccgcgtccgtcgtgacgtgtggcccaatcctcagaacctccttgtagctgcagtggtaggggggaccgtggcggtcgtcttgctcgtcgcgctcagggcgggccgggtgctcacgcgagagatgcgcccgctcgtcgacgcggcggatgccgttgcgcgtcaggatctcgacttccaggtgggtcgcagccgggtcgcgcaggtggacgacgtcctgctctcgatggaccgcatgcgatcctcgctgcgggagtcgctccaggtgcagtgggagacggagcggcgttcccgcgagcaggttgccgccctcgcgcacgacctcaagacgccactcaccgtcgtccgcggcaacgccgacctccttcttgagagtgacctcggcgacgaggagagggagtgcgcgctcgccattcgcgacgccgcggagtcgcaggatgcctgcatccggcggatcatcctcgcgtcgcgcggcgagggggtggcggctgagaggcaagacgtcgacctcgggctcctgttcgagggaatagctaacgatgcggcgcggattgcccatgcgagcggcatcgagcttcgcgtggggaaggacgcaggggagacgggcaagtcctcccccctggagggaagggtcggacgcttggacgcggacctagtctcgcgcgccgtcctcaacctggtgggcaacgcctgcgaccatgcacgttcgtgggcgagactctgcgttgcggtgacggatgggggagacgggcgccctgccatcgaggtgatggtggaggatgacggcgcgggcttctctccgcgggcgattaaacacggggcggagcgcttctatcgcggcgatgcctcgcgcggtggcgtggccgacggagccatggggtcgcactatggtctcgggctctccgttgcccagcaggcagcgcaggcgcatgggggcgagctcgttctgggcaaccggacggacgccgatggcgtggtgcttggcgcacgcgtgacgctcagcctgcgcgtgtgatgcgccagggctaagggagaagggctacgtccccgagtcgcaggctctccgcgctggccgtcagccctcactggccccaactgccatctcccggttgcgccatgggtgaggggttgaagtgaggatccgggcggatgccctctcaaagtcaaagaaggggaggggggcggaggcgccgctgccggcgcctccccgcgcgcccccatcctcggtcggcggcagcgggggtcggccctggcccgtcgcggggccggcaatcagcattcaaaccatggcggcggactcccgaagtgagtgcccgcatcgagccccctccgccgggactgccggacgcgcggggcataaccccagttgggcgtaaatcaaaccctggatcatggcggcaagcccccgaggtgagcactcacatctggggtccctgccatttggccccccgctccctcccgggcggcggcaaccgcccgacgtgagcgctcacgtcgggagcctgccgccgcccgtcggcgcccgggggctacgtctggccctcccacctgcgtaaacgcaagggtggggctgaccgcgggacgggggtcgcctggagaaaccgctcgcatcgggcctccgccgccacgagctgagtctcggcgcggcccgtccccctcgaagggctcggggaggggggtgccgctgggcgcggcgcgcgtctccgaccggctctccggacccgcgggtccgcatccctctgcttgcgggccgcggcggccgtgcccacgtcgggaaccgcgccccgcgtgtacacgcgggacgaactttctggcggcgccgatgtcccggcgtcccgccaactggggaagcgccgcgtcgcggcgggcccgtgtcggaaatcgcgccccgcgtgtacacgcggggttggcttttcggcatccgcccgtccctcagggacgcttctgcctggaaccccgtcccgcgtgtacacgcgggacggggtttctgacggcgcgcggcagccggcgggcggcgtgggccgagcgggtggaccccgggaaaggcccgtcccggtgatcgccccgttccactggcccgccatctccccctctgaccatagatggtctctctgcccgcggtcggcacggctccctcggcgctcctccgcaatcgacggcgcgcgagacggcagacttccaacgttggcgacagatggctcgcgacatcctccccggcagtggacgtcatctgcgaggattcgcttacccgtgaaggagggattctgccgccctcctctccgacccgctccccttcgcagagatgcgggggagaggagctacgcctcctgctcccccagccccttctcctgacatgcggggcaaatgcccgagaacacggtgtaatgcgagactccagcgtatccggtggcttccgcggtccgcgcgtcggcgtccgacgcattgggatccggcacgtcgcacacggcgccgcacgaccggcacacgaggtgggcgtggtcgtccacgcgatggtcaaagcggtccccgcccggcaccttcacgtccaggatcctgccctcctccgcgaggaggttgaggttgcggtataccgtgccacggctcacgtgctcgtcctgccggcgcacggtgaggtagatctcgtccgcggtggggtggtcgtccagctgcatgaccgcgtcgaggacgagctgccgctgccttgtgttcctgcgctggaccatgatctcctcccatgggacgtctgtgttcccgacattctctcacagcccagaggatacccgttgtgccgtcaatattgagaacaattcctaattgtggagaaactgaggcgatgagaacccgtccgatggggcaattgacaacccgctccctttatcaataataagactcgttcccaataaagcgacgaaaggaaacgagatgtccctcatcaacaagcagattggcgagttcagcgtccaggcctaccagaacggtgacttcaagaccgttaccagggacgacgtcctgggcaagtgggccctgttcttcttctatcccgccgacttcacctttgtgtgccccaccgagctcgaggagcttgccgagaactacgacgccttcaaggccgagggctgcgaggtctactccgtctcgtgcgacacccacttcgtgcacaaggcctggcacgacgagtccgagcgcatctccaaggtcacctaccccatgctcgccgacccggcgcacgtcctcgccaacgacttcgaggtcctgatcgagtctgatggcgtcgccgagcgcggtgccttcatcgtcgaccccgacggccgcatccaggtctacgaggtcaccgcgggtggcatcgggcgtaacgccaaggagctcctgcgcctggtgcaagccgcaaagttcgtgcgcgagcacggcgaccaggtgtgccccgccaagtggcagccgggtgccgagaccctcaagccctcccttgacctcgtgggacagctgtaggatgccggccgaggaaaacctctacgacgccgtcgtaatcggcggtgggccagccgggctcaccgccgccctctatctggcccgtgcccgctaccgggtcatcgtcgtggagggggaccgctttggcggtcagatcaccatcacgagcgaggtcgtcaactaccccggcatcctcagcgcctcgggctcggagctcaccgacaccatgcgcaggcaggctgaagcctttggtgccgagtttcgcctggcccaggtgacgggcctcgaggttggcgatgacgtcaaggtcgtccacaccagcaagggggacctgcgctgcctcgccgtcctcatggcaaccggtgcctcgccgcgccaggtcggctttgagggcgaggcggagttccgcgggcgcggcgtcgcctactgcgccacgtgcgacggcgagttcttcaccggcaagcgcgtgttcgtggtgggcggtgggttcgccgccgcggaggagggcgcgtttctcacccgctacgccagccacgtgaccatcctcgtgcgcgagggtgacttcacctgtgcgcccgcgaccgcagaggtcgccaagtccaaccccaacgtcgacgtgctgtacaacaccgaggtcgtgcgcgtctcgggcggcgacgcggtggactccatcacctaccgcaatcgcgtaacgggcgaggagacgaccttctcggccggggaaggcgagaggatcggcgtgttcgtgttcgcgggctacgcgccggcaagccaactgctccaaggcgtctgcgagctggacccccgcgggtacgtccccaccgacgccaaccacatgaccagcgcggacggcgtctttgcggcaggtgacctgtgcgtgaaggagcttcgccaggtggccacggcggtgggcgaggcggcggcaacctccacctccatggagcgctacctcaaggcggcccacgaccgcaccggactcgtgcccacggctcccgaggtccgtcggccccaggtggcaaccacgacggaagagaagccaggcgaggcgggcgcgggcgcctccccgtcggccctcatcgacgccggcatgcgccagcagctccagccggtgttcgaccgcatggagagccccctcgagctcaggctccaccttgccgacgacgacgtatccgccgagctccgcgcgtacatggacgagctcgcctcgctcacgcccaagctcgcggtctccgttgcctccggggacgaaggcgggggagagggacttccctacgtcgaggtgtgccgcgatggcagtcccacaggcctcgccttccacggcgtcccgggcgggcacgagttcacgtcgttcgtcctggggctgtacaatgccgcgggacccggtcagccgcttgaccaggcggacctctccgccatcgagcgcattggcgccgacaccagcctcacggtcatcgtgggcctctcgtgcactatgtgccccgaggtcgtgaccgccgcccagcacatcgcggcgctcaacccccacgtgtccgcgcacgtgtacgacgtcaaccggttccctgccctgcgcgaccgctacaacgtcatgagcgttccgtgcctggtcgtgtcccgggaggggtcggacgagcgcgtgagctttggccgcaaggggctctcgcaggtgctcgagctcatcgggtgacgccagccgcgtcgcgtctcgcgtcggcatcgtccgccctgtccctctcccccggaggggcggggcgccaatgtcccggcaggcgagaaaggagggcgacccgcccgggagcatctcccagacgggtcgccctgtgcgtgcgacgatgtgcgtgcctgcgctacatctcggagtttccgcccgcgctcgcggagacggagtggttggtgtacacgttgtagatgcactgcgccagctcctcggcgaccgagatctgcttgatcttggagccgggctggttggcgacggcgcaggggatggcgtcggtgaccacgcactccacgatgggcgcgttctgaaggcgctcgatcgcctggcccgagaagatgccatgggtcgccgagacgtagatgtcgcccgcgcccatctccttgagcttgttgatggagcccaccagggtgccacccgtgtcgatcatgtcgtcgttgatgatgcaggtcttgcccacgatgtcgccgatgatgcccatgacctcggcggcgttgtgcttgggacggctcttgtgtgcgatggcgacctcgcagcccaggtagtcggagagcttcttggcgaccttggcgcggcccatgtcgggagagacgaccacggtgttgtcgaggtcgaagttcttctgcttgaagtagtcgccaaactggtagagggccgtgaggtgggtcacggggatgtcgaagaagccctggatctggccggagtggaggtcgagcgtgatcacgcggtcgacgccggcggcctcgagcaggttggccaccaggcgggcggtgatgggctcgcggctggacgccttgcggtcctggcgcgcgtagccgtagtgggggatgacggcggtgaagctctccgcggaggcgcggctggcggcgtccgcgacgacgagcgtctccatcaggaggtcgttcacgttctcaccggcgatggactggatgaagaagacctcgtcaccacggacggactcctcaaagcgggcgtagatctcgccgttggcaaacttctcgatcttgagtccctgcagctccaggtggaggatctcggcgatgcgcctggacagggcggggttgctcgtgcccgagtacagcttgatttccttctggtaggtggtgggtttgctcagattctcgtacatgccctagtcctcttcccttagccgcgcccaatactcgtctgcccagccctctttcacgaacatcttggagcgctccagcgcgagggcgccagccggaacgtctcgggtgatgcatgagctcgccccgaccagggcgttgtccccaatggtgacgggggcgaccatcatggtgtccgaccccacgaacacgtggtcgccaatctcggtgtggctcttgtgcttgccgtcgtagttgcacgtgatggagccgccgccaatgttgacgtcgcggcccaggcgggcgtcgccaatgtaggagaggtgcgggaccttggagccctcgccaacctcggagcccttgatctcaacgtgcgtgccggccttggaccccttgtggaagtgggcgccgccgcgcaggtaggcgcgcgggccgcacttgacgtcgtcgtcgatggcggagtccacgatgatggtctcgtccaccaggcagttgttgcccaccgtggcgttggtcaggcggctgttggggccgatgacgcagtcggtgcccacggtcgtctgtcccatgaggaaggtctgggggagaagctcggtgtcctgccccaccgtgacgtcgggcccgacccacacctgggtggggtccatcatggtgacgccctctgccatcaggcggcggttgatgcgcccctgcatggcgcgcgtcgcctcggcaagctggatgcgcgagttcacgcccagcatctcggcgtagtcgtccacgtgctgggccacgacgcccaggccgtgcgacttcaggatggtgggcatgtccgtgaggtagtactcgccctgcacgttgtcgtttccgacctcgccaatgtgggccgcgagcgcggcgccgtcaaaggcgtacacgcccgagttgcactcgagcagggttgcgcgctgctcgggcgtgcagtccttgtcctcgatgatctgctccacctggccgtcgccgtcggtgaccacgcggccgtagccgctcacgtccggcggggtcatggtgagcaggcaggcggactggtcgccccgctccacgcgctcaaccagcgcacggatggtctcggggcgcacgagtggggtgtcgccgtaggtcacgacgacggtcccgtcgctcacgccggccgcctcgagggcgaccctggtggcgtgtccggtccccaggcgctcggtctgctctacggtctcgactcccgggatggtcccaaggtactggcggacctcgtccgcgccgttgcccacgaccaccacaacgcggtcggcgcccgcgtccctgacggagcggactgcccatcccaccaggggacggtcgagcatcttgtgcataaccttgggatggcgggacttcattcgcgttccctcgccggcggcgaggacaatcgcggtaacgggcataaagtggcctccatgtgtaggtatccctgaccatgagtcctgggcagctgccaggaacgcccccatgataacgcacgtcttgcgcgtccatcccactgcgggttgcggtcagagcatgtccacagggtcgcacgcgacgtgagggttcccaacgctcccgccacgggaggcggcggcacccgtccgcactgactggcgcgcgcgaaaaaggcggtccgggcaccgtcgcccaaaccgcccctcgcagacgtggctggggcagagggattcgaacccccattgacggcaccaaaaaccgctgtcctagccgttggacgatgccccagtcgatagacccgcgcggcatggccgctgcggcgacgccattgtagcagaggagggcgagacgcccgatggggcgagggccgcctccgccgttcgtcgggggaggcttgccctgccagcgaggtcgctcatactttggggagcgtcgggcggcgagtgcgcggagggggcagacccatgctgcagaggttccagcgcctgggaggtgccctcttcacccccgtcctgctgttctcgttcgccggtctcatcgtggggctgggcacgctcttcaccacgccgcaggtcatggggcccatcgcggcggagggcacgctctggagcaaggtgtggcgcgttctgctcgcgggcggctggacggcgttcaaccagctgcccctgctcttctccctcgcccttcccatggggttggcaaagtcgcagcgcggcaggtgctgccttgaggcccttgccgtctacctcaccttcgactacctggtgggggccatcgtcaccgtcttcatggggccaggcgtgccgcccgggatggtctcgatcgccggggtcaggaccctcgatacgggcatcttcggcgcgcttgcggtctccggcgtcacggtcgccctgcacaaccgcttctttgacgtgcggctcccgcagtggcttggcgtgttctcgggcacggcgttcgtctacctcctgtcgttcgccgcctcccttgccatggcggtcggcacggtgctcgcctggccggcttggagggcgtgcctcgaggcgcttcgctcctgcatcctctcgtcggggtcatggggcgtcgccatcttcgtcgcaatcgaccgcgccctcacgcccctggggctgcatcacctcttctacgctcccgtctactacgacaacgtggtggtggacagcggaatctacgtgacctgggcgcatcagctcccccagctcgccgcaagcgggcgctccctcgcgcagagcgcaccctgggcggccctcagcgccacgggatggtccaaggtctacggggccccggggatggccctggcgttctacgccacctgtccgcgcgaccgccggagcaggctcgccgccttcctggtcccggccacgctcacctccatgctgtgcggcatcaccgagcccctggagttcgcgttcctctttgccgcgccccagctcttcgccctgcacgtggcgctctccgcgctcctcgcgttcatcgtcaaccacatgggggtggtgggggtgttctcgggcgggctcatcgagatggcgtcgctcaacttcatccccctcgccgcgtcacatggcgcggagtacctgcgcgccgcgggcgtcggcctggcgttcaccgccatctacttcctctcgttccgcctgctcataacgaggcttgacctcaagacccccggtcgcggtgacgggttcgacttcagtcggcttccagactggtaccattccgtgcggagcgaaggcggccgggatgggtccgaccggcattccaccgcgcggacgcatactggcgagacgcacgtttccccgctcgcccaggggatcctcgacgggcttggcgggacgggcaacgtcgtggggatcaccccgtgcatgaccaggctcagggtcaccgtggcggatcccgccgcggtcgcggacgacgccgcgttcgcgaccctcggggtcctgggcgtgttccgggccgggagctccgttcaggttgtggtgggcacgcgcgctcccgagctcgcggaggagatctcctccgtggccgggggtgacgcacgggacctctagtgggttgggggagtggctccatgggcaggccggtggtgttcttcgatgtggacgggacgctggggtgggacgaccccatcgcccgggaggggcgccccgaggaggagcgcagcgtctctccccgtcccagcgacgcggtatgcgatgccatacggagcctcgtggacggtggcgcggtcgcgttcctctgcaccgggcgctcgccggcgaccctccatcccgtcatccgcgagctcccctttgacggcgtggtgggcctgggtggcgcctacgtccgcgtgggcgaggcggtgctgcgcgaccggccgttcccgggggcggtcctcgaggcgctggagggccttctcctcagggcgcgctccggagcacagctggagtccgccgcgggcgtggtcgagctgcgcggcggcccccagggcctccaccaggggccggatgccccgcagaccatgcagggtgccctcgcgaggctgggagactaccgtgcgcacaagctcatcgtcccaacgcccgtggcacaggggctcatgctgacccccggcgcggcggaggtaatacacacgagcgagctcgagatgggcaacagcgaggtctcgctggtgcagaacaccaagcaggacggcgtcaaggccgtggtcgactacctgggcgaggacgcggggacgacctacgggtttggggactcccaaaacgacctgccgctctttgacgaggtggacgtggcagtggccatgggcaacgcctctgacgaagtcaaggcgagggccaacctggtcaccggaggggtcgaggaggacggcgtggccatgggcctgcgcgccctgggcctcatctaaggtcgtgcgtgccattcggcccgttggcgcattcgggctttaaggaacttgtcccttgtgttcctgaacctaatgttcgaacaacttgaagcggtttgctaacgacgggacaccaggttgtacgagaaggcgtcgggatggtagcgaacctgcgtgtactcaaacatcacgccctcggagttgaacgactggttctccatgaccgccacgcagttgtaggggtccaggtccatgtagctgcagtcctcgtcggtcgcgagctggacggtgatgcgccgcttgctggtgaggatgcgcatgtggcgctcgctctctaggaagtggtacaccgagccctcggcgatctctggggtcaggcccgtcacggcggatgccaggaagtagtcgtggtcaacctggcgcgccgccccgtcgagcgacctcacgcgcacgatgcgcagcagctccacgccctccgcaaagccggtcctgcgcgagaggcccgacccgcaggtcacctgctcaaacgacttcaccgaggtggagggggtgagtccgttgcggcgggcgaactccacaaacgactccacgccggagagcgacccctgggcgctgtgcccctcgcgctgccagatcacgcgcacgcccctgccgtgcatgggctgcacgtacgcgtcgtcggcaagcatcgagacggctctgcgcagggtgttgcgcgagcagccgtactgcgccgtgagctcgctctctgtggggaggaaatcctcgtaggtgtaggtgccctcctggatcttgcccttgaggtcacggtagatcccctcatatatggccttgggcattggtcacctccccatctcccgcactcatgcggggtcgcactcaacaggcgagcgcggggaggtcgttcctatggttcccacaagttgggatgtccatgtcctgtgggcgcagagacctccccgcacccaaaacaccagctcccacatagtagtcctccaagaggtctgaacgtgcggagtaccgtttaaccgaaaaatcgaccgttcgacctaaagtcatttgaacaagtttgttcacgctcatactcttcaaggtgaagtcagggcaggtcggggacggcctgcttgcgggcgagaggggccacgcccacagacgagacgggccccaaggcaaatgggaggttgcaatgaaggcgaacggtaacatcagcaggcgtcagttcgtttccatgagcgcggtcgcgggccttggcctcgcgctggccggctgcggcagcactggcggatcgagcagcacgagcgattctggctccggctcctctgcatcgggcaaggtctactacctcaacttcaagcctgaggtcgactcccagtggcaggagctcgccaaggcctacaccaaggagacgggcgtcgaggtctccgtcgtcactgctgcctccgacacctacgagcagaagctccagtccgagatgtccaagagctccgctcccaccctgttccaggtcaacggccccatcggcctcaagagctggaaggactattgcgccgaccttaccggcaccgacatcctcaatgagctcaccaacgacaacctcgcgctcaaggatggcgacaaggtcctgggcatcgactacgtcgaggaggactacggcatcatctacaacaaggacctgctgaccaaggctggctacaaggagtccgacatcaccagcttcggcaccctgaagaaggttgccgacgacatccaggcccgtaaggacgagctcggcgtcaagggcgccttcacctccgccggcatggactccagctccaactggcgttacaccacgcaccttgccaacatgcccatctactacgagttcgtgaaggacgacgaggagcagaccggcaccgacgccatcaagggcacctacctcgacaactacaagcagatctacgacctctacatcaccgacagcacaaccgaccccgcccagctcgccagcaagaccggcgacgacgccaataacgagttcgtgaacggcgaggccgtgttctatcagaacggctcctgggcctgggccgacatctccaagaagctcggcgaggacaaggtcggcatgctgcccatctacattggcgtggacggcgaggagaagcagggtctctgctccggcggcgagaactactggtgcgtcaacagtcaggcatccgaggaggatcagaaggcaacgctcgacttcctgaagtgggtcgtcacctccgacaccggcaccaagtctcttgcctccgacatgggcctcaactgcccgttcaagagcgccaaggagccggacaacccgttctccaagattgccaagcagatgatttccgacggcaagacgtccgtgaactgggacttcgtctggatcccgtccgagcagtggaagtccgacctctccaacgcgctcaccaagtacgcggctggtaccgacaagtgggatgccgtcaagacggcattcgtggacggctggaagaccgagtccgaggccaacgcggagtaacgccaacgcctcggcccaaaagggcctcccgtggggtgggcggacgtctgtccacccaccccgctcctatgcgaagggagttaacgcatggttaaatcactcaggaaatggtggccgctgttcctgcttcccacggcgctctcgtttgcgttcgggttcgtgatcccgttcgtcgagggtctgtacctctcgttctgccggttcatcagcatctcaaaccccaagttcgtgggcatcagcaactacgtcgccgcgctggcagacccgcagtttgcccactccttctggctcaccgcgctcttcaccatcgtgattaccgtcctgatcaacgtgatcgccctcgccatcgcgctctgcttcactcgcaagggcctcaagggcagcaacggcttccgcacggtgttcttcatgcccaacctcatcggcggcatcgtgctgggttacatctggcagatcctgatcaatggcgttctcaccatcgtgggacagcagctcctggcactcaacacggtcgccgggttctggggcctcgtgatcctgatgctgtggcagcaggtcggctacatgatgatcatctacatcgcggggctgcagtccatccccagcgactacctcgaggccgccaaggtcgacggcgccaccgcgtggcagacgctctggaaggtcaagatccccaacctcatgcccaccatcaccatctgcctcttcctcacaatcaccaatggcttcaagctcttcgaccagaacctcgccctcaccggcggcgctcccgaccactccaccgaacttctcgccctcaacatctacaacacgttctacgcgcgtgcgggcgccaagtggatgggcatcggtcaggccaaggccgtcatcttctgcatcctggtcatctgcatctcgatgattcagctcagggcgacccagtccaaggaggtgcagcagtaatgcagcgcgagaagatcaccaataggattctcacggtcgtattcaccgtgctgagcctggcgtggatctaccccatggtcatgatcctcgtcaactcgttcaagcagaacaccgccatcaccaccgggacggcgttcaacccggtcaccgccgagacatccgccggcatcgccaactacatcagtgccctgaccaagcagggctttgccgccgcctttggctacacgctcgtcatcacgctcacgtccgtggcgctcatcctggtgtgctgctccatgtgcgcctggtacgtggttcgcgtcaacaacaagttctgcaaggcgctctactacctgttcgtgttctccatggtcgtcccgttccagatgctcatgttcacgctctcgagcctggcagactccatgggtctcaacacgccctataacatctgcttcatctacctcggcttcggtgccggcctcgcggtcttcatgttcgccggcttcgtgaagacgattccgctcgagatcgaggaggccgccaccatcgacggctgcagcccggtccagaccttcttccacgtggtgctgcccatcatgaagcccacgtacatctcggtcggcattctcgagaccatgtgggtctggaacgactacctcctgccctacctcgtgcttgacagcaccaagtacaagacgatccccatcctgatccagtacttccgcggcgggtacgggcacgtggagctgggcccgatgatggcgtgcatcatgatgaccatcctgcccatcatcatcgtctacctgctctgccagcgcttcatcatcagcggcgtcgtctccggcgcggtcaagggctagcggttcgtcacagcaagaggcccatgcaaggactgttcgcgaccccggtgtgggtcccatgagaaaggcagacagatggccgagatcgtcctcaagaacatcaagaagatctatcccaacgagaagaccaagaagcaccggtttggcaagaaggcaaaggagccggagaagaagagcaacctccaggtgaccgacgagggcgtagtcgccgttcaggacttcaacctcaccgtgcacgaccgcgagttcgtggtcctggtcggtccctccggctgcggcaagtccacgacgctccgcatgatcgccggcctggaggacatctcctcgggtgacctgcttatcgacggcaagcgcgtgaacgacgtggcccccaaggaccgcgacatcgccatggtgttccagagctacgccctgtaccccaacatgaccgtgtacgagaacatggccttcacgctcaagctcaagaaggtcgaccccaaggtcatcgacgagaaggtccgctccgctgccgagacgctgggcatcacccagtacctggaccgcaagcccaaggccctctcgggcggccagcgccagcgcgtcgccatcggccgcgccatcgtgcgtgaccccaaggtcttcctgatggacgagcccctctccaacctggacgcgaagctgcgcaaccagatgcgcgcggagctcatcaagctgcgccacaaggtcaacggcaccttcatctacgtcacgcacgaccagaccgaggcaatgaccctgggcgaccgcatcgtggtcatgagggacggcttcgtgcagcagattggcacgccgcaggaggtcttcaaccacccctccaacctcttcgtcgcaggcttcatcggcatgccccagatgaacttcttccccgcgacgctggttcgcgacggtgcctcctaccagctcaagacccccaagttcaccgtggacatcgcgccggacacctgcaagaagctcgccgcctccggcgtggacgcggcggagaccgacgtcacggccggcgcgcgccccgagcagatcgagctggtggccccgggcgagaagggcgccatctgcggcaaggtcgtggtctccgagctcatgggcgccaccgtgcacgtgcacgcggacgtcaacggctccgagttcgtcctggtcatcaacaccgtggactttgacaagagcaagggctcctcgttcggcatcggtgacgacgtctggttcaagttcgagcccgatgcggtccacctgtttgacaaggagaccgagaagaacctcattcaggcctaggaccgggaggtagtcgccgcccaactccggcaacacagcaactgcggcggtgtgtcgggttgggcggcccctttgtgactggaaccagtaaggagcgaagatgccaaggacaagtggagtgctcatgcccgtctcggcgttgccgggagcatacgggatcggttccttcggggccaaggcgtaccagttcgcggacttccttgcacgctgccaccagagctactggcagattctcccgctcaccacgacgagctacggcgactccccgtaccagtccttctccgccttcgcgggcaaccccaacttcatcgacttcgacgagctcctcgacaagggctaccttgagcccgccgacctcgacggggtgccctttggggacgacccgggcagggtggactacggccagatcttcgtgagccgccggagggtgctcgagcgtgccgtcgaccgcttcttctccaatccccccaaggacctggaggagttcctggacgagaacgactggtggcttgcgccctactgcgagttcatgaccgtgaaggaggagtttgggctcagggcctactacgagtggcccgaggagtgccgcaggcgcggggaggcaacgtcggcgatatgcgcgcgcaaccccgagcgcatgcgctaccaccagatgacccagtacctcttctaccaccagtggcacgcgctcaaggactacgccaacgagcgcggcgtgcgcgtgataggcgacatccccatctacgtctcgcgcgactcggtcgagatgtgggagagcccccagctcttcaagactgacgaggcggacaacccgctgagcgtcgcgggcacgccgcccgaccagttctcgtccaccggtcagtactggggcaaccccatctacgactgggagtccatggcaagggaccactacgcgtggtgggtcgcgcgcatgcgcgccagcctggcgctctacgacgtggtgcgcatcgaccacttccgcgggttcgagtcgtactgggaggtgccgttcggctcgccgtcgtccaagtacggtgactggtcaaaggggccgggcatcgagttcttccgcgagcttgaggaccagctgggcaagctgcccatcatcgcggaggacctgggcttcctcacgcccgaggtcatccagatgcgcgaggacaccggcttccccggcatgaagatcctgcagtttgcctttgacggcgacagcgactcgtactacctgccccaccactacgagcccaacacgatcgcctacgtgggaacgcacgacaacgagaccgcccgcgggtggtacgaggacaccgccaccccgcgggagcgcgagcaggcggacgcctacctgcaccgcgcgaagggggaacccgcctcggcggccctcaaccgggcgattgccgcgtcggtgagcgacacctgcatctacaccatgcaggacctcctcgacctcggcaacgaggcgcgcatgaacacgcccgcgacggtgggtggcaactggagctggaggatgcgggagggtgccatcacgcgctcgctcgaggggtacctgtcgtccctgacccagacctacttccgcatgcccggtgcgagcggcccggagcttccccagtagggggcgcccggaacccgacctgaccatgcccgtcatcaccctatcaggaggacgaatgaccaaccttgaagatcgatcgcaggctgcctttggcaagccgctcgcacagatcagcgacgcccaggtgtgccgcctgctgcaggacctcgtgcgcgagcgctgccaggccctgcccataacggcgggcaagaggcgcctgtactacgtgagcgccgagttcctcatcgggcgcctgctcatcaacgacctcatcaacctcgggctgtacgacgaggtgagggagcagctcgcccaggcgggccacgacctcgcctccgtggacgaccaggaggtggagccctcgctgggcaacggcggcctgggtcgtctcgccgcgtgcttcatggactccgtggcgacccttggcctgcccggcgacggcgtgggactcaactaccattacggcctgttccaccagcggttcgtggacaaccagcagaccgcgctccccgacgagtggctgggcgagcaggactgcctggaggacgagggcaagagctaccaggtggagtttggcgacttctccgtcacctcgcacctgtactccatcgacgtccccggctaccacaacggcaagcgcaaccgcctgcgcctcttcgacctcgagggcgtggacgactctctggtgcccgacgactccatcgacttcgacaagaccaaggtggccaagaacctcaccctgttcctgtatcccgacgactccgaccaggacggtcgcctgctgcgcgtgtaccagcagtacttcatggtgagcaacgccgcacagctcatcgtgagcgaggcaatcgaacgtggcagcaacctgcacgacctccccgactacgcggtggtgcagatcaacgacacgcacccgaccatgatcatccccgagctcatccgcatcctcacgcaggagcacgggattgacttcgacgaggccgtgggcatcgtccgccacatggtcgcctacaccaaccacaccatcctggcggaggcgctggagaagtggccgctcgagttcctcgcaaaggtcgcccccaagatcgccaagatcatcgagcttctcgaccagatgcagcgggaggagcacgacgaccccgccgtggcgatcatcaaggatggtaccgtgcacatggcgcacctggccatccactacggcttcagcgtcaacggcgtggctgcgctgcacaccaagattctcgaggagaccgagcttcaccccttcttcgagctgtatcccgagaagttcagcaacaagaccaacggcatcaccttccgccgctggctcatgggctgcaaccccgacctcacggccctcgtcgaccagaccatcggcaccgactggcaccgcacggccgacctcacgccgctcatggcgcacgtggacgacgaggaggtgctccacgggctggtcgaggccaaaggcagggcaaaggcgcgcatgcgcgagttcctgctcgcccaccagggggtcacggtgccccaggacgccatcatcgacgtccaggtcaagcgcatccacgagtacaagcgccagcagatgctcgccctgtacatcatctggaagtatctggacatcaagaacggcaacaagccggcccgccccatcacggtggtgtttggcggcaaggccgcccctgcgtacaccatcgcgcaggacatcatccacctgatcctgaccctctcgtcctggatcgccaacgaccccgacgtgtcgccctacctccaggtggtcatgatcgagaactacaacgtcagcgctgccgagcgcgtgattcccgccgcggacgtctccgagcagatctcgctcgccagcaaggaggcgagtggcacctccaacatgaagttcatgctcaacggggcggtaaccctctgcacgctggacggggcaaacgtcgagatcgcggacctggtgggcgaggacaacatctacacctttggcacgcccagccgcgaggtcgagcgcctatacgccgagggggcctacgacccgcaggcctactaccgcaagcccggcatcaagctgctggtcgacttcatcaccaacccggcgttcatggccacgggcaacgaggagcggctgaggcgcctgcacgacgacatggcgcacaaggactggttcatggcccttctcgacctggaggagtacatccaggtcaaggagcgcgtgtacgccgactacgaggaccgcggggcgtgggtgcgcaaggcgctggtgaacgtggcccaggccggcaccttctcgtccgaccgaaccatcgcgcagtacaacgaggacatctggcatctcgttccccagaggtaggggagaggggcggggaggcgcagattgtctccccctgcctcgggtgatctcgcgtcgaggctgtctcgtaagggttggcgcgtttagggaggggctaagcgcgtcgatccttatgggactccgggcctcgtaagatctcgcgcgtttagggtggcgccaaacgcgtcaacccttatggagcccggatctgatgaggctggctgcgcctcggcgcaccttgcggtgccccatcgtccccggggcggccgcagcgagcgtcgccgggcccccgcccgtccgagggatgcgccgtcgcgaggtccctcacccccgacacccatcccctctcacacaggtacaaaagggaccccatctgccctgaggcgggtggggtcccttgtgcgttctggctcctcaggtgggggagaggtgctccgcgccggctagttgttgaaggccgtgcagatggcgtcgagcagcatgaccgcgaaggtctgcgcgtccgccgtggtgaaggtgccgttgtagtggttgcccagcggcagctccaacctgatgacggggggctttgccccgcgcgctccctcgcaggtggtgcgaatgcgctggggcagcgtgtccaggtcgtcgcacaccaggttcatgaccttgctatcgtccgcgaggggcgtggaggcaagcacgagcacgcaggtggtgccctccgaggcgtcggaggcgcgctcgaccagctcgagcccgctcttctccgtggtggcgcacgccaggttccagatgcggccggcgacgttgcggctgatgggatcctccgccgtgattgagagcggggtcacctccagcacgcctgccgcgcgggcgaagcccatgccgccggtgggatgcggtcccgccgcgggcttgcctgcccacacgtggcgcaggcgctcgacggcgtcgaaggtgtcgtcaaacgccatgccgtccgcgagcatgccctggctctcctggaactgcgccacggcagcctcggtgtaggcgccaaagtagccgtcgacctcgccgcacgagaagcccaggatgttgaggcactcctgcagctgccgcacgtcggcgccatggtagttggggaggcgcaggtacagggtcctgtcgcccatgtggtaggtctcgtccacaagctctgaccaggtcgccgagtcgacctcggtccccagcggcagaccgtggtccaggcggaacttggccacggcgctcgccgtcgtggagccaaagtcctgcggcgacgtctccctctggtcaatctcgtagccaagggaggcaaggcgcccctggatgtcctcgactgcggcaccctgcgcgccaacggtgattggttccataagcaactcctactcaagctgcgcctagtccaggcgctccacgaaaaagtctgccatagagaggagcgtcgcgcgcgcctcgtccaagacgtccacgtttgacaggtgcgactttgcggtgcggacgagcgagcgggcgtactcgcgggcatggttcaccccgccggcgcgctccatcagctcgacggcgcgcgcgagcccggccgcatcgctcgtctcccccgagaggagggagaggagctcgtcgcgctccgagcccgccaggtgggccagggaccagactgctacgagggtgcgctttccctcggtgatgtcggtgcggaagtccttgccctgcgccttggcgtcgcccacgaggttgaggaggtcgtcctggatttggaacgccaggccgcagtccatgccaaacgagcgcaggccctccacctggtcgtcggtcccgccaccgcatatggcccccatgaccaggggcacggcaccggagtagtacgccgtcttgtgggacgccatgtacaggtagtcgtccacgctcacgtcccagcggccgtcgcgggcccagcccaggtccagcgcctgcccctccacggtgcgcagctccatgtccgcgagctcgcgggccaggcgcagcctcgtcttgtctgggaggtcgggcgcgtccaggagcaggcggaacgtgtccacgatccccaggtcgcccacgttgatggcaacgcccacgccctccgtgcgataggtgcagggcttgccgcggcgcagctcgccctcgtcggcgatgtcgtcgtggatcagcgcggcgctctggaacgtctcgatcgccgcggcggcgggcagcgcgtcgcgcgcgttgccgcccaccgtctcggcccccagcaggcagagcgccgggcgggtgcgcttgcccccgccccgcgtgaagtcccacagcggggcgtacaggtagcgttcgaggtcatctgcgcccgcgtcggacgtggcgtgcggcgcaacctcgcgcaagtagccctcgaccaggggcctgacgcgcgtcaggtatgcgacgaaggcgccctgcgacggggatgccacgctactctccgtagccatcggggttcttggactgccagttccacgagtcgcggcacatgtcgtcgatcgtgtacttggcctcccatcccatctcgcgctttgccttggagcagtcggcgtagttggcgtccacgtcgcccgggcggcgcgggtcgatctggtaggggagatccttgccacaagctttggagaaggccttgatgatctgcaggaccgaggtcccctttccggtgcccaggttgaagatctcgacgcccgtgcggccgttcatccagttgagcgctgcgacgtggccggtgcccaggtcgcacacgtggatgtagtcgcgcacgccggtcccgtcgggcgtgtcgtagtcgttgccaaacacgtggacgcactcgcgcttgcccacggccacctgcgccacgtaggggagaaggttgttggggatgcccttggggtcctcgcccatgagtcccgaggggtgcgcgccgatggggttgaagtagcgcagcagcacgacgttccactcggggtcggcggtgtggaggtcggtgaggatctgctcgatcatccacttggtccagccgtaggggttggtcgcgggcttcttggggctctcctccgtgaggggcaggctgtcggggtcgccgtacacggtggcggagctgctgaagatgatgtccttgcaaccgtggttgcgcatcacgtccaccagggtgagggtgttgcccaggttgttgctgtagtactcgatgggcttgtggacgctctcgcccacggccttgaatcccgcgaagtggattacgcggtcgatggggttctcgtcgaagatggcgtcgagggcggcgcggtcgttcacgtcgaccttgtagaaggagaggttcttggccgcctcgtcgccaacgatcgtcttgatgcggtctacgaccttctcgctcgcgttgctcaggtcgtccgcgatgaccgtcttgtagccgttctggagcagctcgaccaccgtgtggctgccaatgaagccggcgccgccggttaccaggacgcaggtgtccttgggatccttggcttcgctcatgggtctcctctcgtgaggggtgttggactgcgcggtgcgcggccctcctgtgtctctttggtcgccgacgcatgtcgcgggggttgctgcgacacgtgcggaacaaccataaaagtatacgttcagcgtgtgtggcgagcgtgtgtggcgctctgtcatgggcgggggcttgggggacggttgtcgtccctctccccctggcgaccgccatcgtcggcttcgacccggtggcaggggtcgcgatgggcgtccgcccgccgaaaatgccatctggttagtaacaaatcttcctccgatgggtagacgccagacaacacaggacgccgcgaccccgttggggcgtgcggcaagcccgtccctgggacgggaaggcgagaaaggagccacccatggacatcaaggacgtcaagagggtgacggtcgccggtggaggggtcttggggagccagatcgcgttccagaccgcctaccgcggatacgacgtgacgatctggctgcgctcccaggggtccatcgagcgctgccagcccaagatcgaccgcctgcgcaagatctacctggacaccctcgaggccatgaagaccgacccctcggcctatgcgtacgggctgtgcgctcccgaggaggtcacgccggagcggtgcgaggagctcaaggccgatgtggagagggcctatggcagcctgcgcctcaccaccgactgggacgaggcgtttggcgacgccgacctggtgatcgaggcagtggcggaggacccggagcagaagaccgcgttctacaccgagctggccaagcacctgcccgagcgcaccgtcgtcgccaccaacagctcgacgctgctgcccagccagtttgccgaggccaccggaaggccggaccgctacctggccctccactttgcgaacgagatctggaagaacccgtccggcgaggtcatggggcacgagggcacctcgaaggagagctttgacctggtggtcgccttcacctcctcgatcaggatggtcccgctcaaggtgatgcgcgagcagccggggtacctcctcaacagcatgctggtgccgttcctctctgcggcggagggcctgtgggccggcggcgtgggcagcccggaggacatcgacctggcttggaagctgggcaccggcgcgccggcgggaccgttccggatcctggacatcgttggtctcaccaccgcctacaacatcggggtcatggatcctcgcgccaagcaggagggcacggttcaaaacaggatcacgacgctgctcaaggagaagatcgacaggggcgagaccggcgtgaatgccggcaagggcttctacgactactccaagtgacgtgacgcgggggcggtgatggcccatccgccggctgccggcctgcgggttccatcggatggagtcccggcgtcaggcggaagcgctagcggtggagacgaccgaggcgtcgagggtgcggccccatcccggattggttcgggatggggccgccctgtttcatggctttagcctgtgtcgcgccacgcgcgacacagagaaccacccgctcagcgggtggatgacactgacgctatgcaacaaaactccctcccctctaggatggcggttgttcaggtcgccggggtccgccgtccgcgagaggaggagaatacaccataggcacagaaggcgaacagcctccgcacaccaagtggatgccaacgtactcacactgtgttttgcccaaaaatgtataggagtaaggccaccctcacaaccacttaccgcgaggacctcgggcagatctcaggcagctatgccagtggcagggggtcggatcatcgaggggcatcctcatgcccgaccacgtgggcacatgctggtggagcatcccgcccaatactcgtgtcgagcttcatgggatacaggctagaggtgaaagatctctctcctccatgttcggacaggcacgcgaacgctagtacaacgttcggaacaggaagttcgtgcgagggctactacgtgtccaccgtctgctgaacgaagggccacgatcgcgaagtacatcgggagtcaggagcgggcgaccatcgccctggaccggctgagcgtcaaggagtatgaggatccgttcaagagggtagcctggcacagcccgtttgacgggcacgccacgagtcaagcggccatcgggcctgaacgaagtgaaggccagggacttgagtccctggccggcttttctgggttataccctaagagcaaaccacccgctatgcgggtggtaatgatttgtggtggcagggtaacgcggcccttgccctgcttgcgaatgaaatacctcccggggtggggccacgttgctgttgcggagtgatgcggccgatgccatatattgcatgatcgggcgatactgcgggcgtcgcgggtggcggtttcccgaaggggtgcacggacgtttggataacgtgacgccacggcagctgcgatggggctcgcagctggggatgcggcgcgggatgccgggtgcgcttgtgtggcaaggccaggcagcccgacattccccgcgttcgcgcatggacttagggagaggtgcttagcgggcttagccctcctgtggattcctgtgtcggatgcttaacgcctctagccctcttgtgagttgggcatcgaaaactcgcatgaggcctagcttcactaagcaatcgtgccgtcaatccacacgaggcctaggttcgctaagcacccgggctgccaatcgacccgaggcctagcttcgctgaacatctctcccccaaattcgggctcttcgtcacttctggtgggtagcagatccttccgccgcacgccccgaggcccccggacggtagtatgtcgcctgaagacgtgaggacgacgtgacgggggctcctatggacgcgcaggccgggctgctcgcgaagctgttcgagaggtcgatggggctggggagggagtgggaggtctccgaggtctggttcgaggcgagggagggcgcccccgacgagctccacatccgcgtggcgcgcgtgaggggcgcggccgtcgagtgcccggagtgcggcaggcgctgcggggtctacgacacccgcgagcggacctggcgccacctcgacatctggcagtacgagacgatcgtccactgcgccgtgcccagggcggactgccccgagcacggggcggtcaccgtccgcgtgccctgggaggttcggcccaactcccacttcacggcgctgttcgaggcccaggtgctcgcgatggccatgtccgggctgacggcgacccagatagcctccgaggcgcgggtgtccgacggggtcgtctggcgcatgctcggcagggccgtctccgaggccagggccggcgccgactactccggcgtcgtgcgcgtcgggatcgacgacaccgcgtgcaggcgcggccagagctacatcacgaccatggtggacctggacggccggcgggtcgtggcggtcaccgagggcagggacaagggcgccgtggggcgcctgtgcgacgagctggagggccacgggggcgaccgcggggcggtcctcgaggtcacccgcgacatggccgaggcctacgcgcgcggcgcggccgccgagatgccccgggcggcgcagaccgtggaccggttccacgtgatgcagctcgcggcgagggccaccgacagggtcaggtgccgcgagtcgaggtcgtccgaggacaagaggcgcctgctcagggggacgaagtactgctggctgaagcgccccgagaacctcaccgagcggcaggccgccaggaaggagtcgctcatgggcgagcacctcctgaccgcccgcgcctgcgcgatgaccgaagcggtgcgcgccgtctacgcccgcccggaccgcgagagcgccggcagggagctcgaccgcgtcgtctcctggatcatgcactcgaacgtcccggagatgaagaccgtcgcgaagacgctcaggagggagcgtgaggggatcctgaactggttctcccgcagatccaccaacgcgaccatggagggactcaactcgataatccagtcgatcaagagggcggccaggggcttcaggaacatctcctacttcgagaccatgatcttcctcaggctcggccgactggacttctcggcccagcttgccgtctcatctgctacccactagaaacagcgaagagcccaaattcgtgcgggggctagctttgctaagcacttctccgcccaaaccgcgtaggtgcttaaagttcccggtgcccgtacgggttgggagtccggcgtgcttaaagttcccggtgcccgtatgtgttgggcctcggacgtgcttaaagttcccggtgctagtgcggatttaccgacgccacgtacgtgcaggcaccgggaaagttaagcatgctgtttgaaaatccgtacacgcctcggattctttaagctgcctagccctccgatccgtgctcgctccgggaacgttaagccgcaaggtccgcctgccgtgcaggtgccggtcgacagcgcgcagcatggcggctggcatgggggcaaggcccgctcgccgtgaggatgccgggtttctaagctgtcgaacctctccaaacgtacttgggtacagaggagggtagcggctgacgggcgtgccatggtggcgggtccgccgccccaggatgggggaaccatggcaattgacctctgcgactgcaggtttgacggcgacgggcgctttgacatctcgaaggcgcccaccagccccgacgtgaagaaggacgagcgctttgactacgaggagcgcacggccggcaacgcggtgctcatggggcagctgcaggaccgtctctatgccgagggcagggagggcctggtggtcctgctccaggcgatggacgctgccggcaaggactccacgatcaagcacgtgatgagcgggatcaacccgcagggggtcacggtccacagctttaagcagcccagcgcggaggagctctcgcacgactacctgtggcgagccgtcacgcaccttccgccccgggggcagatcgcgctgttcaaccgctcgtactacgaggacgtgctggtggtgcgcgtgcacgcgctgtggaggggctacaagatgccggagcgctgcaccaacgactcggagcggcagttctttggcaagcgctaccgccagatccgcgacttcgaggagtacctgtacgagaatggctaccgggtgctcaagatcttcctcaacgtgagtcccgagcagcagcggctgcgcttcctcgagcgcatcgacgaccagtccaagaactggaagttctccggcagcgacatcgcggagcgcaagctgtggcccagctacatgcgcgcgtacgaggacgccatcaacggcacggcgaccaagcacgccccgtggttcgtgattcccgccgacaagaagtggttcgcgcgctggctcgtgagcgaggccatcgtggacgtcctgcgccagatggacccactctacccggagctgccgcaggaccagcgcgacaagctggccgactacaaggcgcagctcctctccgaggatggccccaggggagagtagcgcacggccagggggatgagccgggggagaggggccgcgctcctctcccccaaccgctgccgtcggccctagtcccggtcgccttcggaccggtccacgtcgtggcccccgcccagcgtgtagcgggtggcggcgtggagcatgttgacctcgctcagctcgagcttgccgtcgatgtagggccggtacatggcctcgatggagcccacccccatgctgcacccgctgcagttctcgcagctggagtcgtcgcagaacgagagtcccttgttcactatctgcatgcgctcctcgcgcgtggtgtccttgatcaacacgctcctgggcatcgctccccctctccttgcgtcctcgtagttgtaccccaggcggcgcggcgggatcgtcgtgcgcctgcttcgaccgcgttgctacacttggatgccatgtgcaggggagaggtgacgccgtgtcgtaccgcgctaccctccgatgcgccaggcggtcgagcgagaggggagtcaccatgggcatgggccatcgtcccgaccgaagcgggaaccccatctcgttcctgggctttgggtgcatgcggtttgcgaggtcgggcggcggcatcgacgtgccccgtgccgaggagcagctcatgcgcgccatcgagttgggcgtgaactacctggacaccgcctacgtgtaccccgggagcgaggcgtgcctggggcaggtgctcagccgcaacggctgccgtgactcggtcaacatcgccaccaagctcccgcagtacctggtgaggagcacgtctgcggcggaccgctacctggacgaggagctgtcgcgcctgcgcaccgaccgcatcgactactacctcatgcacatgctcaccgacgtcgcctcgtgggagcgcctgtgccagctggggatcgagggctggatcgagcgccgccgcgccgccgggcagatccgcaacgtgggcttctcgttccatgggagcagcgacatgttcctgcgcgtgctggacgcctacgactgggacttctgccagatccagtacaactacgtggacgagcacacccaggcgggccgggagggcctgatggccgccgctgagcggggcatccccgtcatcatcatggagcccctgaggggcggcaacctggtggacgggctcccgcgcgaggccaagcggctcatcgccgaggacccgcacgggtggggcccggcggagctggcgctgcggtggctgtgggaccagccccaggtcacctgcgtcctcagcggcatgaactcgctgcagatggtggaggagaactgccgcgtcgcgagctccgtgcgcgcgggggagttcggcgagccggagcgcgagctcgtggcgcgcgtgagggagctcatcgccgcgtccaccaaggtgggctgcaccgggtgccgctactgccagccgtgtccggcggggattgacatcccggcgctcttctcggcgtggaacagcatgtacctggaggggaagtcgcgtggacgccaccagtactaccagacggtggagctgcgcgaccatcccgcgttcgccagagcgtgcctggggtgcggacggtgcgagcgcctgtgcccgcagcacattcccgtgagggaggcgatcgtggaggcggaccgtgacctcaggcccccgctccatcgacttgtgggtaccgtcgcgcggaggttcgtgaactcgtaggcacaccgtggggtgcgacgtgggtcgacggctgctcgggagcgccacctgtggcggttggcgagcgggcccgcgcatggggtgctgagaaaagtcgagttgtggcaatctgaaagtcgattccgccgggagaatgggggtattggcagtcagggaggcccttcggaggctcgttcgctgccattactcgacttttctcagcggaaaaccgtctcggattgccacaactcgactttcctcagcaccctccccgcgaggggtcgccgagaccacggcccagccatcgtctccctagggaagaagcccatccccatcccccagcgacctgcctaggccgctgccgatcggacgcaccggcgtgcccggccacgagcggatggcctccagcatgccgtccacgtccagcaccccgtaggcaaagcccttgcgcaccagctcgtcgggaacgaactcgtcgtacttgtcaaagcgcggcacctcgcccgggtacaccagctccatggggtcgatggggcgtgctgcctcctcctgcaccacgtcgtagaacgtctgggcgtcggcccgcatggtgaactgcatgaagtacggacgcgaggagtccagccccttcatgcccagctccgccgcgcacctgatcttgagaaagcgctccagcgccaggaaggcgtagctgcccagccaggggaacaggcaccacgacgtgccgcccaggcacaccaggggctggtcggtcacgtgggcgttgcgtgccacgtgccgcgcctgcgacagccgcgcccgggcgttccttcgcaggtaggggtacatggcgtcctcgcgcagcgcctgcctcatgcgccgcagcacgtgcgtgtccacgtcgcccgcgcacatgccaaagtacgcggggaccttgcccttcacctgcgagcactcgatgaggtggcgcttgtagtcgatctcctccaccacccacacggcgccggcgatggctatgcgctcgcccacggggggcggctgcacgatggtccccagctcctgcgactcgctgcgcacggtgaattcctcgtcctccgagaacaccgcgtaaaagcggaagttgttggtcacccgctcgcccgcgagccccacgatgagcccgcccgactcggtccgctggatgtggtcgatgtccagcaggtgtcgcagcagcacccggtagtcgtcggcgctcacgcggtggaacggcgtcagcgtgagcacgcgccgcgcgagctcggagggcgagagttcgccggacgaggcgagcgtggccatggtctggtggtacaacaggctgtaggggaggccgttcaggcgcgggggctccacccagcggtcctccaggtatagctggaccagcgcgattccctgcagcagcttccacgggatggtctcggggagcagggcgcgcgactccggttcgtcctcccgcatgaggaaccacatctcgctcggctgaccgcgccgtcccgtgcgccccatgcgctgcagaaacgagctcaccgtgaacggggcgtctatctgaaaggcccgctcaagtcggccgatgtcgatcccaagctccagggtcgaggtcgtcacggtggtgaggttggtgtcctcgtcgcgcatcagctcctcggccgactgcctaaagctcgccgagaggttgccgtggtgtatcaggaagcggtccggctcgtccaccgcctcgcagtactgtcgcagcgtggtggtcacctcctcgcactcctcgcgcgagttggcaaacaccaggcacttgcggcccctggtgtgctcaaacacgtaggcaagccccgggtcggcaaagaccggcgcacggtcgctcaatggctcgggggccggttggtcggggtaggggagaggtgcgcgccccccgacctcgccacccgtcccgtcggcatcctcggccgcctcgccccgggcggggatcgcctggtcgccggcgggagtggtggggacctcgtagtcgggctcctctcccctggggacggatgcgccgcccaggccgtcctcgccgcgctcgggcgcctggggcccgctcacgtagaagtgctccatcgacagccgccagcgctccttgggggcctcgagccgcgggatcacgcagccgcgtcccgttccggcggagaggtacgcgcccgtggcctcgggctcgccgatggtggccgagaggccgatccgcctgggattgacgcccgccaggcgcgagatgcgctcgatgcagcagagcgtctggtcgccgcggtcgccccgcagcagcgagtggacctcgtctatcaccacgtagcgcaggtcgccaaagatgcgcgggatggcgttgtggcggtgcaggagcatggcctccagcgactcgggggtaatctgcaggatgcccgacgggtgcttcatcatctttgccttgtgcgagcgcgacacgtcaccgtgccagtgccacacggggatgtcggcctgcgcgcacaggtcctccaggcgtatgaactgatcgttgatcagggccttcagggggccgatgtagatgcagcccaccgaggcgggagggtcctcccacagctcggtgaggatggggaagaaggccgcctcggtcttgcccgacgccgtggatgcggtgagaagcacgttctggtcggtgttgaagatggcgtccgccgcggccacctgcaccgcgcgcaggctctgccagtcgtggtcgtagatgtagtcctggatgaagggcgcgtatcggtcaaagacgtccatgcccgccgcctagatctggaactcgctgaactcgtcgctagctcccgccgagccgtcgccctcctgggcgcgcgtggtcacgggggacgagaggagctcgccctgcagcaggtcgcccaccttgagggaggggttctggcacaggatgtcgagcatctcaacaaagtccctgatgacctcgcgcggcgtcaggtgggagtccgcgcccacgcgcccgaactcggcctggaggaagcccaccagctcgtccggcgtgatggtgcgctcgtagccaaagagcccggcatggatgtccgcgagcttctccaccagcaccagcagctcctcgtgcgtgaggggctgcaggtggatgaccggcgccagcaggtcaaccagcccgtcctgggcaaagcgcccctgcgtcaggcggctgcgcagcgcctcgtacgagtacaggccgcgcctgcggtcctcgatggactgcggcgtcccgcccatcacgatgcccaggtggtgcgccttgccctggagcgtgtcgttgtacatggtcaggatcttctcgtagttgtactggcggctgacggcgttggggatcttgtacaggttgaccagctcgtcaaccagcaccagcagccccttgtagcccgcgcccaccaggaaggtcgcaaagagcttgaggtagtcgtaccagtcgtcgtcgccgatcacgatgctcacgcccagctcctggcgcgcctcggtcttgttgcggtactcgccgcggaaccacttggtgaccttggccttggtgtcgtcgtcgccctccacgtgcgcgtgccagtacatggtgaggagacgggcaaagtcgtagccgtgcaccagctcctgcagggagcgcatggtctggactatggcggcgtccatggcatcggagaagcctgggtcctgcggctggaggcccctctccagggtcacctgggcctgcatgttcgacacccagcggtcaagcaccaggttgagggcgccgccctcggggcgggtccgcgtgctcatgttgcgcacgagctcgcggtaggtcgccaggccctggccgttgccgccctggaggcgcctctcggggctcaggtcggcgtcgcacaccacaaagccgctgcccatggcgtggttgcggatggtctgcagcagaaagctcttgccgctgccatagcgccccaccaaaaagcggaagctcgccccgccgtcggccaccaggtcgaggtcgtggagaagcgcctggatctcgcgctcgcgccccaccgtgatgtacggaagccccacgcgcggcacgacgccgcccttcagggagttgatgatgaccgcggcgatgcgcttggggacgcgcgggggctgtcccgcctgtccgccggctgccgatgcgtttgcttgctgcgtcattgctccagggttcctctcaggtcttcctcgtagtcctcgatcacgtgggggccgtcgtcgccaaactccaggacggtgtcgccctccaggtcaaacagcttctcgttggcggagtccaccagcatctccacgctgggagagccgggcggcgccggcggtgccggcttgccgtccaggagggcgcgcaccagggcaagctccagggggtcgagcccgtacggtgccgtctccccggcggcgcccgtggctgccgcgccggtggcgggttgcggggccacgggggctggctgcccgggcgagacggttgccaacgcgggggccgcgtccctctcgcccccctgcgttccctcccgcgacggggcgtgctcgtcccctgccacgggtgcgggcgagacgggctgcgcccagtcgcccgtggtctccgcgccggggacgtagccctcgcgctcctcgtccaccagcagcgcctcgcgcgtggtagccgcggcagagcggatgcttcccagcttggagaggtccaccgtgaaccggtggcgctcctcctcgcgcgtgcgctcgagctccgcctgcacctcgcggtcgatcatcgtctggaggtagcgggggagcgtgcgcggcttgagctggcgtgggtactcccaggccacgcgcatggcgcagtcgacgccatggacgatcctgccgaggtcgcggctcttgccctgcagctcgtaggagcgacgcatgacccagcggttgaagcggcaggtgaccacgtcagcctcggtcaggcgcatgtcgccgccctccagggtgggaggcttctccagcgggaccccgaccagaggcatgtaggtggtgctcatcgtgaaccccagcatgccgtccacaaaccccaccttgcgcctcttgccgcagtggagcgccatgcgacgaaacacgccggcgccaacgcgtgcggcctgcccccgatgctcgcgcaggaacggggagcgccccgggtcggtgctcgagagggtgcccatggcatcccacaggtcctggtccgacggggccttgggggcatccgagggcttgcgcccgttgacgccctcgcggcacagcaccgatccctcggcatcgcgcagcacgcggacggcgtggccaaagcggcgctcctcctccgtggtggcgagccgtgggtcaaggcggtggaccatcacgtagtcgcggatccagtggctcacgtccagcgtgacgctcggtcccctcccggcaaggtccatcgcgcgacaggcctcgcgcaggcgctggagctcgcggactaccggctcgcccggctcgcaccccacgccgttgatcagctcgtaggacaggagcatggcgaaggtcgcgggggcatccttggcctccccactcctccacaaggcgcgccaggtgaagtagccacggagctcgcggtcgctcacgacctggtaggtggggaggtagcgataggggagcgttccctggtaggggcagtcgtccacgaagtcacgggcgagacgggcctgtgccacaaagagcggaccgccgcgcaggggccttccgtcctcgtcgcgcgcgccctcgagctcgcggaggcgctgcagcatgggcggaagctttgtctccggcgcaaccttggccatcgggccggtgccggatcccagggggcggccccacgggtcgtcgtcgaggctcccgacggattggtagtccccaagccagtcgtccgtgagcacgcgcctcttggtcgcggcgcgtgacttccgcgcgtcggcggaggattggccctgcatccgagaggagcgagacacacgtgacccgcgggagtgattgccgtcgggccccgccatctgggccttgccggttgagacgggcttgtctccttgccccgtgtgcccacccgagcgttcccgatccctcgcccagtcagaccccttccgtaggattggctggtcggagtaggtgtgcgaggacagctgggatgaggcggccgcctcctcgaacttcctcatgatcctgtcgaccagctcgtcgatgttgaccttcccaacgttctccgccatgccacctccccgagggtcaaattgtcgcaacaccacgattctacccgcaggtgaagacacagggaacacatgtacgaggaatgcgggggaggtcgctggcgtcgggggctggggacccgagtgtcggttacgccgagaagcctcgggggtcaaagaggggggcgcaatgtctccatgggtagcggcctagggacgtcccacactgcagtcccccttgcaacccctcttggtcaggaggaatggcaactatggcagcagaggtctcgcatgagcactcacgcgagcgggttgctggcagcggcctcgtccgcggtgccccgatggcaaccaacgcccgacgtgtgtgatttcccgagagggacaggcttcgaggaccgtgccgggcggacgtttccccagttggaagggaacaacgggaagcctgtctcccgacccgtggcagcaaactcccgaagtgagcactcatgtcgggattccgttgccaatcgagccctggcgatggtccgcctggcagcagactcccgatgtgagtgctcatttcaggcttccgttgccacctgtcgttgcccggattcaaggctggatcccctacctgcggacatgttgagattggtcttgtctccggacggaagcctatcgggcaagccgatcatatcggccattcgttgccatggttcgagtcttgatatcaagtccatgcctttccgaaaaactcaaggaggggaaacggccacaatccacggggggcttggccgtggagatgcgccttccctttgcgtcgacgttgggacctgcagcttgcctggccgatgggcgtctttcggaggggcccgtgaaatagggtttggggtgcgggaaacgagggacgctgcgtgaaggcaaatcgcttgatcggggggtgtcggtccttcggttcccgcagcgggtggctcacgattacgcgcgctccgccgccccgggttccggaaccgcacggtcccttgtcggaaatctcgtccagtgtgtacacacgggagggactttctgaagggattggggtcctgatgtcccgttaccaggggaaacgcgccagcgagacgggctcgcgtcagaaacctcgtcccatgtgtacacacgggagggactttctgaagggattggggtcctgatgtcccgttaccaggggaaacgcgccagcgagacgggctcgcgtcagaaacctcgtcccatgtgtacacacgggacgagttatctggcatcaagggggtctggaggagcatccgtgtctacaaccccgcagcgtgtgtacacacgggagggactttctgacgggattggggtcctgataccccgctaccaggggaaccgcgccagcgaggatggtccgcgtcaggaaccttgtctcatgtgtacacgcgggacgtactttctggcagcggcgggcacggtgccccaccgcaatccgcctgccggcccagcctcctccccttgccagaaaagggggccggccacccatcggcgaccggccccctcatcgcgattgcgtcgtctctactccgtgaagtaggccacgccaccctcgaacagcggctggtacaggttaccgggcacgttctggaacgtgccggcggtgtagcgctccgtgtggcccatcttgccaaagacgcggccgtccgggctggtgatgccctcgatggcaagcaccgagccattggggttcacgtcgagccccatgccgggaacgccgttctcgtccacgtactgggtcgcaatctggcccgccgcctccatctgtgccaggacgtcgtcgttggcgacgaagcggccctcgccgtggctgatggcgatggtgtgcacgtctcccacgttgcacttggacagccagggggagaggttcgaggccacgcgggtgtgcaccagtcggctctggtgacgaccgatggtgttgaacgtgagggtggggcactcgtcgtccatgggcctgatgtcgccgtaggggaccaggcccagcttcaccagcgcctggaagccgttgcagatgcccaacatgaggccgtcgcgtgcctggagcaggtcgcggaccgcctcggtgacctcgggcgcgcggaagaaggccgtgatgaacttggcggagccgtcgggctcgtcgccgccggagaagccgccggggatcatcacgatctgggagcgctcgatctcgcgcaccagcgcctgggtgctctctgcgaccgcggacggcgagaggttgttgatcaccagcgtggtgacgtcggcacccgcgcgctcgaaggcgtgggcgctgtcgtattcgcagttgttgccggggaacacgggaatcaccacgtgcgggcgcgccacgcccacggcaggagccttgcgcgagaccccccgttcggcgacgtcgaagctgaccgccttgaccgtctcgcctgcctcgcggtacgggaacacgggctccatcttggcctcccaggcctcctggagcggcgcgaggtcaagctcctggccctcgacccacatcttgtactcggggctggtgcctcccagcacgcgcacggagaagcccttggtgtcaccgggcacgtaggtgctgtcgctcacctcgagcacgaagctgccgtagcggtatgcaaacaggtcgtctgccgtgaagccgtccgccaggccaaagccgatctggttgcccacggccatcttgaagagcgtctcggccaggcagccgtagcccggggtcgccacgctcagcgcgtctccgtagccaattgcctcctgcacaaagtcgtacacggcgaggagcgacttggggtcgggggtgacgccgtcctcgcggtaggtgggctccaccagcacgagcttgccgttggtggtcttgaactccgggctctggatgcggttcaccttgcccaggcccgtggcaaagctcacgagcgtggggggcacgtccaggtcctcgaacgagccggacatggagtccttgccgccgatggagccaatgcccaggtcgagctgggccatgagcgcacccagcaccgccgccacgggcttgccccagcgctcgggctcctggcgcagcttctcaaagtactcctggaaggtgaggtaggcgtcctgatgcctgatgcctgccgcgaccagcttggacaccgactcgacgacggagaggtacgcgccggtgtactggttggcgctcatcaggtaggggttgaagccccacgccatgcccgagaccgtggtggtctcgccatccacggggagcttggcgaccatggcctcgctgggcgtgagctgcgtcttgccgccaaagggcatgagcaccgtcgctgcgccgatggtggagtcaaagcgctcggagaggcccttgttgctcgccacgttctcgtcggtgaggagagactccatgcgctcgcccagggtgtcgcccgcccagctgggggcgtagctgccctgtgcctccacgtgcacgtcctggtgcttgggagcgccgttggaggagaggaactcgcggctcacgtccacgatcgtctcgccgtcccacaccatcttgagccggggctcctcggtcacgcgtgccacgacggtggcctcgaggttctcctcgtgggcgtagcgcaggaactcgtccacgtcctcgggggccagggccacggccatgcgctcctgcgactcgctgatggcgagctcggtgccgtccaggccctcgtacttcttggggaccttgttgaggtcgatgaacaggccgtcggcaagctcgccgatggcgaccgagacgccgcccgcgccaaagtcgttgcagcgcttgatcaggcggcaggcgtcctcgcgacggaacagcctctggagcttgcgctcctcgggggcgttgcccttctggacctctgcgccgtccttctccagggactccacgttgtgcgccttggacgagcccgtggcgcctccgatgccgtcacggccggtgcgcccgccgagaagcacgatcttgtcgcccggcgcgggggtctcgcggcgcacgtggctcgcgggggtcgcacccaccacggcgccgatctccatgcgcttggccacgtagccggggtggtacagctcgctcacctggccggttgccaggccgatctggttgccgtagctggagtagccgtttgcggcggtggtcacgagcttgcgctggggcagcttgcccttgagcgtctggctcacggggaccagcgggtcgcccgcgccggtcacgcgcatggcctggtacacgtaggagcgcccggacagcgggtcgcggatcgcgccgccaatgcaggtggccgcgccgccaaagggctcgatctcggtggggtggttgtgggtctcgttcttgaagaggaagagccagtcctggtcctcgccgtccacgtccaccttgaccttcacggtgcaggcgttgatctcctcggactcgtccaggttcttgaggatgcccctcgccttgaggtacttggcgccgatggtgcccatgtccatgagggtgaccggcttggtgcgcttgagctcgcggcggacctccaggtagcggccaaaggcggcgcgcaccacggagtcgtcgatcttcacgttctcaagctgcgtgccaaaggtggtgtggcggcagtggtcggaccagtaggtgtcgatcatcttgatctcggtgatcgtggggtcgcgcctctcgcccttgaagtacgtttggcagaactcgatgtcggccaggtccatggccaggccgcggtcctcgatgaacttgcgcagctgggccttggtgtaggagcggaagccctccagggtctcgaccatcgggggcttggggtagttgaccttcagggtcttgcgggtggcgagagacgcctcgcgcgcctccaccgggttgatcacgtagtgcttgatggcctcgacgtcctcgtcggtgaggttggcgcccttgaggtagtacagcttggcggacgcgacggtggggcgctcgccctggctgatgagctggatgcactcgctcgccgagttggccctcatgtcaaactggccggggaggaactcgacggcaaacaccttggtggtcttgccggcggcggggcggcgcgtggtcgccttgtcggtctggggctcgctgaacaccgtggggatgcactgctcgaagagggccttcgagatcccctcgacgtcgtagcggttgaccaggcgcagtccggtgaggttcttgatgccgaggatgacctggagctcgcggcacagctgccgcgcctcgacgtcgaacccgggcttcttctctacgtaaacgcgggagaccatggggctctaccttccgtccgagagttttccacaaatgcacacccatgatagctgcgcaggtaggggccaggctgcctggggcgcaaaagttcatgtggaggtcgggaggcgtgtctcgcgtggtgggcgagaggggcgagggtcgcgcctgggagccgttcgcgctggccgcggggcgcgtggcaggcgagaggggcgcctaccctacagcatcaccacgccggtgacgtaggcgcaggtcacggcgagcgccgcccagtctgcggcgcgcatgcgcatggggtgccagtgggtgcgtgctgccccaccctcgtagcagcgggcgtcgagcgcgcgggagaggccgttggcatgcctcatcgagctcgccaggagcgcgaccagcacgggcaccaccgagcggatcctccttgcaaccgagccctcggccatggcgccgccgcgcgaggtctgcgcgtcaactattgactgcgcctcgtcggccagcgtggggatgaagcgcagcatgagcgagaagaccatggccagctcgtgcccggggaggccgatgcgcgagaggggcgccaggaacgagtcgaaggcgtccgtgagctgcatgggcgtggtggtgagcagcaggagcgcgcccgccacgaccgccaccacgagcctgagcgagtagagcacggccacgcgcacgcccccggtggtgatggcgatggggccaagggcggcgaggatggtgccctcccggatcaccaggaggtcgatcacggcgatgagcccaaggaccgcgagcagggggcgaatggactccaccagcttgccggcgggaacgtgtgcgagcgccgtcaccgccagggcgaacgcaaaccccagggcgagcccctggggagaggtgatgaagaacacgctcaccatggtcgccagggcggcgatggtcttggcgcgcgggtcaagccgatgcacggccgaggtgccggggaggtactgtcccatcgagattcgcagcgccatgctaggcctcccctccgtcgtcgacgcccttgtcggcccgtcgcgcgattgcctgtgccaggtcctccagcgagaggggctcgcccagcccgtcgacgcccctgcgcgcgagctcgcgcgcccatgcgagcgcccgggggacgcccagccccgccgacacgagcgccgcctcatgctcctcggcgaacacctgtcgcggggtcccctggcccaccacgtgcgagcggtccaggaccacgacgtgctcgcaaagggcagcgtcgtccatggagtgcgtgacctccaccaccgtcacgccgccctcgtgcacacggcggagtatggcgcgaagctcctctcgcccaagcgggtccaggcccgcggtgggctcgtcgagcacgatggtcctcggccgcatggcaagcacgccggcgatggcgcacatgcgctgctgccccccgctcagctcgaagggggagaggccctcccggtcgcccagccccaccagggccagcgcgtcgcgggcgcgcgcctccgcctccgtgcgcgagaggccaaggttggcgggcccgtaggcgacgtcctccagcacggtctcggcgaacagctggcgctcggggcgctgcatcacgtagcccacgcgtccgtggagcctgcgcctgtctcgcctgcgcgaggtttcgataccgtgcaccaccacgctcccggagtccggtgcctccagggcgcagagcaggcggagcagcgtcgacttgcccgaccccgtctgacccacgatcgcgcacgaggtcccctcgggaacgctcagcgacacgtcgtcgagggcgggggagctgtcctcccgtgcgtcggtgtcgcggtacgagtagcgcacgtgcgtcgcctcgatggcgagaggggcgctgtcaccgtccccgcggcccgtcccgccggcatcgcccgcagtcccggccgcgctcgtctcgcccgcgtcgtctcccgtccccagcagggtggtgacctggccgagcagctcgtcagcgtcgcaggtccacgcgacccccaggccaagccgggacagccgcatggcgagccgcgagcagaagggctcgctcagcttgagggacgagagcagcttgccgtgggagaagacctcgcgcggagtgccctgcagtgccacgtggccgtgctccatcacgatgacgcggtcggcctccagggcctcgtccatgaagtgcgtcacgtgcacgatggtggtccccgcctgggagagacgccccatcacgcgcatgatcgagcgcctgccgcgcacgtcgaggagtgcgcccggctcgtccagcacgaggacctcgggctccatcgcgagtgcgccggcgatcgcgacccgctgccgctggccgcccgagagcctggtgggatccgccttcgcgtaaccctccagggccacgcggtgcagctcgcgggcaacgcgccggcctatctcgtcgggtgccacctggaggttctcgggcccaaaggccacgtcctcctcgaccacggaggtcacgatctggtcgtcggggttctggaacaccagccccaggctcctgcgcgcccgggcataggcggcaaagtccaccttgccaccctccaggacgtgcagccccaccagggtcacgtccccctcgtccggggcgagcagtccgcagatcacgctggcgagggtcgacttgccagagccgttggcccccaccacgcacacgcgctcgccgcgggcgatgtccaggctcacgtcgtcaagagcgcgcacgccgccctcatactcaagggtgacgtgcgacaggctcgcgacgggcgttccggcctccgctgccactagttgcccagcgccttggagacgggcttgtacacaaggtaggcaaggatgcagttgacggcgatcttcaccaggttgaaggggagaagcgccggtacgatgagcgccacgaccgcctggaccggcatgcccgagtagagcggggtcaccaccaggttgcccaggatgcacgccgccaggcatacgaccgcacccacgaccatgcccagcacggcgcccctgcgcgtggtgtcgcggcgatagaccagcgacgcggggagcaccaggctcagcgtggccaggaccgccatgagcatgccatagacgcccgactgcgtcgcgaggtgcaccagataggggagaaccgataccgccgcacccgtggcggggccaaaggcaaagcccgccaccagggcgatcgcgccggacgggtcgtacttgagccactcgactccggggaggatcgggaactccaggaacagcgtcgcgcacgccgacaccgcgcagaagagcgcggtcaccgcgatgcgacgcgtggaccacccattcccgttgccggtggtggagtgactgtcccgatgcctaagtgtggtgtcccgtgccatgtgctggcccccgtttctttcatccggactgtaaccgttggtcctggactctcaccaggtcaaccgctcttttctgcgcggtgcgcggactcgtcgcatgcccgttgggggcgacctaccgccagtggggaatctcaccccgccctgaaactgtcagtgggactatagcactcccccctcgtttgggggagagaaacggggggacgccgccagacgcccgatccgttggctcgggcggcgtcgaaaggctgcctaggaccgcgcccccaggcgcgccggccgaacgtggctgggacgcacgcccgggaagagcatggcgacggcgacccacgcggctgcgcccacggccacctcgaccccaaaggtgagcgggcctgcgtaggggacgaggaacgacagcagcacgaccgcccccgccggcggcagccaggtcgagaggccgttccacaccagcacgagcgccgcaaagcacacggcgaccatcaggggcagggggacgcccgcggtctcgaccacggcgcggcccagcgagccgacgaggcccgcgcacgcaaggaccgcccaggcgcgccaggggcgggccctcagggtgaagtcgggccgcgtgagctcggtgaacgctacgagcagcggcggcacggcgaacagcgggttgccggtgaggtaggcgggggcgctcagcagggcaaaggccagaagcctcctgccccagctcgccagcgccacccgtggcttgaaggccagggggcggtagtcaatcctctccctcagcccggcgcgctccaggagcacctgacccaggcacaccagggcaacgagcgcggtcaccgcgacggggtaggtccaggagtcggtccccagcagcaccgggaggatggccgcgctgagcatcggcgtcatgtccgccgccgcgaggttcatgcagagcgcgcagaacgcgtagcccaggatcgccttgccccacagcccccaggggaccaggaggttcagcagcagcccaaacaccgagccggcagacatcaggacgagcatgcgcgggcggttgatgttccacgcctggcggggctggatccatgcgccgcacaggatggccgccgtctcggggaacaggacctcctcgcagggaatcgcctgcgacgcggcgaccatcgccacgagaaaggcgccggagagcaggatgggcagccagcgtgcgcgaagggacaaggtggggctccaattcttggggggattcgtgtgggcggggaacgtaagggttccccaagcccttgcggggtagcataagtccctcgcaagggtacctgtatacttgtgataccagattgggcgccattttgggcgagagggacggtccctctcgccagcaatcccatgtcacggcgcccggaaagaggagagtgatagcggcatgtccgacagtgccgaccatttgcgtcccctggcctggaagctccgctccatagttggggaggacaacgtcctggagggggagcccatgagcgggcacaccaccttcaagatcggcggcccggccgacctgttcgtcattccggaggacccggaggaggtgagggacgtggtggccgcctgcagggaggcgggggagccgtacttcgtgcttggtcgcggctccgacctcctggtctcggatgacggctaccgcggcgtcatcatcgccatcgcggacgggctggtcaacgtgtccgtggacgacgaggtcatgacctgccaggcgggcgtgagcctgcgggaggcgtccgagatggcctgcgagctgggcctgaccggcctggagtttgcctgcgggatacctggctccgttggtggcgcatgcttcatgaacgcgggcgcctacgacggctgcatcgctgacgtgctggcatcggtgcgcgcgctcatgccggacggcagcatctgcgacatcgatgcggacgacctgcagatgggctaccgcaccagcagggtgaggaccgaggggctcgtggtgctgtccgcctcgttcaagctccacgagggcgaccccgaggcaatccgcgagaagatggacgacctcacgcagcgccgcgagtccaagcagccgctcgagctccccagcgccggctccacgttcaagcggcccgagggtcactttgccggcaagctcatcagtgacgcggggcttcagggctaccgcgtgggtggggccgaggtctcgaccaagcacgcgggcttcgtggtcaacgtggacaacgccaccgcggccgacgtccacgccgtgatcgaacacgtccaggacgaggtcgagcgccagtttggcgtcaggctggagcccgaggttcgcttcctcccgtagggggcggtcccgggggcgggccctatccccttttcaggcgagagacacatggcggcacccgctcgggacgactcccgtcgggtgccgctttccctttgtgtcggtccgccgctggttgggtttgggtcgcttccgatggtcttcgaccgttcgaggtctaccccccaactgcggctttccccgagaagaattcaaagaaggggtaagggggttgtcctcctggggggtggcttcccgccgcccctcgccgcgggcgcgcggaggccgcctcgtaaagttcgacgcgtttaggtagcgctaaacgcgtcaatccttacggaactccgagtcccgtaagattccacgcgtttagggggtcctaaacgcgtcgatccttacgctgcccggattccgcggggctgcccgcgcctcggtggtccacccgcggccgggcgcggcccgcgctatccctcgactcctggcgccctgcccgtggcggctgcccggtcgccgctgccgggccaccagccgaggctccgggaaggggcggcggcgacgccgtcgcggcggcccctcacgggcggggtgggccggactccgcccctctccctccattccattccttgactctttgacccttgggagctcccctcggtgggcggggagggttccaggtctcttggtgccggtccctgctagttgggcctgggtgtgtccgatggacgccgatggcccggggcccaacatttctccgagcccctctccgataaaaggctcttcgacgtttctagtgggtagcgcatgcgacggtcgtctgcgccgagaagtccaggcggccgagcctgaggaagatcatggtctcgaagtaggacgtgtttctgaagcccctcgcggccctcttgagtgagtggtgaaccggagtgaggccctccatgattcgcgttggtggcgttcctcgagaaaccagttgaggatgcctcgcgctcctgcgcacggttatggccacgacattcattcgtcaacgttggagtgcataatccaggagagtgagccgtcgagactcggaggcgccggagggccctgtcgaggggaaggcagtagacggcccgcatcgcctcgggcatgcgcaagcccgggcacagagcaggtgatcggacgctgaggggaactccttcctggccagcgctttgccactcacgtggagcctctccggcctttcagccaagtaatattgggtccggagcaggcgccgcttctcactcgcaggacttcgctcgcggcagcggaccttgtcggtggcctttgcagaagagactgcatcacgtggaagcggtcatcggttggccggcagttggcatcgcctcacgccgcgcgagcgcgtagcctcggacatgtcccgaggaccgcgcggatggccatgcatggtcgccccgtgtcctcgagctgcgccgcgagccccatgcgcggggccccttgttcgcgggccctacgcagacggccacgggaccactggcgccgtcgaggtccaaccatcgtggataggtgctgtctggccgcgctgcagccgtgtcgtccgatgacggcctcgtggacgccggagtagtgggcggcctaactggcctcgcgtggccccgcgcggcccccctagcatctgcccacacccttcatgtcgctctcggcggacccacgcttcgctatctccggacgtcattccccataatggccatcacagaggacctcggcctcgagagagcgcatgtgagtgggaggttcggccgcacctcccagggcgtcctgacggttatggacgccgtcctcggggcagtcggcccggggacggcggcagtggacgaatcgtatagtactgccagatgtccaggtgggccaggatgcagctaccctggcgtcgtaggtgccgcagcgcctgtggcagacgggaactcgaggcctgcccctcggtggcgcgacctcagtgcagctctcacggggcgcccccgcgctctcgaacagatcgttttttttttttcggctgacctccatcctgccgagccccatcgagcgctcgaagagcctcgcgagcatgccggccttctcgtccatgcgcgcctccagacggcagccttccatgggaagaatgctaccgccggggggcttcggctaaaagtcttgcgaggcgtgatacccacccaaaggttcgaagagcccgataaaagctcaaagaaggggtaagggggttgtcctcctgggggtggcttcccgtcgcacggcgcacggcgaagcgccggtgtgttgatcctcccggagacaactactcaaggaagagaggtggcggggaatcgcgcgtggagacccctcgggtggaaattccattctccggatgtcgaagtcccatctgcctttcagggtcccatgcggggatggtgccgtcagaaaccccgcgccgtgtgtacacacgggacgcactttttggcggcgtttgcgcctcggctatcggtgacctgcgggtgcgtcccgctcctcgtggtcagtgtcagaaaccccgcgccgtgtgtacacgcgagatgggttttctgacggcagtggggttgggaggggcccttccgtctgaaacctcgtcccatgtgtacacgcgggatagactttctggcaaagcctcgctccataatgcttggcaactggggaagtgcaggggaccgacggcttcgctaccaacaatctcgtcccatgtgtacacgcgggatgcacttcctggcacctgccgagggagatggttcggctctttcccctcggccttgtgagcggcgttcgttgccgtccgttcaatgactaccgatgccattctcatgaggcatggaaaggctccagtcccttggcagagaatcgtccgcgctccccgcgagcgactttctgccggctgacccttggccttcgacgagagcgctatcgcaagggctggctggtgctgccggaacaatgactgaccgcgaacaggttggtccatcacagatggcgacgtactgcctccctcgctccgaccggcatgcgcccaacgtccacccccttcctagacttgggccccgctcatgattggcggagttgggacctccgcacgcctctcggccaccacgggccacaagcccgaaacccgggtggccggtgggaggggttgcagatccgttgcctcgtccttctcccccgcgtccttgggttccctcgcccccgggagtgatcaaagctcgaaagttccctccgtccgcgttcccctacgctcgcaggtgactggcgaccgtcccccgatttgcccgggataggcatctttcagattcgtttccgtattaactgtattagactcactagtacagttaggatggtcgcgccagcgggatgtcccgtcacgcgacgtcacccagacccagtcggggcggcacgcgccccgtcgaccttcgggagacgagatgaagaagagcagcaagttccacatcccacggaagggcgagggggagaagtcctccccgcagccgcctgagggcgccggcgacatggcgcagggctccacggaagagcagcagacggtccttgcccccaagccggtcctgggccaccgcgggggagaggggcacgccgacctgccgcccgtcgtcgagggccccgagctcgacgaggaggagcgcgcggcctacgagcgcctgaaggagatgcgcgcccagcgtcgccgcaagaagatccgcaaccgcctgatcgtcgtcggaatcgtcgcggtcgtgatcctgggcatcgtgttcgtccccgggatgctcgcccccaaggacgacggtggggacttctacagcactgacacggtgaccaagggtcactttgaggagacggtcgaggcctccggttcggtgcagcccgtctcgtcggtcgtggtgacccccgaggtcgacggcaccatcgcgagcgtcagcgtgatgcagggccagcaggtcgagaagggccagacgctcttcaccatcaagaacgacgacctcgaccgcgccgtgcgcgaggcgtaccgcaacctcaagtcggcgaagtcgcagctcgcgcaggctcagcaggcgctcaaggacgccaagtccgccgccgcgcaggcgcaggccgcctccgcccaggcagcggccgaccagcaggcgatggccctccccaacgccacctccgccacgctgcgccaggctgacgacggaggcgtccccgccgactcctccaacggcggcgccgcgatgggcgtcacctccgggcagggaggctccgcgacaaccgtcacttcctcgggtgacgccgtccaggacgccaagaacgccgtcgagaccgcccagaaccaggtggacgacgcccaggatgcctacgacaaggccgtctcgcaggcggacaagcgcactgtgacctcccccatctcgggcaccgtgctcgagctcaacgccaccaccgggtcctccgtgggccagcaggccgccgccgcgcaggcccagggcaccgggagcggcaacctctgccaggtggccgacctctcgcagatgaaggtgacggtcaacgtgggcgagaacgacatcaacaaggtcgccgtgggccagaaggcgaccgtgaccttctcgtccatccaggacctctcgctcgaggggacggtccagtccgtcgccgcgaccaccagcaccagctccgatgccaccgggatgaccagcggccccacgtacgccgtggagcttctcatcccccagcccgacgccagggtcaagcccggcatgaccgcaagcgtgagcatcgtcaccaactcgctggacgacgccctcatcgtccccacgtccgcgctcacggacaacggtgacggaacgggcagcgtcaacgtggagaaggacagcgagtcacacacctcgcgcacggtcagcgtcacgatcgtcgccaagagcggctcgcaggccgcggtgacgggcgacctcaaggagggggacgtgctcgtggtctcgggcggcacggtcgactcgggcgagacgggcgacgccaccgccaccgacgcgtcatccgctggcagcgcggactcctcggcaggcgccgacggggagtcctcgggcgacgccgtccccgcggatgcgacggcggaccgcatggtcgcgggccgcgcccttggggtgctgtgacatgaccgcccccgtaatagagctgcgcggcgtccaccgcatcttcgagaccgccgcgggcctcaaccacgtgctgaggggggtgtccctcacggtcgagcgcggtgagttcctcgcgatcatgggcccgtccggttcgggcaagtccacgctcatgaacatcctcggctgccttgacacccccaccaccggcacctatcacctggagggcctggacgtggcgcgtctcaccgacgacgagctctcgttcgtgcgcgcccgccgcatcgggttcgtgttccagtcgttcaacctgctgcccacctacaccgtgctgcgcaacgtgatgctcccgctcgtgtttgcgggggtcccgtacggcgagagggaggagcgcgcggtccgggccctccacgaggtctcgcttcccgtggaccactacgacaacaggaccaaccagctctccggcggacagatgcagcgcgtcgccatcgcccgcgccgtcgtggcggaccccgcgatcatccttgcggacgagcccacgggcaacctcgactccgccacgggcgagatggtcatgcagaccttcgcccggcttcgcgacaagggcaagaccatcgtcctcatcacgcacgacccgcacgtcgccgcccgcgcggaccgcacgctccacatgctggacggcaggctcgcctccacccccgacgagggcgtggaccagggatgggggcagctctcctctcccccgtcgacgggagaggggcgcaccaagcgcctgagggaggtgccgtcggtatgaccatgaccatgcgcgacctgttgcgcgagaccaccagctcgctcgaggcaaaccgtggcaggaccctgctcaccgtgctgggcatcgtcatcggcatcgctgccgtcatctccatgacctcgctcatcgggggcatgcgaaacgcgctcgtgggcagcctgggcctcaatgccgccaggaccgtcagcatctacgtcaacggcagcgggctgagcgagcagcaggtggactcgctccgctccgccatgcccgagtacgagagcctggacggcgtcacgtatggcggcggcaccgtgaagacccagggcggcagcgtccagatgaccgccatgggctgtgccgcgtccacggtcaccagctcgggcgccaaggtcacctcgggcaggctgtggagcgaatccgaggagagctcgggggccaacgtgtgcgtcctcaccacggacgacgtgcggcagatctttgggagcgccgactacgacgccgtggggaagaccttcaagctcgactccgccgagttcaccgtcgtcggcatcgcggagacggactccagcatgggccaggggcagggcatgatgtgggtccccgcccagacgtgcgccaacctgtggatgggcgggcagctcacctacgactccctcacgggcatcgtgcacgagggggtggacgtggatcagattgccacgcgcaccaaggagcgcctggagtccatcctgggcgtcacctcgcagggctcgggcgacgggtccgactccatgggcgacgcggtccaggtgcagaccatgaagtcgatcattgaccagcttgacagcttctcgtccaccttcagcctcctcgcgggcgcggtcgcgggcatctcccttctggtcggcggcatcggcatcatgaacatgatgctcaccaacgtcacggagaggattagagagatcgggctccgtcgcgccctcggtgccaccaggggggacatcaccgcgcagttcctcgcggagtcgatcgccatcagcgtgatcggcggcgtcctgggcgtggcgctgggctacggcgggtcatgggcgcttgcgcttgccatccccaccagctcgctgggcatgggggacaccaagatcgtcccggcggtgtcgcccgaggccgtcctgctcgccacgggcatctgcgtggtcgtgggcctgctgtttggctactatcccgcgcggcgggcggcacgtctcgacccggtcgaggcgttgcgctaccagtagccgcgccaggcttgaggttcaaccgcgtgccccgcatccccctcgggtggtgcggggcacgtcgcgtcggcgggggagaggcgcgaggcggctgggtctttgcccatcccgacgagatcgccggcgactggctcgcctagcccctctccgccgcatccaacgtgtcgagggccgagatcacgggctcgagctggtccagctctgccggggcggtcgacatcatcaccacgatgtacgggccgccctgcgaagcgggcaccagcacgacccccgcgtcgtttgccgccttgccaaagatcgcgttctcgtccttggggtaccagcccgccttggaccaggtcacgtaccggtcgcccagcgcgtccgctatgggcgaggtggtccttgcctggaacagcccggcgaggtccgacgagtgcccgtctccgctgctcaggtaggcgtagaccgcctcccactcctcggccagctggtggggcgtgctgtggggatacttccaggcgatgtactgctggcgcgtctcgtacgggccaaacgacacgtcgtgctcgtcaagccacgacacaaagaagtcctggccgtactgctccaccaggctcgcgtaggcgtcgttgtccgagtccacgatggtgcgggtcacgcggtcgctcacgtcctcccagctcacctggcccgtgtccaccagctcctggagcagcgcacacacgtaggggcccttgatgctgctcgccgtgtagaagctcgactcggcgttgtacgagacgcgcgtctcgccgtccaggtcctcgaggtagatgcccagcgaccacccgttgccctcaaagccgctgatggcggattcaaggttggcgacctcctgcgcggagccgtcccgcgctatgccggtgacctccagcgtgccggagccaaccgcctggccctgcgtctccgccgcctccgtgcgggcatctgccgcggagtccacctggactgcggccgagctcgagtcagagtttgccgccgagtcggccgaccgcgaggcatgcccctccaacgcgcccagtcccagcgtgatcgccacggctgccgcaacggataccacggcaacctcgcgatagttgtccggcaggagagaggagcccttgcgtccgcgtcgcggcatctgccgacgggttccgccgcgccgcccaccagggggaggggtcgctccgccgcgctggccggatcgcccggagggtcgggacgttctggggccttccgagccggtgccccggtcgtggcggtcatgcgcgcgggagagggtcgatgcctcggggcaccgatccccgttgccacggccgccctcgccttccccccaggcatccctcgatggatgcctgggggttgcctccctcctatgtggggtacgtccctctcgcctgtccattgcctggctttccctgccgagtccctgcgatacgctcacggtcttcccaatggcctcaagaataatcaaagaccggattgatggcctttcagcaatgctccgctgggggagagaaccgctgacatcggggccgatgccccctcccacggtcccaggagggtcgactcgctttctttggggggcagcagccagtgggccgctcggctcgtcgggatatcgatggtctaagaatggggcgggccgtggctcccgcggactcggcggctcctccgcgtaggaaagctatcggttccctggctccgaaatcggccaaccgcgggaggggacatctggctgcgggaggttgcatccgctgccagaaagcgcgtcccgcgtgtacacatgggacgcactttctggcgtcaagcccgttctccgatgggaggaggctcctccactgtcggaaatcacatcccgtgtgcacacatggggcgcaactttaggcatccactccgtcgagaggacccatctgtctaaaatcccgcgtcgcgtgtacacacgtcgtgagatttccgacgcgggacatccctccaccgcagtcccagcccctcgggtcccggaccacgacggtcacggtgaggcgtcgatgggctaagaatgggacgggttgtctgcctttcgggccagttggctcatccgcgtatgctggccactgccccttcctccccctcctcgccagctggcagcaaactcccgacgtgagttctcacatctggcgtttgctgccggaagggtgattcgaggtcacgtcctcccagctgcttaactatcagcatttcaaccgtggcggccaactcccgatatgagtgctcacttcaggcgttcgttgccattcgaacccggcgcgtgggccatttggcagaagaatcccgatgcgagtgctcacgtcgggagttgtctgccacgggctgggagacaggcggatcccgagagcctcctacctggtagaatgcagggtggacctggtcagtgccaagtgctcaccaacggggaagcactcacatcgggagtttgctgccgtcggagtccatccgccaggtcgcgcacaatctctaaccccccaaacatcgaaccatggcggcaagtcgtcagcgtgagcgcttttccaggcttccgcgacgggccttgtcccgttttcccagttgtcatcgcatcaatgttccaactgtagtggcaaacggcgccccacgtgagcgcccacgcggggcttccgccgcccatcggggcgggaacggaacccgtttgacaggggctcgctcgcgtgagtacgcacgcgatgcgcttgttgccgccgacgagaactgcccgtattccttgggaccgttacctgcgctggtgtcgtggagacctgggcttccgacggctggccgcccacgaaagcactcacgcggggagtgcgctgccagcgggatggcggccccccgtctgggattaaaccgctgccatgggtggagcctgcgattctcccactctctgagttcttctcccctggggccatccggttttggagctagccccctcgcgatgggtggcgaggcgaagtccgtccctcgaaatcgtccggggcacaaaggtgcgggcgacgggacatcccgtcgcccgcgctcggcaatcgttgcccctacaagctagttcttgagcgagttgagaggagcggggaagcggccgccgcgatgggcgaagacgttcccggcatggcggttgacgggcatcacgggggcggagccaaacagtccgccaaactcgagcatgtcgccctcgctcttgccgatggcgggaatcaggcgcaccgccgtggtctttgcgttgatcacgccgattgccatctcgtccgcgatgatgccggcaatcgcctcgacgggcgtgtcgcccgggatggcgatcatgtccagccccaccgagcacacgcaggtcatggcctcgagcttctcgatggagagtgcgccgtcctcggcggcgcggatcatgccggcgtcctcggacacggggatgaaggcgccggagaggccgcccacgctcgagctggccatgaccccgcccttcttgacgcagtcgttgagcagcgcgagggcgcaggtggtgccggggccgccgcactcgccgacgccgatgatctccaggatctcggccacggagtcaccggcggcgggggtgggcgccaggctcaggtcgacgatgcccttctcggcaccaaggcgacgcgccgcctcgcggctcatgagctcgcccgcgcgcgtgatcttgaacgcggtctgcttgatgcgctcggcgacctccatgaggtccgccccctcgggcaggtcgcgaagggcggcggccatgacgccggggcccgagacgcccacgttgatgacggcgtcggcctcgcccgagccgtggatggcgcccgccatgaagggggagtcctccaccatgttgctgaacacaacgagctttgcggcgccgtagcagtcgatgtcggtggtcaggcgagcgcagtcgatcatcttctgggcgagaaggagcacggcgtccatgttgatgcccgccctcaggctcgcgacgttgacgctggagcagaccctggtggtggaggcgagcgcctgggggatcgagtcgatgagcctacggtcggcatcgcccatccccttctggaccagggcgctgaagccgcccatgaagtcgatgcccagggactcggccgccctgtccatggcgtgggcgatgggggtcaggtccttgtcggggcaggcggcggcgatctgggcgatgggcgtcaccgagacgcgcttgttggcgatggggatgccgtactcgcgctcgagctgcgtcgccacgggaaccaggttctctgcggtcttggtgattcggtcgtacaccttcgtgcacatccgtcccatgtcctcgtcagcgcacccatagagcgagatgcccatggtgatggtcctgaggtcgaggttctgctgcgagaccatgttcagggtctcggcgacctcttctggggtgatggccatgcgtgctccttgcgggatagtggttgcgtacatgctggttgcagccatattacagcgcaaaggtttcaggtaatcgacgtgggccggctgccgtgcgcgcctcccaacatccacacgagacgcgcgatgctgcggcatgccctttgcctctcacgtgggaaaaaggccccatcaacggattcaaacagaattgtttgtctaaacaacaaaacaaaacgttagctgatttacagcacgaataccccgctgaagtgtttagaaatcaacaaactaaagtccgctcagcgtatgtttctaaccactcacgggagaggagattcgaactcaatctgaacgggagtagaactgtttgtgaggaagagaggtggcaataagaccagttaaatgccaccgattctcgacagggtcaccaaggcgggacatgacgattgggagagggacggcacaaaggtttttgttggtggaactaaacatctactaaacagtgtggtccaaaagagaaaaaaccgattacagaccgtttatctcctcacatcagattgagccgtcatcggcgtcccaggcatgaacgaaggtacaggggtttcgaagggagtatttagtatggtcaatgtttctaggcgtggcttcctgaagctttccggcgtcactggtgccggccttggcgcggcagccctgctctccgcctgcagcggcagcggttcgggttccgactccgattcctccgcgggtggcagcgacgtcaagatcggcgtctccatctggagttccacggacgcgctgggcaagctctcggccgacatcgtgaagaaggccgccaagatcctgggcgtcgagacccagttcgtcgaccagggccacgtctccgagcaggtcaccgcttccgccgagaccctcgctgcggctggctgcaacggcatgatcatctgcaactcggcagattccgagatgacctccgtcatcaacacctgcaacgagaacgagatgtacgtcactcagttctaccgcatcatctccaaggagagctcgcctgacgtctacaaggcggccgagaactccaagttctacgtgggcgccgtccacgaggacgaggtcctcaacggcaagacgctcatgaacctcctcctggagaagggtggacccaacaagaccggtgcccgcaacatctgcctcgagggctggacggtcggcgacgcaacgttccagcttcgttggaagggctacaaggagggcctggacgagtggaacaagcagcaccccgatgacaaggccacgatgaccgaccccgtctacgccaacaccagctccgccgagggcgccaaggtcaccgagcagttcgtcaacacctaccccgacatggacgccctgatcgttgccggcggcggcggcgacccgctcgtgggctccatcggccagctcaagaacatgggcctgaccggcaagatctccgtcgtctccaccgacttcctggatgaccttgaggaccagctcaagaccggcggcatcttcgccgagtccggcggccacttctgcgacccgctgtacgcattcatcctcacctaccaggcctgcaccggcaagcttaaggtcaaggagggcgagttcggcaaggagatcaagttcccgtacgtctacgtctccagctccgaggactacgccaactacaagaagtacttcgtcgacgaggctccttacacggatgacgagatcaaggagctcgcgaaggacgacttcgacgcgctcaacaaggcggcgacctcgctctcgatcgacgacgtgaagagccgtcactccaagtaggactaagctcgcccgcgccggcgaggcgccacgacgagaacggttgggagggggccagggtacgttgggccccctccctgttctgaggatgcaatccctcgattggaaggaaggagcgattgatgcaatcgtttctcaagaaggcgaagacgagccagtggtacggcgtagggctcctcgtcgtcatctccgtcatcatctgggcaatcttcaaggtggctgcccccgcgaccttcggcgcgccggacaagctcctgtcgtacctgcagtccgccctcatctacgccgtgggcggctgcggactgtacttcatctgcgtcatggggctgttcgacttctccatcggcgcgatgctcatcctgtccgagctcatggccatcgccttcatccccaggctcgggtggctctcggtcatcgtgatccccatcctggtcggcttcctgctgggcttctgcaacggcatcgcctacatcaagatgcacatcccctcgatcatcgtgaccacgggcctctccctcatctatgagagcttctcggtgtgggtcgcagacatcaacggcacgcgtctggatgacgcctacaagctctttggcgcctatccttggaacctgatcgtggccgtccttgcgtacctgctgtgctggttcatcctcaagtacaccaagatcggcacgtacaccaacgcaatcggcgcaaacgagctcgtcgcaaagaatatgggcgtggacgtcgacaagtacaaggccatcgcgttcaccctctgcggcaccttcgtgggcatcatgtccatcctctacctgggctatggcaccgcgcagaccccgcagaccggcatgctctcccaggcgctcaacttccagcccctcatgggcaccttcttcgggctggcgttcaagaagtacggccaccccgtggtctcgatcctcatcggcgagtacatcgtcgccatgatcttcgcgggcttcgtcgccattggcatgcccaccacggtcaacaacatcgtcaccggcgcaacgctgctcgcaatcgtcacgctcaccaccaagcgcgtcaacggcgccgtggtcaagtagggaagggggactcgcaatggcaaaggaaatcatgcttcatgccgtggacatcgacaagcgctttgggcccacgcacgccgtggaccacgtctccctcgacttctacaagggtgagatccacgcgctcataggcgagaacggctcgggcaagtccacgttcaccaacatgctcaccggcatcatcaccatcggcggcggcaccttcgagctggatggggagaagatcgcccccaagaaccaggtcgacgccaaccaccatggcgccgcggtcatcgtgcaggagcagggcacgctcgacggcctcaccgtcgccgagaacatgttcctgggcgacgaggaccagttcatgagcaaggggatcaagaacaccgccgccatgtacaagaaggcccaggagctgctcgacggctacggcctggcgcacatcaaggcgaccgatcccatcgagcactacaacttcgaggaccgcaagctggtcgagatcgtcaagtccacctggttcaagccgaaggtcctcgtggtggacgagaccaccacggcgctctcgcagagcggccgcgaggagctcttccgcgtgatgagggaggtccgcgacgacaaccgcacggtcatcttcatcagccacgacatgggcgaggtcctcgagatgtccgacaccatctcgatcctgcgcgacggcgagttcatcaagaccgtcgacgccaaggacgtggaccaggacgggctcaagaccctcatggtcggccgcaagatgagcgagcactactatcgcgaggactacggccagagcctctccggcgacgtcgcgatctcgatgaagggcgtctcggtccccggccagctggagaacctctcgctcgagctccacaagggcgagatcctgggcatcggcggcctctccgagtgcggcatgcacgaggtcggcaaggccctgttcggcgcgtcctacaaccgcaccggcgaggtcaagctgggcgacgggaccccgatcaacgacatcaacgcagccatcgaccactccatcgcctacgcctccaaggaccgcgacaacgagtcgctgctcatcgcggacaccatccaggacaacatcaccctgccgtccctgcgcaagatgaagaagcccctctcgcccaagcacgagcgcgagttcgcggagaagtacgccaagcagatgtccgtcaagatggtcggcgtgagccagttcgtctccgctctctccggtggcaacaagcagaaggtcgtcctcgcccgctggctgggcgccgagtctgacatcctggtgctcgactcgcccacgcgtggcatcgacatcaaggtgaaggccgacatctacaacctcatggacgagatgcgcaagcagggcaaggccatcctcgtcatctccgaggagatcatggagctcatcggcatgtgcgaccggatcctcgtgatgaaggaccacaaggtcgcgggcgagctcgagcgctcccgtgacctcaccgagaacgacctcatctctctcatggtttaggaggctcaagggatggctgacaccaacaccgcgacggtcacggccgaagacaccgcgatccgtcccaagctcaacattcgcaacatcctcccgatcatcgggttcgtggtcatcgtcctgttcttcgcggtggccacccacgggaggctggtcaaccccaagaacatcaggttgatcctcaactccacctacacgctcatgatctcgtccatcggcgtgttcatgatcatgaccatgggctcgctcgacttctcgcagggctccatgatcggcctgtgctgcatcgtggtctgcgtactctcgaaggtgagcctgccgctcgccatcctcggcggcattgccaccggagccgcgatcggcgcgctcaacgcctacttccacgtccgtcgccagatcgcatcgttcatcgtcacgatctgcaccatgttcctgctccgtggcgtggtcgcgttcctcaccaccgacgcccccgctcagggcgcagggtacctgcagaccgactacaacgaccccatgctgctcatgaccatcacgattgtctgcctcgtggtcttctacctcgtgttcaccttcaccccgctgggagccaacctcaaggcaatcggtgcctcccagaccgccgcgcgcttcgcgggcatcaaggtccagaagaccaagaccctggtctacatcgcggcaggcgccatcaccggcttctccgccttcatcctcgccatccgcaacggctcggtcaccgcgaccggcggcaacatgatggagacccagatcatgctggcgctcgtcctgggcggcctgcccatctccggcggcgccaaggtccgcttctccaacatcgtggtcggcgtcctcacctactgcatcctcgaccgcggcctctcgatgatgggattcgaggcggcgcccaagcagctcatcatgggcatcgtcttcctcatcttccttgcgctgttctccgaccgcgagtccggccaggtcatcaagtagtccgtgctccctcccggcggctcccgccgccggggcgacggggtggccgggacaggcgtcccaaccgtcccgccccttgcctccgtgggaggccccaagggcctcccacacccaggcaccttgctccaacgcataccctatagggaggtagtcaaatgctacagatcaagaagtatcagttctggttctgcccctgcacccaggacctctatggtgacgaggtgctggagcacgtccaggcccacgcccaggaggtcgtcgaggccctcaacgcctcggacctcatcccctaccagatcgtgtgcaagcccaacctgctcaccagcgacgtcatcagccagacgttcaacgcggccaacatggatcccgactgcgcgggcatcatcacctgggcccataccttctcgcccgcaaagagctacatccacggcctgcaggacctccgcaagccgctgtgccagtttgcgacgcagtacaacgaggagatcccgtacgacaccatcgacatggacttcatgaacgagaaccaggcggcccatggcgagcgcgagttcgggcacatcttcgcccgtatgcgcatcccccacaagatcgtgttcggcttctggaaggaccccgtggcgcagcgcgagctcggcgagtggatgcgcgtggccgttggcgtcaacgagagccgcaacatcaaggtctgccgcttcgcggacaccatgcgcaacgtcgcggtgaccgacggcgacaaggtcgaggccgagcagaagtttggctggaccgtcgacgcctggcccgtgaatgacctcgtcccctatgtcgacgcagtttccgacgccgaggtcaaggcactcaccgacgagtactatgacacctacgagctcgtgctcgacggccgcgaccccgaggagttccgtcgccacgtcgaggtccaggcccgtcaggagatcggcatcgagcgcttcctcgacgagcacggctacaatgccttctctgaccactttggcgacctcggcggcctcaagcagctgccgtccctctccatccagcgcctgatgcagaagggctatggctttggccccgagggcgactggaagacgcctgccatggtgcgcctgatgaaggtcatgaccgcgggccagaaggacgccaagggctccgcgctcatggaggactacacctacaacctggttcccggcaaggagggcatcctcgagagccacatgagcgaggtcgatccctccgtggcagacggtcgcctggcaatccgcgtgacgccgctctcgatgggcgagcgcgaggatcccgcgcgcctcatcttcaccgccaaggagggtccggccatcgccacctccctgatcgacctgggcaaccgcttccgtctgatcgttcagaaggtcgacgccaagaaggtcgagaagcccatgcccatgctccccaccggcaccgtcttctggacgccgcgccccaacctcaaggttggcaccgaggcctggatctacgccggcggcgcgcaccacaccgccttcacctatgacctcaccgtcgaccagatggccgactgggcggagctcatgggcgtcgagtgcgccatcatcgacgagaacaccaccatccgcgacttcaagcgcgacctgctcctgggcgaggtcgcataccgctaggggcgtccgtcgcgtgacccgtcggcctagcggcctacgggtggcacacatacacaacgcatgcggccgcgccctcggcagggggtgcggccgcatcttccaagaagtggagagaggaacatggcagcaaccaaggagcagataaaagagcagctcgaggggggcaggtgctcccttggcatcgagtacggctccacgcgcatcaaggccgtcctcgtggacgagggcaacgaccccatcgccgtgggcaccttcgactgggagaactccctcgtcgacgggtactggacctatgcccaggaggagctcgacaacggcatcgcggcggcgtatgcgtccctcaaggaggacgtgctccagcgctacggcgtgacgctcaggcgtctcggcgcgctgggcgtctcggccatgatgcacgggtatctccccttcgacgccgagggcaggctgctcgtgccgttccgcacctggcgcaacaccacgaccacgcgcgcggcccacgagctctctcggctcttcgcgttccacatccccgagcgctggagcgtgagccacctgtaccaggcggtcctggacggcgaggagcacgtgcccagcatcgcatcgttcaccacgctagcgggctatgcgcaccgtcgcctcaccggcgagcacgtcctctccgtgggcgatgcctcgggcatgttccccatcgactcccagacccacgactacgacgcccagaagatcgccgcgttcgatcggctcgtggccgagaagggcgttgcgtggaaggccgaggaccttctccccaaggtgctcgtcgcgggtgacgtggcgggtcacctcacgcccgagggtgcgaggttcctcgaccacgacggcgacctcgaggccggctgccccgtctgcccgcccgagggcgacgcgggcacgggcatgatcgccaccaacagcgtggcgccgcgcaccggcaacgtctcggcaggcacctcggtcttctccatggtcgtgctggagcacgcgctcaaggacgccacggttccgcagatcgacctggtcaccacgccggttggcgaccccgttgccatggtgcactgcaacaactgcacctccgacatcaacgactgggtcaacctgctcgtcgactactcccatgccatgggccaggaggtcgacaagggccaggtcttcacgacgctgttcaacaaggcgctcgagggcgagaaggacgcgggcggcctggtctcgaccccgttcatctcgggcgagacggtcatgggcgtccagaccggctaccccctgctcgcccgcaggcccgacgcccgcctgaccatcgccaacttcatgcgcgagcacatcatggccgcgttcggtgctcttgcggtgggcaacgaggccctgcgcgaggagggcgtgaagatagaccgcctgtatggtcacggcggcatcttcaagacccccaaggtcgcgcagtccatactcgcggccgcgctcgacgctcccgtcaccgtgatggcgacggcgggcgagggcggcgcctgggggcaggcggtcgcagcttcctacatgatccacaaggaggagggcgagtccctctcccattaccttgaccagaaggtgtttggcgacatggagcaggtcacgctggagccggaccccgcagacgtcgagggctaccgcgcctggctggcagacttccgtcgtgccaacgaggccgagaaggagcttgagcgccagatggcgtagggtttcgcgctgaaggtcagtcttgggggcggcgcgggcgcaaccggcgccctccccattcagagaaaggttgctcgacatgatgctgaaggagctccgcgagcaggtctacgaggccaacatggacctgcccaggcacgggttggtcgtgttcacctggggcaacgcctcggcggtggaccgtgacaggggcctgttcgtgatcaagccctccggggtggactacggcgagctctcgcccgagagcatggtcgtgtgcgacctcgacggcaacgtggtggagggcgacctcaacccgtcctccgacacccccacgcacgcctacctgtaccgccagtgggacaacatcggcggcatcgtccacacccactccgccgcggccgtggcctgggcgcaggcggggcgctccatcccgtgctacggcaccacgcaggccgactacttctacggcgaggtgccctgcatgaggggcctcaccgaggacgagatcgagggcgactacgagctcaacaccggcaaggtgatagtggagggcttccgcggcctcgaccccgtctcgcaccccggctgcctcgtgcgcaaccacggccccttctcgtggggcgcagacgccgcccaggccgtctaccacgcggtggtgatcgaggaggttgccaggatggcgcgcgacaccgagcagctctgcatggcggcgggcaagcccctggatgaagcccgggcgccccagtacctgctggacaagcactacatgcgcaagcacggccccaacgcctactacggccagaagaagaactagccgcgagggctgcgataaatcagacctccgcccatgtgggcgagtgaggggagaggggccttggcctctctcccctccaatcttttctggcgcagacaacgtggctggggacgtacttgctgctcttccgtcgcccgcaggggagagcccgcctgcctccgcctcaaatgagctcaggggggcagcgcatggggagaggggcagtgcgggagaggacaccgccgaatcgggcggctggtagcgccgtgctcagtgcaccaccttgcctgaggtatcaggaatcgaatcatggcagcaaattcccggcaagggccgcgctaccgtcccgtgcgtggatgacagcgcggccccttccaggacttctgaggccccttcggctgccgtcagcctggtgactcctcgctccccgcccgtgagctatgccgtggtcccaaacgcaaaggtcgtggtcgagacaaacgggtgccccggcgcatacaccggctgcgggaagttcttgtggtggatggcgtccggatagaactgcgcctcgagcgccacgccatcgaagggccgatagtgcgcgccacccttcccgatgccatccagccacctgcccgtatagacctggagacccggggcatcggtgaggacgtccatcgtgatgcccgtctcgtctcccaccagcgtcgccacgcgctccgcgcactcgtcgttgtgcagggcgaagttggtgtcgtacccctcgcctgcctgcgtggcgtcgcggcccagggcctttgccaccctgaagtcgaacggcgtgccggcgacgtccaggatctgccccgtggggatgtggtgctcgtccgcgggtgtgtacctctccgcctccaactggagcgtgtgccccaacacggagcccgacgcgtgtccgttgaggttccagtacgcatggcaggtgaggttgatgatggtcgttgcggagggctccgcctcgtagtgcacggtcagccggttgtccgccccaagggtgtaggtcaccctcacgtcgaccgcgcccgggaacccctgatcgcccgtccggctcagaaggcccatcgtgacggtagtgccaccgtcggcggtctggttggggccggaggcgatggtccacaggcgctcgaaccacatgtgcgggcccgagtggttgctgttctccccctcgttcctcgcaaggtggaaggtggtgccgccaaggtcaaaggccgcaccggcgatgcggtttgcgcaccgtcccacgatggcaccgaggagctgggggttgctctcgtagccgggggcgccgtcgcatcccaggagcacgtcgaccaggttgcccctgccgtcgggaaccgccaccgactgcaggcaggcgccaacctgcgacacgcccacgcgcatcccggcctcgttggagagcacgacgaggtgcgcctccctgccatccgacatcctgccaaagccacgggtctcgacagacatccgctacctcccgccaacgcacgtgcatggacgctttcaccttagcgtggcgggggaaccgtggttcgaggtttcggtgggtgagaccagcggtgcgccgtgcgcgcggcccaagtcgggggcgcgtcgagcgcatggggcggcgggggagaggcgcggcacgtctcgcccgcggcccgtccctgcggcccggctacccctcctgcccaaactccaacgggaccctgatgacctcgcgcacgccggcggagaggagctcctcgacctgctcgtcggtcgccccgtcgtcggtgatgaccgtgccggcgtcggcggcggtgccaaatgcgtaggcgcactccacgccgatcttgtccgagtcgagcaggacgaagtgctccctggaccgcgcgagcatgagtgcgtcgaccgtgggctccggggcggtgttggaggtgaggcccaccctcgcgctgatgccgctgcagccgatgaagcacttggttgccgtgaagcgcccgatggtgtcgagcgcgagctgtccggcgagcgaggcgcgcggcgggacggcttccccgcccgtgaggaggatggtcggcttgaggggcccctgcaggagcatgaccttgctgttgttggtgatgaccgagacgtcgtcggcctcgatgtggttgaccacgtcgagggcggtggagctcgcgttcacaaagaccgcgtcgccgtcctccacaaagcctgccgcgcgccgtgcgatggcacgcttggccatgacgcgacgggagccggagggccttcccagcgtgttcatgagggtcgcggagccgtactggtgcgagacgagctgcctcgactcaaggtagtcgaggtcgcggcggatggtcaggggcgagacgccaaagcgctcggcgaggtccgtgacgtccatcctcccgcgctcctcgaggaggcggactatgtcctcgcgacgcttcatcacgaaggactcgcttctccgcatgcggcgccccctctgttgctcggtgccgcgcggccacgtgccgcgccggatgattccaacgaccattttatgaaccattcggtcgttttcgggggcttcttttctctcgaattgctcccgccgtgagattgtgcggcctttttatgcaaaaacgagatttataaacgattcgctcgatgttgggttcaaatcgttcataaaaatggggatgtttcataacgacacaggtaaacaggtcgcgtcaagcgtttacatcttcctaaaaacgttctttgcgcaaatgaacgtgttgaacggtctatgagaaaagataggagaaatagcccaaaaatatttagtttcaaattgactgtggggttcggatatgggactcttctagacgaggagacgccgcgcggcgcgcggcagtccatattcgtcatgcgcctcccgacgggcgaagggtcgtcccgggagggccttggcgcgggagtgggtcccgtgccggaagggagctggacatggcagagaagtaccgggcgttggtgtgctgccgcgctggtgtcgcgatgagcgagattctcgacatcaacgtgaagcaggtcctctcggaggaggggtatcccatccagaccgtccgcgggaccatcgacgacatcaagaactttgacggcgacctcgtcatcaccatgtccgacatggcaatcgacctcaagggcaaggagggcgtgccctacgttgtcggcatccgcaacgtggtcgacaaggcagagatcaaggcgggcctggtcggcttcctcaaggagaggggcgaggcggtcgccgagtaggcgcgccgcaccatcgcaggctgccgcagacagagcacaacacgagcgccccatcggggcgcagggagaaaggaagccttcatggccgaggagctaggcacaccttggaagaagctcgacgcaccggttcccgaggaggagctggcctgggtcgacaagtactggagggccgcgaactacatgtccgtcggccagatctacctgcgcagcaacccgctcatgcgcaaggacttcgttgacgagaagacgggcgagaagcgcgacttcggccgtgccgacgtcaagcaccgcctggttggccactggggcaccacgcccggcatcaacttcctgatgggccacgtcaaccgactcatccacgaccacggccagagcgtcgtgttcttcatggggccgggccacggcggacccgccggcacctcccagtcgctgctcgacggtacctaccgcgagcactacccgcagatcaccgacgacgaggccggccttcagcgcttcttccgccagttctcgtaccctggtggcatccccagccactttgcgcccgagacccccggctcgatccacgagggtggcgagctcggctacaccctctcgcacgcctacggcgcggtcctcaacaaccccagcctgctcgcgttcgccgtcgtgggtgacggcgaggccgagaccggtcctcttgccacgtcctggcagaccaacaagctgatcaaccccgtcaccgacggcatcgtgctgcccgtcctgcacctcaacggctacaagatcgccaaccccaccatcctcgcccgcatcagcgacgaggagcgcgacgagttcttccgcggcatgggctaccacccctacaccttcaccgcggggtttgacgacgagagccacatctcgatccaccgtcgctttgccgcgctgcttgagcaggtgttcaacgagatctgcgacatcaagtggcgtgccctggccggcgagaccgcccgtcccgagtaccccatgatcatcttccgcacccccaagggctggacgtgccccaagtacatcgacggcaagaagaccgagggcagctggcgtgcccaccaggtgcccctggcgtccgccaaggacacccacgagcacttccgcgtgctccgcagctggctgcgcagctaccgcccgcaggagctgtgggacgagaacggcgcgctgcgtcccgaggtcaccgagttcatgccgcagggcgacctgcgcctaggcgccaaccccaacgccaacggcggcctgctcctcgaggacctcgagctgcccgacatccacgactacgagatccccgtcaaggagaagggccacggctggggcatgaccgaggcggcgcgcgtgtttggcaactacaccgccgacgtcctcaagctcaacctcaccaagttccgcctcttcgggcctgacgagaccgcgtccaaccgcctgcaggcggcctacaagctcaccgacaagcagtgggacgccggcttcaacgccgaccccgagaacgacgtgtacctcagcagcaccggctccgtgatcgagcagctgtccgagcaccagtgcgagggccttctcgagggcttcctgctcaccggccgtcacggcgtgtggagctcgtacgagtcgttcatccacgtggtcgactccatggtcaaccagcacgccaagtggctcgaggccaccgtgcgccacatcccctggcgcaagcccatctccagcctcaacatcctgctcaccagccacgtctggcgtcaggaccacaacggcttcagccaccaggaccccggcttcgtggacgtgctgctgaacaagaacttccacaacgaccacatcgtccaggtgtactacccggccgacgccaacatgctcctgtgcgttggcgaggaggcctacaagtccaccaacaagatcaacgcgatcttcgccggcaagcagccctcgccgaccttccagagcatcgacgaggccaagcaggagctcgccgagggcgtggccgagtgggagtgggcgggcaacaccgctgcgggcgagaagcccgacatcgtgctcgcctgctgcggcgacgtccccacgctcgagatgctcgcgacctccgacgcgctgcaggacctgggcatcaaggtccgcttcgtcaacgtggtcaagctcctctccatccaggacagcgaggagaacgacgaggccatctccgacgagcgcttcaagcagctctttggcgaggacgtgcccgtgctcttcgccttccacgcctatgcgcacacggtgtacggcctgatccacggccgtcccaaccacgataacttccatgtgcacggctacatggaggagggctccacgaccaccccgtacgacatgctccgcctcaacgagatggaccgctgggcgctcgcgtcgcacgcgctcgagatcctggatgccaagaagtgggcaaagcagatcaaggagtggcgcgacttccgcgacgaggccttccagttcgcggttgacaacggctacgatcacccgcgcttcaccgagtgggtctggcgcgaggtcaccggccaccaggacaactccgcggcggccatgtcctcgaccggcggcgacaacgacgagtaacggtcgctagtcggcaggggagaggggccgggcaacgttcccgtggccctctcccccgccccaggcgagccttttgcagacaagggggcctcccgcatccaaagacggtgcgggaggcccttctcgtggggatgtcgccgtgggtggccacgttcctgggggattctcccgggctgagcgcctgtatgaaagacgggaggcccactccgctagatctgcgcgacgctgtccctctcgacgaagcgggcggagatgtgcgtggtgcacacgtagtcgtgcgggtcgcggacctgctcgatgagcttgcgcaccgcaatctcgccaatgtcgtgcttgggcacgtgcagcgtggtgagcgcggggagcatggcggtcgccaggggcaggtcgtcaaagcccacgaacgagacgtcctgcggcacgcgatagcccgcctcaaggagagcgcgcatcatgccgcacgccatcacgtcgttctcggcgaagaaggcggtggggagctcgtggttggccgcgacccacttgcgggaggcctcgtaggcggtggagatggtggtccccacggtcacctcgtagcggcggtcgaactcaaggcccgcctcgcgcagggcgagcaggtagccgcgcttgcgcagggggaagttgcgaatctggaggtcgccgcgcaggtacccgatgcgcgtgtgaccccggtcgatgaggtagcgcaccgcacggtaggcggagctctcgttcgagatcacgattgactcgatgaagtcgcggatgcaccagccgtccacgatcacgaggggcgccgccgagccgtagaacggagcgtagtcgccctcctccatctcggtccccagcaggacgattccgttggtggggtcctggcacatctcgtgcagcaggggaccactctcggggtccaggaggtccacggtgacgtagttggtcgagaggccatggcacctcgcctcgcgctccaccccgttgatcacgatggggtggaagtcagactcgtccagcacgcggccgctcttcctcgccacgatgaagacgatcttctcgagcttgttgggacgctggtagcccagctcctgggccgccttgatgattgcctccgccgtcttcttgctcacgcccctcttgtggttgagcgcgttggagacggtggcgggggagaatcccgtgcgacggcttatgtcgcgaaccccgaccttcacggtggcctccaaaccaaaaccgaacgatgtaactaaaactgataaaaacaatagaccataaacacgcggaaattgttttgctttgtttaaaagagaccatctcctcgcccagcggtcgaaggtacgcgagatggctcccactgatctcgagcattctgcaaatacctcatttcaactgcgataaaacgatgacgagactgttcgggggacgtgtcgggaaacatgcgcccctcccactggcgggcgcttgcgggcatggcggggactgtgcgtctcccccagaggtgtttaggcctgttcactagatacgcgagatggagtcccaccctcgccgaaacgtgccgcacgccgccggaagctcgggcgagacgtgccgcgccatgcctagaatggcagggtgcctctgggggcgtcggaaacggcggaggccttcttgcctgggagagaccggaaggtggcgctgtcatgtatttcattgggattgacgttggaacgtccgcgaccaagctgctgctcatggacgagggtggtggggtccgctcggtggtgagccggcgctatcccacggcgatgccgcagccgggctggagcgagcaggaccccgacgactggtgggatgccgtgtgcgacgggattcccgagctgctcgagggcatcgatgccagccaggttgcgggcatgggctgctgcgggcagatgcacgggctcgtcacactggacgggcgggaccgcgtgatccgccccgccatcctgtggaacgacagccgcagccgctaccaggtgggatgcctcaacagggacatcggccgggaggcaatcgcccgctacaccggcaacgtcgcgtacgtggggttcaccgcacccaagctgctgtggctgcgcgaggaggagcccgagcacttctcggccatccgcaagatcatgcttcccaaggactacgtcaccttccgccttacgggcgagtacgtcacggactactcggacgcgtccggcacgctgctcctggacgtccgcaaccgctgctggagcaagcacatgctggggctgtgtggcctgtggcgcgccaagatgccgcgcctgtgcgagagctgggaggaggtcggcaccctgctgccccaggtcgccgaccggctgggtctgccaaggacggtcagggtgtgcgccggcgcgggagacaacgcctccgccgccgtgggtgccggggccgtgggcgagggcagctgcaacatcgtcctggggaccgccgggaccatcctcatgaacatggccagctaccacgaggacaaggacaacaagctgcactgcttctgcaacgccgagggcggctggaacctcatgggctgcatcctcaccgccgccgggtgcaacgagtggtggatgggcaacgtgctccagacggaggactatacggcggagcagggcgccatctcgctggaggggctcgggcagaacgacgtgttcttcctcccgtacctcatgggcgagaggacccctcacaacgacccgcgcgcccgcggcgccttcgtggggatgtgcgccacgagcacgcgcgcggacctcacgcaggccgtgctggagggcgtcgccttcgccctgcgcgactgcgcctgcatcgcccgcgaggaggagctggacgtctcgtcgtcgaccatctgcggcggcggcgcgaggagccgcctgtggctctccatcatctccgacgtcctggggattcccctgcgcatcacgcagaccgagcaggccccggcgctgggcgcggcgatgctcgccagcgtgtgctgcggggcgtacggggacgtggcggggtgcgcgagggccctggtccacaccaaggggaccgtggagccggaccgcaaggtggtctccctctacaacgggcgctatgatacctggcgccgcatctatcccgccctgcggggcgtgttccaggagatcatgtagaggagagcgccgcccgtgatccaagacataggggaccatcgcttcgaccggacctatcgcaccgacgcacccacgggacggagcttcgtcctcgcctaccaccagggcctggccctgtatgccgcgcgagacggcaggctcgagctgccccggctctccgactggggtgccgacgccgcccagctccacgcccgctacctgttcgcgatcggcgacagcgagttcttcctcgccgactgccgcgtggcgggaggcgggggagaggggacgcccaccccgctcgtggccgatcccggcgagccggacggcccggaggtcccggcgccggcgggcttctcgtttgcccccatccgcgagttccgcttcctggagccgcggtggatgtcgtttgccgcgatcaccggctaccacctgtgggactggtaccgccacaaccgcttctgcggcgtgtgcggaggcccgctccggcacgtggcgaccagccgcgagctcgcctgcccgcagtgctccaacgtggtgtacccgcgcatcagccccgcggtgatcgtgggcgtcacggacggcgacaggatcgtcctcaccaagtacgccgggcgagagtacaagaactacgccctcgtcgccggcttcgtggaggtgggcgagagcatggaggactgcgtcaggcgcgaggtcatggaggaggtcggcctgcacgtgggcaacatccgctactacaagagccagccctggccgttcacccagaccgtcctgggcggctacttctgcgacgtcgagggggactcccacatcaccctcgaccgccacgagctcaagctgggccgctggttcgaccgcaaggacctccccctgagcctgcccgacacctcgagcctcaccaacgagatgatctgcgccttcgcccgcggggacgcataggcgtcaggccatcttcaggcttcccaagggtctgtgacgtcctaggggcgcaatgttgcctggctgtgaactgtgcccccgttgccggcaggcgggcgctagagtacgactcaaccgaatacgaacgaccaaacctaagaagcggaaggtagacgccacacgcgcgcacagagattctggggtgctgagatccaggacgagatgcggggcgttgattgggccgccgagggcgcacccaaaggcaggggcaagcgatcctgccaagtaggctgcgacgtgagggcatacgtcagttgccagaggcgtgacagcgtcttgcaaagcgcgtgggcccagcccacgaaccaaggtggcaccgcgagtcccagggacccgtccttgacgaatctgcatctgtagacgacgtcgggggcgggtcccttccgttctcgaggaaagtgggaggtgagcatgtacccatcgcttgaggaggtccgtcggatcgcggagaggggggagtacgagaggatccccgtccgccgcgagatcctctcggacggcttcaccacgatcgaggcggtccgccgccttcgcggggcgagccatcacgtgttcatgctcgagagcgccgagcccgacgagcgctccgggcgctactcgttcctgggccttgaccccagcatggaggtcacctgcctggacggcgagctgagggtccgaaggaacctcggcaggccggccatgggcgggggagaggcgacggccccggaggtcgagaccagccgcgtcgaccacccgggcgccttcctccgcaaggtgctggcggcgcaccgcagcccccagctcgacgacttccctcccttctgcggtggcctggtggggtacttctcctacgactacctcaagtacagcgagccgacgctgcgcggcggcgacatggggcacgcggacttcctcgacatggacctcatgctctttgacgacgtgatcgccttcgactcgtaccgtcagcgcgtggtcctggtgacgggcgtccccacccggggcgacctcgaggagggctaccgcgaggcgggcaggcgcctcgaccgcatggaggacatcctgcgccatggggagccggccaagttcgagccgctccggctcgccgctccgctcgagccccgcttctcgcgcgagcgctactgcgacatggtccgcaccgcgcagcaccacatccacgagggcgacatcttccaggtggtgctgagcgatcccgtcacggcgccggcgacgggcagcctcttcgacgcctaccgcctgctcagggccgagaaccccagcccctacatgttctacttcacgagcgacgacctggagctggctggcgcgagccccgagaccctggcgcgcctgaccgatgggcgcctcttcacctacccgctcgccggcacgcgcccccgtggcgcgacgcccgaggaggacgagcgcctggagcgcgagctcctctcggacgagaaggagcttgccgagcacaacatgctcgtggacctggggaggaacgacctcggccgcgtggcggagctggggagcgtccacgtggacgagttccacaagatcctgcgcttctcccacgtgatgcacattgggtccacggtgggcgcccgcatcgcccaggacagggacgcggtggacgccgtcgtctccatcctccctgcaggcaccctctcgggcgcgcccaagctccgcgcctgccagatcatccgcgaccttgagggctacaagcgcggcatctacgggggagccatcggctacctggactttgccggcaacctggacacctgcatcggcatccgcctggcctacaagaaggacggggaggtctgcgtgcagtcgggcgcgggcgtcgtcgccgacagcatccccgagcacgagttcgaggagtgccgcaacaaggcccgcgcggtggtccgcgccatcgaggcctcggaggggggcatcgaccgatgatctgcctcatcgacaactacgacagcttctcctacaacctgtaccagctcctgggctccatcgagccggacgtccgcgtcattcgcaacgacgggctcacggtgggggagctccaggccctctcgcccgacgccgtggtgctctcgccgggcccggggcgtcccgtcgacgcgggcatctgcgaggacgtggtccgctccctcaccgggagggtccccatcctgggggtgtgcctgggccaccaggcgatcgtggaggcgtttggcggcgtggtcacgtatgcctcggccatcatgcacggcaaggcgtcacgggtgacgctcgacccgggctgcgagctgttccgtggcatcgagtcgcccaccaccgtcgcgcgctaccactcgctcgccgccgacgccgcatcgatgccccagtgcctgcgcgtgacggcgaccacggacgacggggaggtcatggccgtacggcacgtcgacgcgccgacctttggggtccagttccaccccgagtcggtcatgaccccggagggctcggccatggcgaggaacttcctcgacgtggtggaccgatggcggtcgggcgacctgtaggggcgcggcaccggctcgaggcgcgaagcggacgaagtcagttctcaagtgacagggagacaccaggatgatcagggaagcaatcgagaagatcgtgtccaaggaggacctcacctacgacgaggcctacgccaccatgcgcgagatcatgagcggtgagaccagccccacccagaacgcagcattcctcgcggcgctctccaccaagtcgaccaaggccgagacgatcgacgagatctcgggctgcgccgccgccatgcgggagctggcgacgccggtcgagcacccgggcgtcgacacgctcgagatcgtgggcacgggcggggaccgctccaacaccttcaacatctccaccaccgcggcgctcatctgcgccggtgcgggcgccaaggtcaccaagcacggcaaccgcgccgcaagctccaagtgcggcaccgccgactgcctggaggcgctgggcgtcaaccttgaccaggacccggacaaggtccgctccgagctcgactcctgcggcatggcgttcctctttgctcagcggtaccacagcgcgatgcgctacgtcggccccatccgcaaggagctgggcatccgcaccgtcttcaacatcctgggcccgctcaccaacccggccaagcccgccttcttcctcctgggcgtgtacgacgagtacctcgtggagcccatcgccaaggtcctctccaacctcggcgtgaggcgcgcgctcgtggtctatggccaggaccgcatggacgagatctcgctctccgcccccacgagcgcctgcgagctgcgtgacggctactatcgcaccctgaccatcgcgcccgaggacttcggcctctcccgctgcatcaagcaggacctgctcggtggcacccccgaggagaacgccgccaccgtgcgctccatcctttccggagaggaccgcgggcccaagcgcgacgccgccgtcctcaacgcgggcgcggccctctacgtgagcggcatcgccgactccatcggcgagggcgtcgccaaggcgggcgtggcggtggacgacggctccgcgctccgcaccctggacgcgttcgtggaagagagcaaccgctgatgggggagcacgggaacatcctccagaccatcgcggagcgcacccgcgagcgcgtcgcccgggagcgggaggagcggcccctcgaccaggtcgccggcgaggcgcgcgggcttgccgagagggagctcgggagcgacggctcgttccgcttcccgtttgagcgcgcgctctgggcgcccggcatgtcgttcatctgcgagtgcaagaaggcatccccctcaaagggggtcatcgcggaggacttcgaccccgttgccatcgcccgcgagtacgaggcggcgggcgcggcggcgatcagctgccttaccgagccgttctggttccaggggagggacgagtacctctccgccatcgccgacgccgtttcgatcccggtcctgcgcaaggacttcgtggtggacgagtacatggtctaccaggcaaaggtccttggcgcgcaggcggttctcctcatctgctccatcctcaccgacgagcagctggcacgctacgtctcgctcgcccacgagctggggctctccgcgctggtggaggcgtatgccccggaggaggtcccccgcgccctcgccgccggcgcacgcgtggtgggcgtcaacaaccgtgacctccggacgttcgaggtcgactttggcaacagcatccgcctgcgtcctctcgttgggcccgagcgcctcttcgtctcggagagcggcgtgagggacgccagtgacattcgccgcctatatgatgcgggcgtcgatgcggtgctcgttggagagaccctcatgcgccagaatgacaaggctgccgcacttgccgagctgaggggagaggttccgtgatgaacaaccgtcgcatgtccaccgtcaggatgcgagagctcctggacgaggggagcgagcgtacgcacgtcaagctctgcgggatgttccgcgagcaggacatagacgtggtgaacgaggtgctcccggacctctgcggcttcatcgtggactacccgagctcgcacaggcacgtcgaccgcgaccggctccagcagctggtcgacaggctcgatccccgggtccccgccgttggggtcttcgtggacgagccgctcggactggtctccgagctggccgacacggtgctggacatggtccagctgcacggcaacgagggaaacccctacatcgtgttccttcgcgagctcgttgacatacccatctgccaggcaattcgcgttcgcacgcccgacgacgtgcgccgcgcgaacgagtcaaaggccgacatcgtcctcctggacggtggcgcaggctcgggaaaggccttcgactggtccctcatccggggcgtcgagcggcccttcatcctggcgggaggcctcgacccgcagaacgtgggcgaggcaatagacaggttccacccctggggcgtggacatgagctcgggcatcgagaccgaccggctcaaggaccccgggaagatgcgagcggccgtggccgcagttaggggaagagatgagcaactccgcgacctctcggggtcggttcgggattcacgggggacagtacattcctgagaccctcatgaacgccgtgatcgagctcgaggaagcctacgaccggtacaaggacgatcccacgtttaacgccgagctcaccgacctgctcaacaactacgcaaaccgtccctccctgctctacttcgccaagaacatgacgagggacctgggcggcgcaaaggtgtacctcaagcgagaggacctcaaccacaccggcgcccacaagatcaacaacgcgcttggccaggcgcttctcgccaagtacatgggcaagacccgcctgattgccgagacgggcgccggccagcacggcgtggcgaccgccaccgtcgcggcgctcctcggcatggagtgcgtggtgtacatgggcgtgaaggacatggagcgccaggcgctcaacgtgtaccgcatgcgcctgctgggcgcggaggtgcgcggcgtgtcgtccggcaccggcaccctcaaggacgcggtgtccgaggccatgcgcgagtggaccagccgcatcgacgacacccactacctcatcggctccaccatgggcccgcacccgttccccatgattgtccgcgacttccaggctgtgatcagccgcgaggcgcgcgcgcagatcctcgaggcggagggcaggctcccggacgcggtcatcgcctgcgtgggcggcggctccaacgccatgggcagcttctaccacttcatccccgacgaggacgttcgtctcatcggatgcgaggcggccgggcgggggatcgacaccaaggagaccgccgcaaccatcgagaccggtcgcgtgggcatcttccacggcatgaagagctacttctgccaggatgagtacggccagatcgcgcccgtctactccatcagcgccggcctcgactacccgggcgtcggccccgagcacgccatgctgcacgacacgggccgcgcggagtacgtgggcatcaccgacgacgaggcggtggacgccttcgagtacctgtccaggcaggagggcgtcatccccgcaatcgagagcgcgcacgccgtggcgtatgccatgaagctcgcgccgaccatggacaaggaccagatcatcatcgtcacgctgtccgggcgtggcgacaaggacgtggcggccatcgcccgctacaggggagaggacctccatgactagcatcaaggacgcattcaccgcggcggacgggagccgcaagaaggcattcgtgccgttcatcacctgcggggactcctcgctcgacgtcaccgaggaggcgcttctcgccatgcagcgggccggtgccgacctcatcgagctgggcatcccgttcagcgaccccacggcggagggccccgtcatccaggaggccaacatccgcgcgctctcgggtggcgtcaccaccgactccatctttgcgatggtcgagcgcgtgcgtggcaggggtctcacagtgcccctggtgttcatgacctacgccaacgtggtctttggctatggcaccgagcgctttgccgcaaacgccgccaaggcgggggtccagggcgtcatcctcccggacgtccccttcgaggagaaggccgagttctccgagcccctggccgcggagggcctggagcttgtgagcctcatcgcccccacctcccacgagcgcgtccgcagcatcgcgcgcgaggcgcaggggttcgtgtactgcgtgagctcgctcggcgtcaccggcgtgcgctccaagatcacgacggacatcgccggcatggtcgagctcgtccgcgaggcctccagcatccccgtcgcggttgggtttggcatcagcacgcccgagcaggcggcgcggatggcggcggtctcggacggtgccatcgtgggctcggccatcgtccgcatcgtcgcggagcatggcgaggggtgcgtcccctacgtcgaggagtacgtgcgctcgatggcggaggcggtccactccgcataagtggcttgcgtggcggcgggggatgggcgtgatgcccgcctcccgccgccgcgacggcttacagattcattgccgtcgcgtatttcggccatgaactgctcggatacaaactaggtggtagttggtcagagtcttcccatgggggtggcaaccatgactaccatcgctctttccggtcgttcgggcatctccggagggcatccgcgcgatgggcttgcgggggttggcgctgccggggggagagggacgtccctccgcggcttcggcggtggcctcctggctgtgggaggtcggcctgcccatcgtcgtcgtggcaacctacctggtgagctttgcctgcatcgtgatggggctgggagaggagcgcgcgtggacgctcttcctcctcgggttcagcctggccgtcgttgccctggttctgggcatcccggtcctgcgccacagggcgctgtgcgcccgggagggcaacggggtgacataggggccctgtggcgccgagcggatcggcgaccctcgtcaccaccatttggggcctggtaccaagccgtccgcctggtgggctgacacgtcgcgacccctcaagatcgaagaaggggagagggccgtccgccctgtcgtcgtacggcgcgcgcatggcagccgggcttttgagccgtagcctcgacgcatgctcccagctcctccgtggccattctcaaccaattcacttgggggcgagcctttggcccaaagccaatcgccggtcggaggggcattggagttcagagaggggaagagaccggtcacccctgcggggttactgtccgcggggaagggcctgctccgttcctgaccttcgggaccacctgccgcgcaggctctggcggcggggtttccgatgtgctgcgtgtctcacccagcgtcccgccgcccgggctccatgtagcgactatcccggcggggaatcaatggctaagaatggggtgggtcgcccctcgcccggaccagtcgaccctccccctccacgcgcggaaggccaccgtagtcccctcatgagggaccccctttgcgagagcgccacaccgcggattgggcgccttccgggaagggcccgctggcagcaaactcctgacgtgtgcgctttccctggcagtggcagccgccgcagtgcgtcgacttcgcgtttccccagttggatctctatcaaccttgcaataatggcagctgcttcccgacgtgagtgctcatatcgggaagcagctgccattgggaccccggacgattttccggacctaggccgccagcgtgtagccgtagcccaggtccctcctgtactccgccgtcgtcctccagccgagcgacttcttggctcacgtccgttaccagggacacgaggcgtcgagcctgtccctgaaccctcgaacggacccccgtcccgcgacgcctcgaagagtcgtctgggcccgaagaacactcgcatatctcgctgtatgtcggggccatctcgccttgagagaaatcgagagggtgacgggccctctgtctgttcgatgtagcgaggcacagttatccggtgtgtgtgtatttttctcttatgtgatggcaccgcttgatgtggtgcgtgtttttatttgggaccaacaggagggcgccgcctcggtcggccccacggacacccaaaaggtccgagcagcccaccagcagctcctgtcgtgtgcagcgagaccatccagcagacgggacctcccggtagaagcgtcgatagcgggcgagaggaggccttgtagccgtcgagggcgaactcggtgacggcggtgacgcagagcaggccgggctcgccagcgcggaagtcgttcgtgagtgccagtcctccccgagcggaaggttgcggggctcggggcgagtgttcgcagccagggttagctgtggtagcgggccctatgagcatctgggccgccttcctagagagcgagccctcctaccgcatgatggcaataacgaccttctcggaggcgatgaccggcgtaccctcgtcgcctccgcggagggttcgccgcacgagacgggcttcggcccagcgacgcgcctcaggtcggcgcgtgaagcctcggagcagaaggtgccgaaggaggctcgaaggaagagcggaagcgcgccccctgagggcagcattcgtgtcggggcggagggatgagagcctggccgcctggcgagaggtgatctgggtatggcgagggtctccgcagacgtcagcggagcctgacgccgggctcgggccctcactggccgccttgccctgccgcgaggttggtacctctccacgctggttcaaagagccagggggggttgacttttaggaaggtccaacaccgcagggcctcggcggctttactcggtcatccatgcgcccgctcccgggggtcctcggcaggtcggcgcccagtcgagcagtcgtcgccccgcgtgcctctcgatgccgcaaaggtcggccccttccgctcgccccgtcccacgacggggaaggctaccacgccgcgccctcgctacacccggcgctcgtggggccgcacgctcggtgcgggcagtgcatgcggcggccagccgggcataccgggcggacgagctcgaaggcgcccctacgcccgaaggcctagtccgctttgaggacgttcctgtggggggaaacatcggaagtcccggcaggcgccggctcacgctcagggccgctcggttggaactcccagaggatcccctcgcgctcctccctcgtgttagatcggactcttccctgggaccctcacgaggtccgggatttgtacggggtcccattcgggtctgggaatgggtccgatgcctcaactcccgatgtgagactcacatcagtcgttgttgccgcgggccgggaagtgggcgagtccaaaggcgccccccacaccgggggggataacggcagggctgaacagccccggctggtaattctgcggttagcgatgtgctcacatcgggatccggccgccacgacgcgttccccccagtggggcccgtacggttgggtacagcacattcagagttcgggccatgaggcaaatactcgcgtgagcaattacgcggggaggagtgcggctgccgcagttagatgtgatgcattgatggcgggggggaatgcggctccggtgttcgtcggcaacccttgagggtgcttcacgcgaggcatttgtgccgggcggctgcaaacccgttcttctaggactctggccttacgaattgtaggccaggcgctcgggcacgtgccgccgatgtgtcattgaaaggcgccgcgcggggagggttctgacacgccagccgtgactggccgcaggagggacagttgaggtccgcgatgccgttgggcatgtcgccccgacacggccacgcaatcctcgcgttcgtacgtttccatcatgcgctctgttgtgccatccatctgatgcgcgtgcgtctctggattggcagcgtgcttagagaactcggtgagttgtacgagttgcggcagaggcatgctagaagagctcggtgcctggtggatttcggacgggtcgacccgtacgggcacgagaaagttaagcacttgtgcttgaaatccacgggcatcgggaacgttcaaggcaggtatgagttctcccgaccgcggaggaccccgatggaaacgcaaaccctgccaccatagatcagccagggaagctggcgggaataggagcccggtcccgcggcccggtcccgatcgggaccttgccacccccgctcctgccaggcgtctcagtgagggggaaatgcggggataaacctctcttgcagaaagttggtcaacttctgagtgctagtcctccgagctggactatctagtagtactcctgtagggcagcgaaatagggacgtcatgcccggtcgaggaccatcgcgccttctccagccggtcctcgggtgggttgacgatgacgagaacaggttgagccagtcgtcgatgcggggtctcgcctcgaagccggaaatggcggtgcatgaactcttcagcaggaagtgcatgtggttgacgcgggagagcggggtgtgggtgtcgttcgccccttcgaggtcggccggacctgtaggcgacgatcgggcagcccaagccgctcgacgagcaaggatggagtctccattcgtggaagagcgtcgaccccaagggcgatcgtgccgcacgtaggcgtcccagcacttcgactgctggattgccgagccagcccgcacagcgaggctcctgccggagagtcgtcgcatcccaaggccgatgcagattcctgtcctcgatccgcgcccatcccggcccctgactccagccctgtccctggcggcgagggggcggttgcatttctagtcgatcgggactcgcccgagagcaggacgcgtcctgaacgccccctccagaacggcgaagagtttgtccatcaccaggcggtggtggtgccgatcctcccgtcctccttggttatcgccgctaggctctcgaagccgaacgcctggcacatgatagacccagtcgcgacgggggaggagcttgggtcctcgaagacggtgcaagttgccggcgggcgtggaaggtcctgccgcaggacgcgcacctccagcggcgggcgcaatcggccttcgtggcaccagtcgctgatttggatgtggccgctgcccgacatctggggcaaggggccggttaccctctcgttacccgttcatgaagtcgcgtcccctgtcgtccattcagagcaacggtgcggaaattcgtacacggtcctatggcttgctccggacggcccagctgtgcggacgtcaggtcggacgtccgggacagctcgtccagggatcgtcgcgaggcgcggggcgtgcatctcgtgccgctcatggttggtttcctgcctgccgcggtcgggggcggcgccggggggactccaatcgccagatcgccgccacccaccgcggcattctggcggatggctatgtcctgtggtgattatagggccgcggagctagtcctggcggaagaccaactttctgcaaaagcggatttttgcgggataatccctccaaggaagctcgttctggtttggggatgggagagggcatggcagacgtcaggtttgcgaccataggcaccagtgccataaccaagcggttcgtcgaggcgctcgcggagattcccggcacccgctacgtggcggcctactcgcgtgaccttggccgcgcccgggagtttggcgagacacgcggggccaccctcgcgttcgacgacctgaatgcgctcgcggcgtcggacaaggtcgacgccgtctacgtggcatcccccaacggggcgcacgccaggcaggcgtcgcttctcgcccaggggggcaagcacgtcctggtcgagaaggccttcgcgtcaaacgagcgcgaggcgaccgaggcgttcgtgtgcgcccacgagtcgggggtcgtgtgcatggaggccatgcgcaacctccacactccgggcttccataacgtggcggcgaacctcgcccgcgtgggcagggtgagccaggcgaccttccggtacggcaaggtcacctcgcgcatcgccaagctcagggcgggcgagcacgtgaaccagtttgaccccgcgctctcggagggcggcctcatggacatcggcgtctatgccgtcgagcccgcaatcgcgctgttcgggcggcccaagcacgtgagcgccagcctgctcaccatcccgcttccgtgggagcccgagccctcgggtgccaggatcgacctcgcggggagcgtggtcctgagctatccccgcaccatcgtcgacctcaactacagcaaggtggcgaacgacttctacggcgcccaggttgcgggcgacacggggacgctcatgtgggagcagaccaactgccccgccgacctcaggtttgtcccctacgaggacaagggcatggtgtacagcgccgccggcggcaaggccgaggtcatccccgccaccatgcccgacaacgacatgacctgcgagatcgcgacgttcgtcagtgcaatcaacggcgacgccgacgccctgggcagggttgccttctgcgagcgggtcaccgtggggtcccttgcggtcatggacgaggcgcgccgccaggcgggaatccgcttccccgccgacgacgcccgctaggggagggtgcatgggactcctgggaatgcttcgggcgcatgggggagagaagggcgagccatccggcacgcagctcctctcgccggtccccggccttctcgtgcccctctcccaggtgggcgacccggtcttctccgcgggggcgatgggcgagggctttgccgtgagacccgaggacgagaccgtgctctcgcccgtctccggcaccgtgtcggtggcgggagcccccaacttccacgcggtcgacatcgccggcgacggtggtgccgaggtcctggtgcacgtgggcgttgacaccgtcgagatgggcggcaggggcttcaaggtgctcgtccgaccggggcagcgcgtcaaggcgggccaggcacttctcgccttctcgcgcgacctcatcgcacgggcgggcctcgacgacgtggtgatcgtctcggttcccaactccgccgacctgggtggggttcgcaccatcctcgacggccgggttgacgccggcacccccgtggcgcgcgtcggggcatagggagacagcccctctcgccctcgggaacccccctcgggcgtgccgggcgactggctgggggcggcggcccctctcccctgcccaaccctccgcccatcgacccttacctcatccttacggcgcgatgcccccgcgtggatgccccagccccacgcttgtcttgctgaaagcgcagggcgaggatgggagtcgcatggagacggcggagctgggagtgggcatggcagcgggcacggaggcacccttcaaggtggacgcggagggctccgcgtcccgcgggaggcgtcaggtccccaaggcgctgctggagcgtgccgacaccgtgacctgctttgtcgtcccgtccgtggccgtcgcgctctcgctggcctcgctcgcggcgggccgcctcgacctcatggggaaggtgcccctggcgctcctcctgatcgcccttgtcggggggcttgcggtcggctcgattgcgctggagcgaaacgcgcggtagcggtcgggggttcgcggcgtgacgacttcgtgacgctccgacgcccattgttacggtctgggaaaccgggacgtcccccgttcccagggggtgtcaaactaaccaccaagtcgcgctcgtggggagcgcgcacgcatacgaggagtctctcatgcacagggcagaggtcgcagttctggggaatgccggtcgcaccatggggtgcgcccttcttctcgctgcgctcgagcttacctcgcccctagcggggctccccctagcgtagggtccgaccggcccacacccgggcggtagcgcgtcgcgtttccgtccagacggttctctctaacgacctccccacccctttgcatgcgagctccttggcggtgccatcaggtgccgtgccacacgcgtccattggcccaagacggcaaggagcaaagatcatgacccgcaagattgacatcttcgacaccacgcttcgcgacggcgagcagtcgcccggagcctccatgaacaccgaggagaagctcgtcatcgcgcaggagcttctgcgcatgcacgttgacgtcatcgaggccggcttccccatctccagccccggcgacttccgctccgtgcaggagatcggccgcatggcgggcgacgacgccgtggtggtaggcctcacccgtgccgtcgacaaggacatcgaccgcgccgcggaggcactcaagaccgccaagcgcccccgcatccacacgggacttggcgtctctccccagcacctgcgcgagaagctccgcatcaccgaggacgagtgcgtggagcgcgccatccactgcgtcaagtacgccaagcagtacgtggacgacgtcgagttctacgcggaggacgcgggccgcgccgaccagaagttcctggagcgcgtgatccaggccgtggtcaacgcgggcgccaccgtggtcaacatccccgacaccacgggctaccagatgcccgacgacttcggccgccgcatcaaggggctggccgacaacgtcattggcatcgagaacgtcaagatctcggtccacacccacaacgacctgggcatggcaaccgcccttgccctcgcgggcgtcaagaacggcgcgcggcaggtggagtgcaccatcaacggcctgggcgagagggccggcaacacggcgctggaggaggtggtcatggccatcaggatgcacggcgaccagctcgacgcgcacaccgacgtcgtgaccacggagctcacccgtgccagccacctggtgagcagcatcaccggcatgcaggtccaggccaacaaggccatcgtgggcgcaaacgccttcgcacacagctcgggcatccaccaggacggcgtgctcaaggcacgtgacacctacgagatcatcgatcccgccgacgtgggtgccgccgggtccgagatcgtgctgtccgcccgcagtggccacgcggccctcaagcaccgcctcgccgagctgggctacagcttctccgacaaggagtacgacgagatctaccagcgcttcctcgaggtcgctgaccagaagaaggaggtctacgacgaggacctggagtccatcgtgcaggagcggcagcgcagcgtgacctcggtctacgtcctcgacgccatccaggtcgtctgcggcgatgccgcggtgcccaccgccacggtcaccatctcggacgaggcgggcgagaagcacgtggtcgcctacaccggcaccggtcccgtggatgccgcctacaaggccatcgaccaggtcgtctccgcaaactgcgacctgcaggagttctcggtcaagtccatcacgcgcggcatcgacgccatcggcgaggtcacggtgcgcattgcggcggaggacggcaaggtatacacgggccgcggttccgacaccgacatcgtggtctccagtgccaaggcctacgtcaacgccatcaaccgcatgatctcgaccggtcgctccaaggcgggtaagtaagcgggagactgaccaccgcggggccgccgccgggcggagcgaacaccaagagagagggacctacatgacacgagccatgaccatggccgagaagatgcttgccgcgcacgccgggctggacgaggtcgtccccggccagctggttgagtgcgacctggacggcgtccttgccaacgacatcaccgcccccatcgccatcaagacggtgcgcgagatcggtgcgggggtgtgggaccccacgaggatcttcctcgtgcccgaccactacagcccgaacaaggacatcaagagcgccgagcagaccaaggtcacgcgcgacttcgcgcacgagatgggcgtcacccactactacgagcagggctgcatgggcatcgagcacgcccttctccccgagctcggcgtggtgggaccgggcgacctcgtgattggcgccgactcccacacctgtacctacggcggcatcggcgccttctccaccggcgtgggctccacggacgccggcgtgggcatggcaacgggtcgcgcctggttcaaggtccccgagaccatccgcatccaggtggacggcgagctccccgcgggcgcgagcgccaaggacatcatcctctacgtgatcggcaagatcggcgtggacggcgcgctgtactgcgccatggagttcaccggatccaccatcgccaacctgagcgtggaggggaggctcaccatcgccaacatggcgatcgaggccggaggcaaggcgggcctgttcgaggtggacgacgtcgcccgcaagtggctggagggcaggaccgagcgcccctggaccgagtaccacagcgaccccgacgcgcagtacaagcaggtcatcaagatcgacgccgccgacatcgtccccaccgtcgcatggccccacctgcccagcaacacgcatcccgttgcagagagccgccacatcaagatcgaccaggcggtcatcgggtcgtgcaccaacggccgcatcgaggacatgcgcgccgccgccgacgtcctgcgcggccgcacggtcgaccccaacgtccgctgcatcgtgatccccgccacccagggcgtgtggctgcagtgcgtgcacgagggcctcatggacgtgttcatcaacgcccactgcgtggtgtccacccccacctgcggcccctgcctgggtggctacatgggcatcctcgccgcgggggagaggtgcgtctcgtccaccaacaggaacttcgtcggccgcatgggcgaccccacgagcgaggtgtacctggcgagccccgccgtcgccgcggcatctgccgtcgccggtcacatcgcgctcccgtccgacctgtagcccccgcccgagcaaaggagatactcaatgcagttcaagggaaccgtcttccgctacgggagggacatcgacaccgacgtcatcatccccgcgcgctacctcaacacctccgatcccgccgagctcgccaagcactgcctggaggacctggacaccaccttcgtcaagcgggtcaagccgggcgacatcatcgtggcggaccagaactttggctgcggcagctcgcgtgagcacgcccccgtggccatcaaggcagcgggcgtctcggtggtcatcgccaagagcttcgcgcgcatcttctaccgcaacgccatcaacatcggcctccccatcatggagtgccccgaggcctgcgatgccatctcggacggcgacgtggtcgaggtcgacgccgacaccggcaccatccgcgacgagaccaccggccagaccttctcggcccagccgttcccgccgttcatccaagagatcatcagcgagggcgggctcgtcgcccgcaccaaggcgcgcctcgcccgcgaggccaagggagagtaggcatggcatccaagacgtaccgcatctgcacgcttccgggcgacggcattggccccgagatcatcgccgagggaaagaaggtcctcaaggcggtgggcgagaggcacgacgccgcctttgagtgcgaggaccacctcatcggcggttccgccatcgacgccacccgcgcagccggcgaggaggtgagcgccctgccgcccgcaacgctcgccgctgcccgcgccgccgacgccgtgctgctcgccgcggtcggcggccccaagtggaacgacaccacgccgggcgccgttcgccccgagcaggggctcctcgccatcaggaagagcctgggcctctacctcaacctgcgtcccgtgcgcatgtaccaggcgctgcgcgacgcctcgccgctcaggcccgagaggctcgagggcgttgacctgctcatcgtgcgcgagctcaccggcgggctctactttggcgagcacacgcgccgccataacgtccccggcgcgggcgtcgacggcgccgcgggcgacgccgccgttgactcgatggagtacagcgagcacgagatcgagcgcgtggtgcgctgggcctttgacgcggcggcccggaggcgcggccgcgtggcgtcggtcgacaaggccaacgtgctcgagacgagccgcctgtggcgcgaggttgcccatcgcgtggcggcggagtaccccaaggtcgaggagtccgacgtgctggttgacaactgcgccatgcagctggtctccaaccccgcgcagttcgacgtcctggtgaccgagaacacctttggagacatcctctcggacgaggcctccatgctcaccggctcgctcggcatgctcgcctccgcctcgctcggctccggcacggccctgtacgagccgagccacggctccgcccccgacatcgcggggaagggcatcgccaacccgctcgcgcagatcctctccgtggagctcatgctccgctacagcttccacatggacgacgccgccgacgaggtggcgcgggccgtccagcgcgtgctcgacgacggttggcgtaccgtcgacatcgccgacgcccagacgcccaaggaccacgtcctgggtaccgtcgcgatgggcgacaaggtcgtggagtacctggggtaggcacatcccccaacttaaggggagagagacgcgccgctgccggtgggagggcccacggcggcggcgcgtcgcatctctcccctgtgaagaggcctttcggtgggtgcgacggtcgctggacgtgggagcgtcccgttatgaaaggggcccggggcgcacggctcccggaccccacgaatgctctcgttacgacgcggctagcccgcaagccccgcgatcacggaggccagcgcgatgaccacgcccaccaccgactcgccgcccagcaggccggaggccacgaccaggccgctctcgtcggactttgcccgggcctcctcctgctcggcgttcgataggcacttgcggcgcgaggcgcagacgcggtcgtagacaaccttggcgagcgcccccagcgcgccggtgaacgaaaggtagaacggcaggtacacacccaggccaaacatcatggacggcaggttggcgtagtacagggcgatgcctgcaaccaggccgatcgcaaatgcggggacgctggggatgcccgacaccatcgtggcgaccaccgaggcctgcgccgccacaaactgcttgtcgggcccaaaggcgtcgggtccgtacgccgagaccagcgcgaccatgaccgccgccgccacgaacgctcccagtacgccgccgatggcctggcccagccactgcgcacgggggtcggtgcccaggatggcgccagccttgaagtcgttcatcacgtctcccgcaagcccacaggcaacggcgacgatgcccgcaacgtagaacagccgcacctgggggaggcccgagaacgccgcgaccacgagcatcacgatcaggccaaagatctccatggggtcgatgccggtctggccgcaggactgtgcgctcatggcggtggtcacaaaggcgaggagcaccaccacgacggcggggagggggccaagccccaggcccaggcaggcgagaaccgccacggccgcggtcgccaggccaaggatgccggcatccagccgcacgccgccggacaccagcgactcctgcccgtctcccccggcgtcgccgccgcgcatgccacgcaggatgcccgccgcctcggggaggatgtcgcgcaccaccacggcgatgccggcccccatcatcaggcccatgcccaggctcttcacgatgccctgtgccgcctcgacgtcccacagcccgacggcgctgcccgcgaccaccaggccaaagttggcaaagaccgcgccggcaaaccaccaggccactgcgacgcctcccaccaggaagcccaccgagagcatcatgggcgagttgtagatgccaaaggtcacgccggggatggggagcgacgcgagcatggtggggagcacgccgagcgcgtcgcgcagcacggtgtaggcgcccgcgatgcccatggagccaaacagctgcgcgcccgtcctgccgcctgcctcagtcgcccgcagcgtctgtgccgcggcgttgcccatggggaactccagctgggagtccacgatgaagtgacggtggatgaccgccgtgcaggccaggccgagcaccgtgccacacagcgccacgaggagcatctgggtccagcccacctggtcggcgtaccccagcatccaggcgccggggatcgtgaacgcaaggccgcccgcgaccatcgcgcccgcggacatgatggtgtgggtcacgttcgcctcgttgagcgaggcgttgcccagcagcttgaggaagaagagcgagaccaccgccgcaaacacgatgggccaggggagcgcccccagcctcagggcggtgtaggccgaggaggccgtgatgatcacgcagcccacgcagccgatgatgaccccgcgcagcgtgagctgcccgcgccacgaggcgcggtcggtaccgttgtccatgtgattctcctgttcgtatatccgctccccctgtggccagctggcaacgccgccgcgtggcgagcgagtgtcggcgatgccggggagtcgggttaccggatgcccgccgccccggacatgggtggcggacttggtacagtatagcgacggcatcgaaggggagtggtacgcatggcgcacgaggtccgaggggtcgagggagaagtccggtccacggatgcccaggcggtgctcgccgtggacgtgggaaacaccagcacgtccttcggcctgttcggcgcgggtgtcgacgcgctggcggagcccctgggcacctgggaggtcacgacccctcagcggctcacccccgacgaggcccgcatgcaggcgcggcaggtcctggcgtgtctcctcggcgatgtcgccggcggaatgaccctgcccgcgtttggcgggggagaggcgcgtggccactcggccggcacccccgtccccatgggtgcgatcctctcgtgcgtggtccccagcctcagcgccgcgtgggaggacgccctgcgctcgctgtgccccggcgggcgggcgctggtcgttggccccggcctgcgcacggggctgccgatgcgctacaaggacccctcggaggtgggaccggaccgcatcgcggacgtcctcgccgcccgggaggcctacgggtcgccggtggtcgtggtggactttgggaccaccatgaacatcgaggtcatcgacgcagcgggagcctttgacggagggatcatcgcgcccgggctcgtgcttggggcgaccgccctcagccgcgcggcggcgcgactccccgtcatcgagctccgtgcgcccgagcgcgcgattggccgctccacgcgcgaggccatgcggtcgggcgtcgttctgggggaggtcgctcgcgtggatgggttgctcgaccgggtgttctccgagctggggcaggcggctcccgtcgtcctcacgggagaccacgccggacagctctcggcgctcctcgcgcacgaggtcagggtggacgagaccctcaccctccgcgggttgcaccagctgttcctctccaacgccgggaggggcgggcagaggcagcgcagggcttgaggccgtctcgtcttccagtggttggcccaggggcagaggtcaaagaaggggagagaaacccgtcgtgggaacgggtccacatcccttgccctgcctctggtcgtcagcatcgtcgggaggtccgtgtcagcaatcccgtcccgcgtgcacacgcgggacgaactttctggcagagctgaagccatgaggtttctgctatcaggggaaacgtgtcagcgggacagatcccatgtcagaaatcgcatcccgtgtgtacacacgacgcgcactttctggcgtctgagggctcggtagggaccaccctgcctaatagcccgtcccacgtgtacacacgagatgcgatttctgacggtagtccctcctcgtcctcggactgccgcgtctccttcgatagccaaagaaggggaagagagacgcctccactcgcggctgccccatgacgccagcccaaagcggagtgcgactgccccctcggaacggctctcggttccgcggccctccacctggcccctcttatacatcaaagtcaaaactatggcagtaactttccgacgtgagcgcttccccgcgggaggtgtgcccgcacgggccgggcccacctggcattcccccaggtgggggactcgcgcgaggcggaagccccccgacccgtggcggcagcctcccgatgtgagcactcacaccgggaggctgccgccattcggaagcgattggggggcctaatggcaggagactcccgatacgagcactcacttcagaagtttgctgccaaggttcaaggtttgattggaatccaactgggattgaccccgggcgtcggaccccctgtcagcgggagcccgatatgtgtgctcgctttgggagttccctgccaattggcccgtcggagaggattaccgatctcatgaggaggggtcggccgggtgggacggcgggcgcctcctccattcctaggcttcgattccctgccatgggtggcacggctcgaggccccgggggcggggtttagacaggaccacggggagccccgtcctatgtgtgcacgcaagcgacttgctgccgggggccgctgtcgcgtcccccatccctatctgctccctcttagacgcttttagacgggctgcaggtacgtctttcccaccgagtgaagagactccctcactgtcgtgtcaacccgttcccacgggccagccagacatggctgctattccagtctagtgacgatgagagtgaactcggtcgacccatcgcgccgttgtggcgatatcgcttctcccctggttccgcgtgtcctaacggtacaatcgggtggaccaactgcgctgtgactgacggagaatcgtggaccaccacgggggagcggcgcacgtaacctaccatgccgaccgtctgggcaagtcgcacccgcagggagcgtctgcccacgtgtggcgtcgttcccttggtgcgaaggatcgcttcgaagggagctcgcatgcaggacctggcacagctactgagggagaacccgtacccgggccgcggaatcgtggtgggtgcggggcgcgtgtactactggattatgggtcgcagctccaacagccgcaaccgcgtgttcgtcacgaccgacgacggcatccagacccgggcgcacgaccccagcaagctggaggatcccagcctcatcatctaccaccccgttcgcaccatgggcgatgacctcgtggtgaccaatggcgaccagaccgacaccatcgtgcaggcgggcagcttccgcgacggctgcatggcccgcgagtatgaacccgacgcacccaactacaccccgcgtatcagctccatcatccatcccgacggcagcttcgagctctccatcctcaagcgccaggatggccgctgcctgcgcgagttcttcgcctacgagggcgcggacgagggctgcggctacttcatcagcacctaccagggcgacggggacccgctgccctccttcgcaggcgagcccatcccggtgaacgtccccgaccccgaccaggtgtgggcggccctcaaccaggacaacaaggtgagcctctacgccaacgtggcgggcagggtgaagctctacaacaagaacctcggcgactaggcaagggagaggaactggcatgaactcgctcgaactcaagtatggctgcaaccccaaccagaagcccgcgcgcatcttcatgaaggacgggtcggacctgccggtggaggtcctgagcggcaagcccggctacatcaacttcctggacgcgctcaactcctggcagctggtgaaggagctcaaggaggcgactggtcttcccgcggcggcgtccttcaagcacgtgagccccgccggggccgcagtgggcctgcccctctccgacgtcgaccgccagatctacttcgtgaaggatgacctcaaggaccccagtcccatcgcctgcgcctacatcagggcgcgcggtgccgaccgcctctcgtcctacggcgactgggcggccctctccgacacctgcgacgccgacgtggcgcgctacctcaagggcgaggtctcggacggcatcatcgcccccgacttcacgcccgaggcgctgcagatcctctccgccaagaagggcggccgctacaacgttgtgaagatcgatcccaactacgtccccgcccagaaggagtgcaaggacgtctttggcatcacctttgagcaggggcacaacttctacaagatcgacgagggccagctccagaacgtggtcaccagcaacaaggtgttcccggaggatgccaagcgcgacctcatcgtggcgctgatcgccctcaagtacacgcagtccaactccgtcgcctatgcaaagggcggccagaccatcggcgtgggcgcgggccagcagagccgcatccactgcacgcgccttgccggcaacaaggccgacacctggttcctgcgccagcaccccaaggtgctctcgctgcccttcgtggacggcatccgtcgcgccaaccgtgacaacgccatcgacgtgtacatctcggaggagcacgacgacgtgctgcgcgacggcgagtggcagaagtggttcaaggagcgccccgaggtcctgaccatggacgagaagaaggcctggatcgccacccagacgggcgtggcgctgggctccgacgccttcttcccctttggcgacaacgtggagcgcgcgcacaagtccggcgtgagctacatcgccgagccgggcggctccatccgcgacgacaacgtgatcgagaccgccgacaagtacggaatggtcatggcgttcacgggcatgaggctgttccatcactaaggggtgggggagaggggccgcgccacttcgtccggccccatcccgctggcagtcacgtcccaagagacaaagcgaggccggtcgtcatccgtgacggccggcctcgtgtgtgatgaccccgatgaacgggcgtgccgcttgggacggctactacatccttggcttgaactccgtggggcaggtgatgatgttgccagacggcccgcggttaccggtcaccttgtgagcgacgcccacgatgagtgcaacgacgccgatgaaggcggcgagcatgagtgcgaaccctaggaagacactccagacgaacaggggactagatacggcggcagacgtaaccataggcgctcctctcacatcacgtgacaactgattccaatgagtaatatacccacttctttataatgtttcaatatggtttctcaccgaataatgccagctaatcgccttacaaatgcgggcggtacaggataacaaaatctccttgtattccaaattacgagtaaaacaaaaataaaatgcatacactgggacgaattctcatcgcacgagggcatttgcccagcatgtacgtatccgcacgcatcagaagatggatgttcgcgaaacacaaatgcatacactcccgtttcaagccgcacaacatcccgaatcactcctgtaatcgtgcgagcggagaatcggcggtgcgagaggcaatggtgcctccgtcgtcgagaggagcgagcggtggcagacggtgtcgattctctgatgtacgagttcggtgcggggaagtccgccatcaggacggtcttcgaggagacctgcgccctgcgcgagcagggacgcaccgacttctgggacttctcgatcggcaacccgtacgtccccgcgccacccaaggtcaacgagaccattcgggaggtcctgggccagtacgcccccatcgacctccacgggtatccccccaacaacggctggcccgccaccagggcggcggtcgccaagaacctcaacgagcgcttctccaccaactactccatgggcgacgtggtgatgacgggcggatgcgcgggagccatcacggcgaccatctgcgccctcacgaccgcgggggaggacatcatcgtcatcaccccgtacttccccgagtaccgcatgtacatccaggcctggaagtgcaagtgcgtggaggttccctccgagcccgagacgttcgagcttgacatcgacgccatccgcaaggcgatcacgccgtgcacgcgcatggtgatcgtgaacacgccgaataaccccactggcgccgtgtactcggaggagagcctccgcgtcttgggcgacgtcctgcgcgaggcgtcaaagcgctaccagaagaccatctacctgctgtccgacgaaccgtatcgcgagatctgttacgacggggcccagaacccctgggtcgccgactgctacgagaacaccatagtgtgctactcgtggtccaagtcgctctcgctccccggggagcgcgtgggctacgcgctggtgccgccctcggtcaccaaccactccatggtgtacgacgccctcctcggtgcgcagcgggcggtcaacaccatcaccaacagcctgttcacccgcgtcatcgaacgctgcgtggacctgccggcgccggtgggggagtacgagcgcaagcgcaagatcatctacgagggactgagcgacatcggctacgaggtggtgcggccgcagggcgcgttctacctgtggctcaagtgcctggaggaggacgaccacagcttctgccggcgcgcggcggcggagcagcacctgttcctggtcgagtcgaccgacttcgggtgctccggctgggcaaggatttcgtacgcgtgcagcgacgagaccctctccacctcgctgccggcgttcaggaggctcttcgactcctacggtggctaccagtggtgagccccgctcgccgaactttccgtccgggtggtgcacatccggtgattggacgcgtgtctccccctctgttgggtacgaacaaccaaggatagggtcgcaagggcggcctcgcctcgtccaaagggggacatcgtgtgcacgagcattcgctttaacgacaagagcggtcacatgtacctgggcaggaacctcgattggagctgcggctacggcgagagggtcgtggtgacccccagaggcttcaagcccgcttccccgtttggcgtcacccccgaggtcaagcatgccatcatcggcatgggcatcgtggaggagggccagcccctctactttgactgcggcaacgagtgcggccttgccgtcgccggcctcaacttcccggggtatgcggtgtacgagaaggacgcggtcgacggcaagaccaacgtctcgtcctgggagttcccgctgtgggtgtgcgccaacttctcggacatcaacgaggtggaggacgcactggacaacgtcgccatcgtcgaccaccccatcaccaacaagtaccccacctcgctgctgcactggatcatcggggacgagcagcgctccatcgtggtcgagtaccgcgaggatggcatgcacgtgttccatgacgacccggacgtcctggccaaccagcccggctttggctggcacaccgagaacctgcgcaactacatcaacgtgagcagcgacttccccgagggcgagggctccatgggcaccccgctcaagccgtttggcagcggctcctgccagcgcggcctccccggcgactactactccacctcgcgcttcgtccgcgccgcctacgtcaacgccaactaccctgcgcaggacacggaggaggacaacgtcagccgcatgttccactcgctgcagcaggtcgccatggtggacggctgcgcgcgcatgggtgacggcgccttcgagaagacggtgtacaccggttgcttctccagccgcaccaactcctactacttcaacacctacgacgaccagacggtgcacgcctaccaccttgcggactacccgcaggagggcagcgagcccatcgtcgcgtaaggggcgcgaaatacccgtgaggccggcgggcccatgatcgcgaggcaggcctcaaacggattggccgtcctgggccgggggttgtgaccccggcccttttttggccgaagggtatctcggcatcgccggaggcccgcttgggctgcgcggtccgatggctcccaatccatatgagccccccgacactccttacgctgccttcgcgttcgaccctcaggcgactgtcgtagggcagggagggggagaggggcacgctccaggcgagacgaccgacctcagggaaaaaagaggcgtgctcccttgggcagtcggcggctgcgtctggcttccccgatgcccggcttccttgggtttcgagccataacaaacacgctgggaaaccaacggtctaagaatggcgcgggctgtccatcgtttgggccagctggctcacacgcgcgtgccagccaccgttctcctcctcgtcagatggcagcaaactcccggcgtgagcactcacatccgacgtctgctgccatccgagggtgagtgaaggtcaaattggcagagaacttctgaaatgagtgctcacaacgggagctcgctgccaggactcgggaggcgggtgggtccgggagccttccaccttgggaaacgccgagtggacctggttggcgccggacgtcctctaacagggaggcactcacatcggtgtcccgctgccatcgacgggaacggctcggcgaaggaggtgtcgaccaaacgtcgacgcgagcgcgaggggtgccccggcgggtggcaacgtgccggtgccgtcccgcccggccccccgcgggcgcgttggggccgcctcgtaaagttcgacgcgtttaggttgggttaaacgcgtcaatccttatgggactccgagtctcgtaagattccgtgcgtttagggagtcctaaacgcgtcgatcattacgggcccggattccatggggccggccgcgcctcgcgaatcaccctcggcccgaccgcggcgcgtgtcgccgggggccgtcctaaccggccgagggacgcgccacccgcggcccgccctattccccgactcctggcgcgccgcccgtggcggctgcctggtcaccgccgggcccaccggccgagactccgggagggcggtggcgtcgccatcgctgcgggcccttccgggcggggtgggccagcccatacccccggcgccctctccttccattccattctttgactcttcggagtccctctcggcaggcggtgagggggtactgcgtcatccgcgatggaacgctcgtgcgagtactcgcacgagccgcttgcctccatcgacggggcagttttttctatgagctctttaccagcgcagatgtcatggcgacctggcctctcccagccgacagttcgtgagggtgcccgtgcgaggcgtctgccgcaatggggatcaggaggggccccgacccgggagcatgccgtcgcacggctcccgtcacccgcgatcgcgtttctctccatgagcccttttgtgagcgcataccaatcggtcgaaccatgggcctttgcgtcagcgtaggccaggtctccgacgtctggggaggggaggggaaccgcccgtggtgcgtcccgctactccatggtgtgggactcgaatacggggtcgtcgcgccagagcacgacctcccccgcgcgaagcgatgccgggacgtcgatcaggcgctggttcgccgagcccctgaaccggagggtgatgtccttctcgccttcgatgaacgggccgtccaccagcacgtcgaggcacgagaggatgcgtggggtcgcctcggtgacgggagagctggtgtagggtgcctcgaccggcacctcgccccgcagctcctcccacgtgaagccggagtacagccacacgttcttctcgggaaagcgctcgcgcacgcgctccaggaagtctgccagcgggccctggttctcgcgctccatgggctcgccgcccagtacgctcagcccgtccacgtaggggtggtcaaggctctggagcagctgctcctcgacctggggcgtgaagggctcccccgccgtgaagtccgcggcaatctggttgaagcagaacgggcagtgccgcctgcatccagacacaaacagcgtcgtgcgcacgcccacgccgttcgcgatgtcgcagtacttgatgttggagtagttcatgggtgcccttccgattgacggcttcccattctaacaagcgccccggacggaaggcgtgaggcttcgtgcccgtgcgacggcatcacgaggagggcatgccggggacatggcgccagagggggagaggggcgttcgctacgactcgcgaagccgccgctccaaacgtttgccgaccgccaccagggccataacgatgaggtagtaggccacggcgaccacgaggaacggctcgaaggcgcggtaggtcagggcctgcacgctctgggcggcgcgcatcatgtccatgaggccgatggtggccacgagcgaggagctcttgagcaccgtgatgacctcgttcatcagggcgggcaccaccgagcggagcgcctgggggatgatgatgcggatcatcatcgtcgggtatgaaaggcccagggcgcgcgcggcgtcgtactgcccgcggtcaacgccctcgatgccgccgcggagcgtctcggacaccgtcgccgacccgttgagccccagcgtgagcaccgaggcggtaaacatcgagatcttgtatcccgtgagctgcggcgtggcgaagtaggcgatgaacaggagcacgatcagggggacgccgcggaagatcgaggtgtagaagtccaggaccgcgcgcaggggccggcaggggagcaccttgagaacggctatgaccgcacccagggcaaacgccagcaccagggcggcccccgtcacctcgagggtgacgaggaggccgctccagaacagcgactcataggggactacgaccgagaagtccatctccgccggctactgggcgctgctgtccgcggcatcgcccacggtggagcttcccgccgcggaggtgtcgtcgccccactcgaagtccttgcccacatacttgccaatgaacttgtcgatggtgccgtcctccagcatctggccaatgcactcgtcaaaagcggagatgaacgaggcacccttgaccgccatgacgcgatagacgcccacgtagtcgcttgtctcgctgcggtcgagaaggcccagggtcagcttgtcgttggccttctgcatggacacgccctcggcgccgtcgcacacgtaggcgtcgatgcgcccggcgaggacctcctgcaggcactggttgccgtcgtcgtaggtgtggacgtcagcgtcgggcagcactgaggtcacgaacttgttctggacggtgcccgttgtgcaggcgatgctcttgcccttgagcccgtcgacgctcgtgaccttgtccccctgggtcagcacgcccacgagcggctggtagtacccacgggtgaagtcgtaggtcttctcgcgctcctcgttggacgacatggccatggtgaagtccttgtcgttgccctgtaccgaggccagggtcgcggcgaacttctgcgcctcgaactcgtaggtgaagccaaggcgcttggccatctcgtccgccaccgcgatgtctaggcccacgaccttctgggagccgcccgtctcgtcgatgtagcggtagggcgcaaaggcgtcgtcgcccacgaaggtgagcttctggcccgagagggcgccgcccgccgaggagtcggaggagtctgccgtcgcggtgcccgcggaggtggcggaggcgccgccattggacccgcatcccgagaggaacagcggggtgagaaccgccccggctgccatcaggccaaggaatcccctgcggtcgatcgacttgctgagatggctcgtttcacgcgtcgcgcccgcgacgccgttgtccctggtgtccgtatgaattcccccaaaagctaagtgatccaacatgctgcgcactattgtatagtacttaaatcccatcaaacgaatgggaatttggctggtaacgcgctcgactcggattggcttgcaaggcctttggtctcgccccacgcgtcgccccgatggcgtatgttgtctgggatacgacggagggaggacccatgtgggtcacgcacatataccacagtggcttcgcggtcgagctcaagggctgcaacctgctgtttgactggtacaccggggagctgccgccgctgaggagggacgtcccgctcgtggtgttcgtctcgcacgagcactcggaccactacggccgctgcatctggaggctgcccaactcgttttccgacgtccgctacgtggtggacagcgcggtggcggagcaggcgccgcagggcagggacgtgctgtcggtcgagtcggaaggcgactattgcatagacctcgggaccgatgcgggcacgatggaggtccggacgctcgagtccaacgacgagggcgtggccttcctggtgcgcgcgtgcggcaagacggtctacttctcgggcgacctcaacgtgtggtggtggaaccgtcccaaggcgcagaacgaggcatcggagaggttcttccgcggcgagctggagcgcatcgccgatgccgacgtcgacgccgcgttcgtgcccctggacccacggctcgaggaccccgtcgccggcatcgcggcgtacatggacgtcgtgggcgcgcgcgacgtgttccccatgcactactggcacgatgcggaggacgccgaggagtgcctgtccgatccccgcctcgccccctacgcggcgcggctccactttgaggacgtgtgcgagctgcccgagtaagaccgggcaggtgagacccgcgcgcgtgccgcccgcaagtcatcctcatgagagaggggcggggcctccccatcgggagcgcccccgcccctgcgttcaaggcctgtggcccgtgccgctactcctcggagtcggtgcccaggacagacctgcccagggcgtccgtggcgacgatggccgcgtacagctcgtcgggcgtcacgtcgccggcgaggttgtggatcgtctcgcccggcacgcacgcgttcttggcgatggtgcggatgtcctcgtccttggtcacgccgagctcggcgagcgtgatgggcaggccgacctcaaagcagaagtcctggacgtcgaagaactcctcctcggtggcgccctcgagcgtcagctgcaccagcgtgccaaaggcgacgcagttgccatggggcacgctgtggccgcccagggacgtgaggccgttgtagaaggagtgcgccgccgcgcagttgacgttgtcggcgccaacgccggagaggtagacgttggcctcgatgatcgcgtcgagcgcgggggtgaccacgtgcttctcgcacgcggcgagcgcttgggtgccgtagttgcgcagggtctcgtagcagagcttggccagtgccatgcccgcgcgggtgatgccggtgccctcgaggctgggggactcggtgcgcagggacgcgcggccctcgaagtaggtgcccagggcgtctcccatgccggcgaccaggaagcggacgggtgcgtcggcaatgacctgcgagtcgaccatcacggcgtcggggttggtggggtagaagaggtacttgtcaaagctgccgtcgtcgttgtagatgaccgagaggcccgtgcagggagcgtccgtcgccgcgacggtcgggatgatcacgacgtgcttgccggtgtagtacgcggtcgccttcgcggtgtccacggccgagccgccgccgcacgcgaccacggcgtcgatcttgtcctcctccacgatcttctgcatcttggcgatctcgcccttgctcgagatgccgccaaagacctcgtagcgacggtagtcgtcggagtcgccaaagctctcctcgatcttgtcgtgacaggccttgtagccgctcttggagcagatgaacagccagcggctgcccatgtagcccatctcgtccttgaacttgaggagggcacccttgccctggacgtacttcaggggctcacgcatggcacgaagcagtttcatgaccgatcctctccctgtgatgcgcccccggcctcttccgaggacgcggctacgacgattctatagcaggtgggcatggcggacgtcgcccgtcgtgccaggagagacccatcttccccaacctgtttgagaaccaacgcgatgggggcatcctgtctcccctggggcttcccaccttggccgatattgaacattgcacccatattatgcataagtgatacactcagagttgaattgttgcagaattgtttatttacagccaccagcgatacgaaacccatatacttgcccagacctttaacgcggtacgagataccgagaaggcttgcatagcgcttgtcgtcgggcactggtccggcctctcgggagcacgcgccctgtgcgcggggctccccttttttgggcggtggacggcgtgggcgcggaaaggcgggtggtgcagtgaacctgttggtcaacacggagggctgccgggaggccctcatcgcgctggaggacgggaccgtccttcgcggacgagggtttggggccccgggcgaggcatttggcgagatcgtcttcaatacgtccatggtgggataccaagaggtcgtgaccgacccctcgtatgcggggcagatcgtgaccttcacctacccccagctgggcaattacggcatcacggcaacggatgcccagtcggcgcgtccccgcctgaggggcgtcgtggcacatgacgcgtgccgcacgcccagcaactggcagtgcgtgcagagtctgcccgactatctcacccagagcggcgtcgtggggatagaggacgtggacacccgggccctcaccctgcgcatccgggaggcgggtgccatgcgggccgcgatctcgaccgtcgacctggacccggcgagcctcctcgcccgcgtgcgtgcgtctgcctgcatcggcgagcacaacttcgtggcggacgtctcatgcgacggcacgcgcgtggtcagcgccaggggagaggtgcgccaccacgtggttgcctacgactgtggcatgaaggagggcatcgtcgagcgccttgcccaggcggggtgcgaggtgacggtcgtcccctgggacacgcccgccgaggacgccctcgcgctgcatcccgacggggtgttcttctccaacggccctggcgaccccaccgccgtcccccgcgtgcccgacgccgtgcgcgccgtgctcggaaggctgcccgtctttggcatctgcctgggcaaccagatgatcgccctcgcggcgggcggctccatacagaagctgccctacgggcaccatggcggcaacgagcccgtgatgaacctcctcacggggagggtcgaggtcaccgcccagaaccacaactacggcgtggtgttttccagcctcggacggctggtgcccgagctctccggcggcgtgacggagcacccggccgacggcgacctgcgcgcctggagccgcgcgcgcatcgcccccgtggtgcgcaacgagcgctacgggcgcatccgcctgacccacgtcaacctcaacgacgggacccccgagggcctgcagtgcctggacgttcccgccttcgcggtgcagtaccaccccgaggccaggccggggccaaacgactcggcgtacctcttcgagtcgttcgcgcgcctcatggacggccgcgacgactacctagccatcgacgtgcgagagggaaggtgccactagatgcccaggcgcgacgacatcaagaagatcctcatcatcggctccggccccatcgtcataggccaggcctgcgagtttgactactcgggcacgcaggcgtgcaaggcgttgcgcgagcacggctaccaggtggttctcgtcaactccaaccccgcgaccatcatgaccgacccgcagaccgccgaccgcacctacgtggagcccatcacgcccgagtcggtcgccaaggtgatccgcaaggagaggcccgacgcccttctccccaacatgggcggccagacggcgctcaactgcgccgtcgccctggcggagggcggcgtgctcgacgagtgcggggtggaggtcatcggctgcgacatcgactccatccgcacgggagaggaccgcgagctctttgcccaggccatgcgcgacatcggccttgaggtcgcccgctccgggacggcccacacgctgggggagtgcgagcgcatcgcgagcgagatcggctaccccgtggtggtgcgcccggcgttcacgctgggcggcgccggcggcggcatggcccgcacccacgacgacctggtgcgcatagcccgtgagggcctggcgctctccgccaactccgaggtcctggtcgagcagagcctggaggggtggaaggagatcgagatggaggtcatgcgcgactccgccggcaacgggatcgtggtgtgccccatcgagaacctggaccccatgggcgtgcacacgggcgactccatcacggtcgccccgtgccagacgctcagcgaccgcgagatgcagcggctgcgcgactactccctcgcggtgctggagcgcgtgggggtcgcctgcggtggctccaacgtgcagtttgcggtcaacccgagcgacgggcgcgtcatcgtgatcgagatgaacccgcgcgtgtcgcgctcgtcggcgctcgcgtccaaggccacgggcttccccatcgccaaggaggcggcgcttctctcggtcggctacaccctggacgagatagccaacgacatcacccaggccacgcccgcctgcttcgagccctccatcgactactgcgtggtcaaggtcccacggttcgcgttcgagaagttcgagggcacggacaccaccctcaccacccgcatgaaggcggtgggcgaggtcatggccatgggggcgacctttgaggaggccctgcagaaggcgctccgctccctggagaagggacatgccggactgggggcggacggtcacgacgacttcgacgaggagcactttgagcggcgcgtcgcgacggcgacccccgagcgcatcctctacgtggccgaggcgctgcgacgcgggtggggcgtggaacgggtgcacgagctcacgcacatagacccctggttcctctcgcgcatcgccgacatcgtcgccgccgagggcgcgatcaggcgcctggggcttgcgggcctggaccacaaccacatgctcgccgccaagcagctgggcttctctgacgcccagatcgcctggctcacgggctcgcgcgaggacgtggtgcgggccgtgcgcgaggtggtgggcgtgcggcccctcgtcaagaccgtggacacctgcgccggcgagttcgccgccaggaccagctaccactacctcacctacgagcgcggaagcgccaccgagttcaggcaggcggaccgaccgcgcgtggtaatcctctccgccgggccaaaccgcataggccagggcatcgagttcgactactgctgcgtgcacgccgcctacgcgctcgaggccaagggatacgagacggtcatggtcaactgcaaccccgagaccgtctccaccgactacgacacctccgaccgcctgtacttcgagcccctgaccttcgaggacgtcatgaacgtgatcgaggtcgagcggcccgtgggcgtcatcgtgacgctgggcgggcagacccccatcaacctcgccggaaggctccgcgacgcgggggtgcccatcatggggacgcagcccgacgccatcgacctcgccgaggaccgcgaccgctttgccagcctgctcgaccggctgggggtggcctacccgccctcgtccacggccgagacggtcgaggacgcccgcgccgtggcccgtcgcgtgggctacccgctgatcgtgcgccccagctacgtgctggggggccggggcatggcgatcgtgtacgacgacgagggccttgccaagtacatgtccgcggccacgcgcgtctcgcccgaccaccccgtctacctcgactcgttcctcgaggacgccatcgagctggacgttgacgccctctgcgacggcagcgagtgctacgtggggtccgtgctggagcacatcgaggagtgcggcgtgcactcgggcgactcggcgtgctgctggccgccattctccctctccgacgccatcgtggggcgcatccgcgacatcacgcgcaggctcgcgctcgcgtgccgcatcagggggctgctcaacatccagtttgccgtgaaggacgagcaggtcttcgtcatcgagctcaaccctcgcgcaagcaggaccgtgccgttctcgtccaaggcgacgggcgtgcccctggcccgcatggcggcccgcatcatggcaggcgagaagatcgccgacctggggctgccgcccgaggaccgcgaggtgggctactacgccgtgaaggaggcggtcatgccctggagccgcttcccgggggcggacgtcaccgtggggcccgagatgaagtcgacgggcgaggtcatgggcatcgacacgaccttccccaaggcctacgccaagacccgcgaggccatctcgtatcgcatccccatggaggggaccgtcttcgtgtcggtctgcgacgcggacaagcgctccatcgcgcccgtggcgctctcgctctccaacctgggatacgacctggtggcgaccccggggacggcaaagacgcttcgcgccgcgggcatcccctgccaggtcgtgaggcccatacgagaggggagccccaacgtcctcgacatgatggcggatggccggatcgcgttcatgatcaacacgcccaagggcggcagcaccaggggagacgggatcctcatcaggagcgccgccgtcaaccgcggcatcgacatggcgacgaccatgtcgggtgccacggcgctcatccaggcgatagcggcgctcaggaggggaccgctggacgtgtacgcgctgcaggacctgtaggggacggacttcggacgtctccgaggtaacggccccgggcccgcatcggtgggtccggggcctgttcctgtccagagccctccctgggcccgttggcagcaaacgacccgtctgagcgctttcgcggacggtttgaggcagtccgattcattacgatatttgcgcaggcaaagagctcatagaaatgagggtggttctcgcccatggcggcaaacgccatgcgcgagcactcatgcggtcgacttgctgccacagtttgaacgttgatgcgcggccaacaggcaaacgcggctgcgcccatttcttggcccgcgtggaggcgctcacgcgagtgcctttcggccagccatcccattccccagggttcgatggcagcaaactcccgatgtgagcaccttcccgcgggggagaggagcctgggcatcgggcccggccgacgtttatgcaggtggggacccctggagctgaaccgctgctttggctgtggcagcaaactcccgatatgtgtacacacttcgggagtttgctgccaatcggctccctttccggggtcgaatggcagagaaagcccgatatgagtacacacatcggaatctatctgccatagttgcgttgttgattattcgtcaactgggtttagccgctatgcacccaccaaccgggcagccagagcccgatgtgagtgcacatttcgggagcttcccgccagtaggtcagccgtcagggttagccgtcccacgccccacttttggcggggaaggaacttcaagagcaagatcgtaggccaggaacaaataaaggggttggctggccagggggtcggtggcctgccccattctttgctgattggtgccctccgtggtagatgtctctcgggacgcagagggctgggaatcaggaaaagccgtccgtcaggccgaaaagtgcgtcccgtgtgtacgcacggtgagagttattgggcagaccgatcgttttcaatgccacggatgacagaaagcgtgtcccgtgtgtacacacaccatggagtttctggcgccggagtcaccagccctcgagtctttccagttgcatgggagttattgactaggcaatgccagaaagcgcgtcccgtgtgtacacacaccatggagtttctggcagaggctgacccgactgtcaccttggctcttctgatgggacggatgtttccggaattgagtcgacggcacctctcgagagtccctgaaaggttggctggatttctcgcatttttcagacgatgcagttgggaatctgagaggggatgttaatttcagttacccaacaatgcataactatgtatgcagggaggaaaccacgtacgtaacggtaaggtttcgagcgatggttcatcaacgttatctagtaatcaaggtttgtatcgtatgacagccttacgaccatactaatgtgaagcgatacgaaaccacaggctatctaccagcagaaacgaaatgtttcggcgggagaagctgacgtcagtactctcgcaacactaaagctgagtggttgtaggaacgactgtgctgataaaatgaatacaatgccacagcatttgtaacaaaatagtgagaatccaataattcaaacattcgaaccaaacgaagattttcataacataaccgtcatactgagaattatgtgaacggtatcaatctgactgcgaacggtattcccctgccgtcgaccccatgaatctcgccattcgacttggaagccactcgaccttccactacggaagctttgcatcatgtcacgcgtgcgtaacaaatcgtgacggtttctaggggaaggtgatggcatggaagagacgtctgcggtctcgtctgccggcagcatcgccgagcagaagaagagggagctcgatgcgagcttcttcaagaagggcatcctcgtggccctgttctccagcctgatgtacggcttctacacggcattcatcacggcgggtgagagctcccagctgtggctggggtggatgagcgccatcaatcccacggcgttcctcgcggtcttcatcctgcccaccgtcgccagcgcgatcaacgactcctgcagcgccctctgggccctgggcatcactgccaaacagggtaagctcggcgacttcggccgcacgatcaacaccaagcccggcatcatcctcatcctgagcgccctcgtcggcggccccatcgccaccgtcgcgtacatcatcgccctctcccaggcgggcactatcgtggtccccatcgcggcactcaaccccgcgattggctccatcctctcccgcatcctctacaagcaggagcttggcccccgtaagatcgccggcattgcgatctgcgtcttcgccggcctcatgattggctccgccagcctcaccggcgactcctcctccaacatggtcctgggcctcgcgctcgcattcgtcgccgcgctcggctggggcgccgagggctgcatcgccggctacgcctcctgcatgatcgacacccagatcggcatcaccatccgccagtgcgtgtccggcctcgtcgagctcctcgtgatcctccccgtcttctccctcgtgggtggcgtctccctgggcgagaccttcggctacgtcggcgccgcaatcaccgacctgcccaccatcctctgcttcatcgtcgctggcttctcggcctacaagtcgttcgccagctggtaccgcggcaactcaatgtgcggcaccgcccttggcatggcctgcaacggcacctacaccttcgtcgcgccgctggtcacctggatcgtcgtcggcctgatcatgggcgtcgacggctacgcgctcgcgcccatcgcatggattgcggctgtcgtgatgatcatcggcatcctcgtgatcgccgttgaccccaaggagctcttcggaaagaaggaggcggcctaatgcgcccgctcaactatgcgatgctcaagtacttcaccacggttgacgaggccagcgtggacgacgtcatggacgccctcaagggcgagtacgccgacttcaccgccttcaagcgcgacaagatgcaggaggcgctcatgacggccgagaagaacggcctcatcggcgagtcccgcgtcgacctggacgacaacggcgagctgcgcgtgttctacaccgcgactcccgagcagcgcgacacgatcaattcctacatcaagtagagggggtacgccatgcgctacaagggtgaggaggccatcggcctcatcgagaccatcggaatggtccccgcgctctatgcggctgacgccatgctcaaggccggcgacaccgagctgatcagctacgagaacatcggctccacgctggtcacgatcatcgtcaagggcgacgtcgcggcctgcgaggcggctgtgaaggccggtatggaggccgcctccagcatcgggaagctcacggcgcacaacgtcatgaagcgccccgtgccgccgatcggcgacgtcgtctccgtccacgacgtcgattacaactagggaggaggagcaatggcaagcgagggcatgaacgctctgggcgccatcgagacctttggcctcgtctgggtgctcgaggcaggtgacgccatgtgcaaggcgggcgacgtcgagctcatcggctacgagaacaccgcctccggctacatctcgattctggtccagggcgacgtcgccgcgtgcaaggcggctgtcgaggccggcgtcaaggccgtcgaggccctgggcgccgaggtctacagctctgtcgtcatccccaggccgcatcccagcctcaagaagatcaccgacaagtataccgtcgagaagctccttccctactaagggggtgtggcatgtcactcatcgataacgaccttctctccatacaggaggcgcgcatcctcctggagcacgcggcggagtccgccgaggtcctggaggggctgccgagcacgcttgtcgacgatttcctgacccacctccgcgaggggctccttcccaaggcgcaggagtacgccgaggaggcgttcgctgagagcgactactgctcacccgaggacgaggccgggctcaccaagtgggtcgtgacggacctcctcgacgacgtctgctcgcagacgccggtccagcggatcgtgcactcgcgcaaagggtccgcggaggtctgcctctccaagggcgtcgtggtctcgctccttcccgactggcttgcggtaccgaccatgctgagccagctcttcatggccgtccgctccaagagccccatcgtcttctccgccacggcccgcatccacggcacgtgcgagaaggtcatggacgacgtgctgaagatcgccgagttctgccactacccgacggaggccatcggcttcctcagcatcttctgcccggagggggaggagtgggtctgctcccagccctgcgtgcgcgtggtcatcgactcgcgcgaggatgcgggtgtgcaccccttcgatgcggcgggcagggacgtgtactacgcgacgctgggcaacaacccggtgtttgtggagtccacggcggatctcgccctctgcgcagacgaggtcgtgctggggaagtcctactgctacggcatgcttcccggtgccgagcagagcgtggtggtcgagagggccgtggatgccagcttccagacggagctccgtcggcgcgggtgccacttcctctccgacgaggaggcagaccgcctggtccacacgctgttcatggacgacggccgcccgtaccgcgagctcatcggcaagagcgccttcgacctggcccgccgcgctgacatcgtggtgcccgagaccaccaaggtgctcgtggtggagaagccctacgtcagcgaccgcagcttcttctccaaggcaaagtacggcccggtcctctcgtactacgtggaggacagctggcgcaccgcctgcgagaagtgcatcgagctgatcctgaacagcgggcacggcaacgcgctcgcgatcttctccaaggacccggaggtcgtgaggcagttcatcctcaagaagcccgtggggagggtgctcgtcaacgtgagcaccggcctgggctgcatcggctgccacagcgacctgcccaagacgctcaccgtcaccgggtgggactgcgccaccacctccgagctcggcgtcacctacggtgacttcgtgcgcaggcgccaggttggcatagggggcagcgcctccgccagggacctcctggagcgcgcgagctcgtgcgaccacaccccggtcgcgatcaaggttcaccttcccgaccccaaggcggcccgggagggccgggacgaggggtccgagaacgttggcaaggagccgggggattggttctccggcgtggttgaggcaatgaagaacgattctgaagaggagtgagaatggacattaaggagtttgcgaaggagctgtccgaggctaccaaggacatgtccgacgagcagcgcgccactgtccgcaagatgttcgagaaggtggcggaccagcttgacgcccccgcccccagcacgcacgcggccgtgagcgttgacaccccctacgacgtgcccgacggccccaccgaccgccaggttcgcctgaaggacaacttcctcaagcaggtccccagcatcaccatgtaccgcgcccgcgcggtcaccgagatcatgaaggccaaccccggcatgcccaagatcgagctgcgcgccaaggccttccgtcactgctgtgagaccgcgcccctcgtcatccaggacgacgagctggtcgtgggcgccccctgcggcgcaccccgtgccggcgccttctcgcccgacctcgcctggcgctggctgcgcgacgagctcgacaccatcggcgaccgtccccaggaccccttctacatctcggaggaggacaagcagtactgccgcgacgtcctgttcccgttctgggagggcaagtctcaggacgagatctgcgaggaccagtaccgcgaggccggcgtctgggagctctccggtgagtccttcgtctccgactgctcctaccacgccatgagcggtggtggcgactccaaccccggctacgacgtgatcctcatgcacaagggcatgctcgacatccagcaggaggccaaggagcacctggcacagctcgactacgccaaccccgacgacctggacaagatctacttctacaagagcgtcatcgacaccaccgagggtgtcatgatctactccaagcgcatgagcgaccacgccaaggagctcgccgccaagtgcgccgaccccaagcgcaaggccgagctcgagcagatcgccgacatcctggcctacgtcccggcgcacaagccccgcaccttctgggaggccgtgcagtccgtcttcaccatcgagagcctgctcccggtggaggagaaccagaccggcatgtcgctgggccgcgtggaccagtacatgtacccgttctacaaggctgacatcgaggccggccgcatcaccccgtaccaggccttcgacatcgccggctgcatgctcatcaagatgagcgagatgatgtgggtcacctcccgtggccagtccgagttcttcgccggctaccagcccttcgtcaacatgacgctgggtggcgtcacccgccagggccacgacgcgaccaacgagctcacctacctgctcatggacgccgtccgccacgtcaaggtgtaccagccctccatcgcctgccgcatcaacaacaagtcccccgagaagtacatgcgcaagatcgtcgacatcgtgcgctcgggcatgggcttccccgcgtgccacttcgacgacacgcacatcaagatgatgctcgccaagggcgtcagcgttgaggacgctcgcgactactgcatgatgggttgcgtcgagccccagaagtccggccgcctgtaccagtggacctctacgtcctacacccagtggcccatctgcatcgagctcaccctcaaccacggcgtgcccctgtggtacggcaagcaggtcactcccgacatgggcgaccccgagcagtacaagacctacgaggagtttgacgccgcggtcaagaagaccatctactacgtcaccaagtggaccgacgtggcgaccgtgatctcgcagcgcgtcgcccgcgacgtggcccccaagcccctcatgtccatcatgtacgagggctgcatggagagcggcaaggacgtctccgccggcggcgccatgtacaactacggccccggcgtcgtgtggacgggcctcgcgacctacgccgactccatggccgccatcaagaagctcgtcttcgacgaccacaagtacaccctcacccagcttgccgagggcctcaaggccgacttcgagggctacgagcagatgcagcaggactgcctcaacgcccccaagtacggcaacgacgacgactacgccgacagcatcgcggccgacatcatcgactacaccgagcacatccacctggacttcaagacgctgtactcgcacatgtccaccggcacgctgtccatctccaacaacacgcccttcggcgagatgaccggcgccaccgccaacggccgcaaggcctggacgcccctctccgacggcatcagccccacccagggcgccgaccacaggggacccaccgccatcatcaagtccgtgtccaagctgtccaacgactccatgaacatcggcatggtccacaacttcaagctcatgagcggcctgctggacacccccgagggcgagaacggcctcatcacgctgctgcgcaccgcatcgatgttcggcaacggcgagatgcagttcaactacctggacaacaagaccctcatcgacgcccagaagcaccccgagaagcaccgcgacctggtggtccgcgtcgccggctactccgcgttcttcaacgagctgtgcaaggacgtccaggacgagatcatcagccgcacgatgctgaccaagttctagtcaccgagcaggcaaggccatggaggagccgcacgtcgcggcacgaaggaagaagggagaggttgctatgagccatgagcaggggagcgttgaacgcaaggcgcgcatcttcaaccttcagaagtacaacatgtacgacggccccggcgtgcgctccatggccttcctgaagggttgcccgctgcgttgcaagtggtgctccaaccccgagagccagcagcgtgggcacgaggtcatgttcaagagtgccaactgcgtcaactgcggcgcatgcgtggccgtgtgccccgttggggtgcacaagatggtggacggcaagcacgtggtcgaccacaacgtgcagtgcatcggctgcaggcagtgcgagcaggcctgcatgtacagcgccctgcaggtcatgggtgacgaccgctcggtcgacgacatcgtggagttcttcgacgaggaccgggacttctatcgcatgtccgggggcggcatcacgctctccggcggcgaggtcctggcccagcccgaggccaccctgtcgatcctcatggcctccaaggcgcgcgggtaccacaccgcgatcgagacctgcgggtatgcgcccaccgagacgatcatgaaggtggcccagtacgtggacctcttcctgttcgacatcaagcagatggaccccgtcaagcacaagtactggacgggcgtcaacaacgagcagatcctctccaacgtgagggacctcctcgagaacggctacaacgtgcgagtcaggatgcccctgctaaagggggtcaacgactccaaggaggagatcgacgccgtcatcgcgttcttcaagccctaccgctaccagaagaacttcgacggcgtggaccttctcccgtaccacaagctgggcgtcggcaagtacgcgtcgctcggcagggactacgagatcaaggacgacccgtcgctctccgaggacgacctcaaccgcgtcgagggctggatcaaggacgcggacttcaaggtcaacctcgtcaggcactagcggcgggaagcgagagacgccccgccaatccggggcaagggaaaccagaggggaggaaggcatgcactacgtaaccgaggacgagcttcgcgaggcctacgccaaggcgccgtttggaacttacgagctcccggacaacgcgcgcctcacgccgagcgcccgccagttcctgatcgacttcagggtcgacttcggctcaggcgagggcgagcaggcacccagggcacacggccaggcagcggcgaagggcgttcgcggcgagggcccctgcgatctgggagcgctcgtgcacgacgccaacctcctgggcgcaaggctgcgcctcatggcacgcagggcgctcggcatcgacaacgccgtggcccgcagggcggaggcgctcggccgcaggtggcaggaggcacggaccccggcggacctggtcgcagaccagcccaagggcgacgtcgacgccgagccgcccggcccgccgccggcgccggccttcgacgccgccgtgcaccccgccttcttcgagatggcatacgtgcacgcgcagctcggccggtacgcacgcgcatgggacaacgctcgtgcagcggcagggcccgaggacgcccggaccataggcacctgggtgtcgcaggcggcgctcatgtgcaaggagttggaagaggcagtttcaagagcagagggggaggtgtaggcgatggtcgatctggagggtgcaaaccagaggctggaggagctcctggcctgcgttgaccaccccaaggccgtcaaggagggccagaggctctactgcgggctggacctgggcaccgccttcatcgtcctggtcgtcctggacgaggacggcaaccccgtcgactgcaagtaccagtttgcgagcgtggtcaaggacggcatggtcgtcgactacgtgggcgcctgcgacatcgcccgcaagctcaagggccagatagaggaggagctcggggtcgagctggaggagtgcgccgtcgccatcccgcccgagaccgggtcgctcgacggcggcgccgtccgcaacgtcgccgagagcacgggcatggagtgcatcgccgtgttcgacgagcccaccgcggccaacctcctcatcggcaccaaggacggcgccgtcgtggacatcggcggcggcaccacgggcatctcggtcttcgaggacgggaaggtcgtggagtgcatcgacgagtccacgggcggcacgcacttctcgctcgtcctcgcgggtgccaaggggatgaccttcgacgacgccgagcgctacaagaggcagccggagaaccaccgcgaggtcctgcccatcgtggcccccaccatcgacaaggtcacctcgatcatccagcgcgcttgcagcggctacgacgtccccgaggtgatcctggtgggtggcacggccgagctcacgggcatcgaggacagggtgcgcaagcaccttggcatcgaggtccacaagcccaaccaccccatgttcgtcacgcccatgggcatcgcgctggggtgcaggctcaaggccagggagctcgaggatggttgacatcaaggtgatcaaggcccccgccccagggaccatgcagatcatccggcagaggagcggggcacgctggggcgaggactttcgccccgcggcggtcggcctggtgcagggcaagctgatcgagatggtcgtggcgagcgacatcgccgagaagaccgcgggcgtgacggtgaccgacgtcaggggctcctgcccccagaacatggtgatgctcgccatcgccggcgagacggcggaggtcatggagtgcctgcggaagatccgggacggaggggacggaacgcatgattgtcggtaagctcatcggctccatctgggccacccgcaagtacgacgagctcaacggcatgaagctcatgcgcgtcgaggtcgttgcgggagacgacgccggcaagcagctgatctgcgtcgacaccatcagtgctggcgtcggcgaccgggtcatcgtcaccaccggagcctccgcgtacctcttcatgagggacgagttccagaagaacgccccggttgacgcagtgatcgtaggaatcatcgacgaagacgtgagtctttaggaaaggaggacgggatgaagaggctgatcagcgcccaggacgtcatcgctgccgcagagcgtcacgagaacctcgtcgtggacgagaacaccatcgtgaccgcccaggcgcgtgacgtcgccaaggagcgcggggtcctcctcgagacgggttccgccgtcgcgaagtccgcgccccacgcggaggcggcgcccgtggcagagcaccacgaggaggcccatcacgaggagcaccacgaggaggtgcaccacgaggaggcaaaggccgcgcagcccgcgctctccgctgacgagctggagcgcgtcatctccgctgcctttgagaagggcatctggaccaaggaggaggtcgaggccctcttcaagcccaaggcgatcgacgccaacatcgtccccgtgggcgtctccggccgccacatccacctctcccaggagcacctggagcagctctttggcgccggctaccagctcaccccgatcaaggacctgagccagccggggcagttcgcctccaaggagtgcgtcacgctcgccggccccaagggagtcatccagaaggtccgcgtcctcggccccgtgcgccccaagacgcaggtcgaggtcctcgcgggtgacaccttcaagctcggcatcccccaggagatcaggctctccggccacctggagggcaccccgggcgtcaccgtgatcgggcccaagggtacggtcgtcctcgacgagggcgtcatcgtcgcggcccgtcacatccacatgaaccccgcgcaggccgccgagcgcggcttccacgacggccaggtcgtctcgctcaaggtcggcggggagcgcggcgggatgctcgacaacgtcatcatccgcgtgacggagagcggcaacctcgattgccacatcgacaccgaggaggccaacgcccttcacatcaagtgcggttcaacggttgaggtagtcaggtagcgcgggcgctgaggcgcaggcactagacccagggaggaagaaacatggcaagcaccactgaggcactcgggatgatcgagaccaagggtatggtcggctccgtcgaggcggcggatgcgatggtcaaggcggccaacgtccgcctgatcggcaaggagctcgtgggcggcggcctggtcaccgtcttcgtccgcggcgacgtgggagcggtcaaggccgccacggacgccggcgcggccgccgcgcagcgcgtgggcgagctcctgtccgtccacgtgatcccgcgcccggacggcatggtcgagtcgatcctgccccacgcggagtagcaaccacctaagcagcaagatggtgtgggcctggcggcccgcagacccagggaggaagaaacatggcaagcaccactgaggcactcgggatgatcgagaccaagggtatggtcggctccgtcgaggcggcggatgcgatggtcaaggcggccaacgtccgcctgatcggcaaggagctcgtgggcggcggcctggtcaccgtcttcgtccgcggcgacgtgggagcggtcaaggccgccacggacgccggcgcggccgccgcgcagcgcgtgggcgagctcctgtccgtccacgtgatcccgcgcccggacggcatggtcgagtcgatcctgccccacgccgaggcgtaggtagatggccgcgcagaagtccgggcaggagggcgctcccaagcgcacctcctcccgcaggggggcgggccaggcggccgaggcgggcaagcaatctgcggacgcccccaaggccaccccgtccaggaggggcgccagccgcccctccaccccccgcaaggagcaggcgaccgcagccgacaaggctaagcccgcgtcggccgtggtcgcaaagccggaggccaagcccgtctcggcccccaaggcaaaggctgaggagcccaaggcggcaccaaagcccaaggcagcaccccaggcccaggagcagaaggctcccgaggcacccaagacggaggcccagcccaccaaggcggagccccacccaaccaaggaggtaaccacaatggcaaacgccatcgaggcactcgggatgatcgagaccaagggaatggtaggcgccgtcgaggccgccgatgccatggtcaaggcggcaaacgtcaggctcgtgggcaaggagcgcgttggcggcggcctggtcaccgtcttcgtccgcggcgacgtgggagcggtcaaggccgccacggacgccggcgcggccgccgcgcagcgcgtgggcgagctcctgtccgtccacgtgatcccgcgcccggacggcatggtcgagtcgatcctgccccacgcggagtagcgtcgccgtcccagtaccaaccgtcagctagccggaaagaggcatgatgcaggaattcgattacgatctccagagcatccaggctgcgcgcgacctggctcgcaaggggcaggttgccgccaaccagatcgccaactacagcgtcgagcagatcgaccgcatcctccgctccatggtcgaggtcgcggagaagaacgccgagaagctcgcacagatggccgtcgaggagaccaccttcggcaacgtccatgacaagatctacaagaaccacatggcctccggcctgctctacgagcagatcaaggacaagaagaccatcggcgtcatcgacgtggacgagaagaaccaggtcatcaccatcgccgagcccgtcggcctggtcatgggcatcgtgccctccaccaacccgacctccacggtgctctacaagtcgatgattgcgctcaaggcccgcaacgccatcgtcttctccccgcaccccaaggccgcaaagtgcaccaacctcgccatcaagctcatgaacgacgccgccgtcgccgcgggcgcgcccgagaacatcatccagggcatctcgatggcgaccatcgccgccaccaacgagctcatgcacgcgcccgaggtcaagatgatcatcgccaccggtggccccggcatggtcaaggccgcctacagctcgggcaagcccgccctgggcgtcggcgccggcaactcgccctcgtacatcgagcgcaccgccaacgtgaagcaggccgtccaccagatcgtcgcctccaagacctttgacaacggcaccatctgcgcgtccgagcagagcgtcatctgcgagacctgcaaccacgacgaggtcgtagccgagttcaagaagcagggcggctacttcatgtccgaggaggagtgcgccaaggtctgcaagatcctgttccgcaacggccactccatgagccccaacttcgtgggtcacgccgccctcgacatcgccaaggccgccggcatcagcgttcccgccgacaccaagatcctcatcggcgagcagcacggcgtgggtcccgagtggccgctctcctacgagaagctcaccaccgtcctcgcgttctacaccgtcgccgactggcacgaggcctgcgacctctctatcgcgctcctccagaacggcatcggccacaccatgaacatccacaccgaggacaaggagatcgtccgcaagttctccgtcaagcccgcttcccgcatcctcatcaacacgggcggaacccagggcggcacgggcctctccaccggcctcgaggtcgcgctcacgctgggctgcggcacctggggcggcagctcggtctccgagaacgttggcccccagcacctcatcaacatcaagcgcgtggtcaacggcctggtggagcccgacgaggtcgctgccgtggacgagaccttcgccaagtggcaccccgagctcgccgctcagtacggctgcgcaccccacgccgagggcggctgcggctgctccgagacgcactgcgagcccgcgcacgagacccacgacacgggcatcgagatgcccgtgggccacggcaccagcggcatcagctactccgtgggctgcaactgctgcggcggccagaccgtgacgcaggaggacctgcagcactccagcgacaccatcgatgccgcggagctcaagaagatggtcaacgagctcgtcgccgcgttccgtggcgagtaggccaagcgacctttagggaaacgtctgccaagaggcaaggagctgaactatgaacgaggcactgggaatggtcgagaccgtgggctgcgttggcgcagtcgaggcctccgatgccatggtcaaggccgccgaggtcaccctcgtgggcaaggtcaacgttggtggaggcatcgtcaccaccttcgtgcgcggcgacgtcgccgcggttaaggctgccaccgacgctggcgcggctgcggccgagcgcgtgggcgagctccgctccgtccacgtgatcccgcgtccgcactccgacgtcgagctgatcatcccgcacctgaacgcgtaggaccttggatctctcggccttctacaccgagcttgaccgtctgtacggcgagccggggtcggacgtcgcgggcttccttcgggaggccctgcggcgcgcccggctcgccggggacgggcggggggtcgccgcggcggccaacgagctcgagagcgtcctgaggctccgcggggagctggacgaggctgaggggctgtgcgaggaggtcctttgcgtgctggagcgcgagggagccggggacgacgagagggcgcgtgccctcatcaacctcggcgacgtctacgttgcccaggggcgctacgccacggcggtcgatgccttcgaccgcgccgaggcgctcctggggagcggagacgcccacccctacgaggtgagcgcgatctgcaacaaccgcagcggtgcgtaccgtgggctcgggcgctttgcccaggcccgctcggacctccgccgggcggggcggctcctggagcgcgtccccggctccgagggacggcgtgcgaccaacgcgatcaacctcgcgcaggtcctcgtagacgagggtcgcgtggaggaggccgccgaggccatcgaacccgcgctggaggcgtaccgtaccctctgcgggggacgagacgtccacaggccccacgccctggcgaccgcggcgcagatcgcctatctgcgcggggactacgcgggggcggcccgtctctaccgcgacgcggcgggggtgctgcgtgacaagctcggcgacgcccccaacgtacgcgccctggaggcatccgcggcgcgcatggagggactggcggcggcaggcacgtaagggtcccacggagccttcgtgggacggtgggaacgatcgggaggtgcggcatgaggggcatggagctggcaaggcggtacttcggggcctacgagcccaccctcgtgttcgggctcccgtactccgtggagcggaggctggcctttggcctcgtgggtcctggctcggagtgcctgggcttcgacgacgatgcctcgcgggaccacgactttggccccggcttctgcgtgtgggtcccccgtgagctctacgcagactggggagaggagctcgcgcgccgctacgatgcgcttcccaaggagttcatgggccagaggcgcgtcgagaccgccctcgcgggccagcgcgtcggggtgttcgagaccgagtcgttctatcgcacgttcaccggcctggagcgcgagccccagggcgtggcggagtggctccgcattcccgagcagttcctggcgaccgtcaccgacggcgaggtcttcagcgacgccagcgggcagttctcacgcgtgcgtcgcgcgctccagggcttctacccccaggacgtggtgaggaagaaggtcgccgccaacatggcggtcatggcacaggcgggccagtacaacctctggcgctgcctgcgccggggcgatgtcgtcgccgccggcaccgcccgcaccgagttcttgcaggcgtccatggcggcgctgcacctgctggcgggaacctacatgccgttctacaagtggtcgttccgctcgctgtccgagcgcgcccacgtgcccgagcccatctgcgcgctcgtctcgcgcatcgcggccgccccggtggcggacgtggcgcaggccgacgtcgaggcgctgtgcggcgtggtcctcgcgaccgtgcaggcgctgggatgggcggccggggactccgacttcctgctcgacgccgcgacggccgcgtggcagggcatccccaacgactacctcagggagcggccgctcaacgagggggcgtatcgctgatgggtacctgcgcttgcgcctgccgcgagggctccggctcctacggtcgccgcctggagcgtcgcagggcgatggacgcgctcttctccgcgcctggcgtcgtggacgtgatggcgggggaggggctgggggagtccgcccgcgccgacctccggaggctcgtggggctggagtgggagcagttcgacgccgtcctgggcatgaacggccgtgccggctgccaggacgacctccgctcgttcctctcgtaccgctgcgctcagtacctggccttcccgcaccgcctcatcccgctggtgctgggggagtacgaggaggccgagcgcacgggcaggaacctcgtggaggagaagtacgcgcgcatgatggccgtgaccgatcccgatggctaccagcgcgactgggcccagcgccttggcaccccctcgcccgtgagggcggcggcgctgcgccagatacgcgcgctcctctcgcccgccctcgaggccgccgcacgcgagctgccgcagtcccaccgccacgcccggcccgacgagtcggcgcctggcagggtgtcggccctcgactacttcgaggccgagctggcgggctactcgctggggacgctgttcgccctcagggacgcgctgggggagcagctgaagcacaccaacccaattgccctgagctacgtcctggcggcgcgtctcagcaaggcgacggaggcgatctcttgaacttgcgcggaaggcaggacaggtgcgacctctaccagataggggaggtcagcaagatcggtgggatctcgcagcgcacgttgaggcactacgacgagctcggtctcatggagcccgacgtcgtgggcgacaacggctaccgctactacagccgccagaccatgctcaagatcccggtgatccactacctcaagatgatgggcttctcgctcgacgagatcgcctccatgcagcagcactccaacctgctcgaggcaaaggagctctttgccaagcacctcgccgcctgcgacgaggaggcacgcctgctcgccgagaggcgcgaggccatcatcgactggacggagctggtggacgaggcgaacgtggtccttcgcgtgcgtcccaccgcggtgagcgtgaagtacctcgccccccgcgacctgctgtgcctgcgctcgcgcttcaccggcgggtttgccgagtccatcgtgagccttgacttcgcctcctacgtgagcagcgtggacaacgccatctcggggcccgtcatcgtgggcttcgactcggtcgaggacgcggtcctcgccgcctcgcaggggtgcgagtgcgacgtgcggctgctgcagaaggccatccgccccatcgccaaggagaacgcgtggaccatgcccggcggcatgtacctctccacctaccacatcggcgccttcgaggagatgggctctgcctaccagaggctcctcaagttcgcgcgcgacaacggctacaaggtcgccggcatggcgctcgagcgctttgtcaccgacttctggacgaccaacaaccccgagctcttcgttaccgagatcctgctaccaacagaaacggagtaaagatgaacgagttctacctcaaggcaaagctgttctttggcccccaggccgtggagcacctgcagtcgctgcactgctccaacgtgctcgtcgtcactgacgggttcctccaggagtccggcatggtgagcaagatgacgcagtacctgccgtcgggcgctcacgtcaaggtgtactccaacgtcaagcccgaccccagccaggagctggtggacgcgggcgtcgagatgatcttcgacgtcaagcccgacctggtgatcgccttcggcggcggctcgtgcatcgacgcgaccaaggcaatcctgtacttcgcggccgagaagggcatggagcgcccgtacttcctggccatccccaccacggcggggaccggctccgaggtcaccaacttcgcggtcatcacgcgcggcaccaccaaggtcgcgctgatcgacgacgcgctcgctcccgacggcgccctcctcgacgccagcttcacgcgctccgtgccccccaagatcaccgcggacaccggcatggacgtcctcactcacgccctcgaggcctacgtgagcaacaaggccaccaccttcaccgacgccatggccgtcaaggcgctccgcatcgtcttcgaggaccttcccgtggtcttccacgacggtgacgccatgagggcgcgcggccgcatggccgaggcctcctgcgtcgccggcatcgccttcaccaacgccggactgggcatcaaccacagcctggcccacgcgctgggcggccgcttccacgttgcccacgggcgtctcaacgccatcctcctgccctacgtgatgcgcttccacatggcagagcccaagtaccgcgagccctacgaccgcgtcgcgcgcgagctgggcatggcggacgccgacgagctgctgcagcgcgtcatcgacctgcgccacgagcttggcatcgaggaccgtctggccgacctgggcaccatcgacgccgcgagcttcgaggagcacgtgggcgacatggccgaggccgcgtcccacgaccgctgcacccccaccaacccgcgcccggtgtcgaagcaggacctcgtgaacctctatcgcgacgcctacaacggctaggggcgtcgcccgggcgtgcggagccttccctgggtcgccgcacggccgggcatgaccgcccgcatttcctctcctcccctgggtgggccgtcccccgcatcgttgggagggcggcccgcgccattgggcgaagggtgccttgacactcacgggaggtaagcaagtaagacggagcttgtgccaggaaccaagactgaacggaggccgtgagcgtggacaacggtcaggaccagattcgcgtcgtacaagagacggtctcgggcaaggagatcacccttgcccacgtcatcggcgggccggagccgattatctacaccaagctcggcctcaacccgtcggttgactatggctcgagcgccctcggcatcatgaacatcacgccgcccgagtcggcggtcatcgcgtcggacatcgccatcaaggcggccgacgtgtacctgggctttgccgaccgcttcaccggcaccatgatcatcaccggcgagatcgccgacgtcaccaccgccatcacccaggtggtcgagttcttccacgacatgctcggctacgtcacctgcaaggtcacgaagcgctaggggccgcaggtgggcgagaggatcacacgaaagcagttcttcgaccaggtgttccaggggaatccgcggcgcgacgagaacggcgagctgcgcatcacccgcgtgcgcgtgcccgggcgcgagatcgacctcgcgcacgtgatgggcacctcgcggcgtcgggtgtgcgagaccctgggcctggacatcggcgtccacgagggcgaggaccacaccggcgaggccatcggcttcatgaggttcaccccgtgggaggccgtcgtggtggccgcggacctcgcggtgaagcacggctccgtggagattggcttcatggaccggttcaacgggtctctcatccttaccggcccgatcgccgagatcgagagcgccgagcaggagatcctggactactttgacacggagctcgacttccacgtgtgccagatgacgcgcagatagggggaggcgtgaagcgactgttcctcatggggcgcagcgaggccggcaagacctccctcacccaggcgctccggggcgagaagctccactaccacaagacgcagtacacctacgccggcggagagaccatcgacaccccgggcgagtactccgagtccaagcaggcgggcgtgggcctggcgtgcttctccttcgagtccgacgtggtggccatcctcattgcggcgaacgagccgttcacggtcttcgcccccaactgcgacgccttcctcaaccggcccctcatcggggtcatcaccaagatccacgcgcccaacgccaacatccccatggtgaggcagtggctgcagagctgctgctgcgagcacatcttcctcgtggacaacgccacgggggaggggatccccgagctcagggcatacctggaggaggacgtccccaccatctcgctcgaggaggccaagcgccgccagcgcctggggctccacgactgggagaccctgcctgccggtgcgtagggtcggggccatggccgtggctcttctcgcctggcctcgcctggccgcagcctgtccatcgcagtccgcgtgctgggttgttcccccgtcagggcgtctcgtctgccgcaatccacgcaccggggtcgattcgcctactgggtcgaactgcccgccggggcgtctcgtaaaatttcacgcgcttaggcaccggctaagcgcgcgaaaccttatgggactcagaattccgtaagactacgcgcggttaggggcccctaaccgcgcgtttctttacgagactgggtttcgctggcgggcgcccttacccccgagtcccttggggccgttgggctcgacctttgcctcgcacagggcgacgtatcccggtatgcaaagtgggacataccctcgtggatgcgtccccttgccggtcgccgtctggggcgtcagaacgacgaaaaggaggacgcaccctcgtggatgcgtccccttgctggtggcgttctggcaaggcggccgtggcgtctgcccgcccgttgatgtacttccggactcccttgctgatggcgttctggcaaggcggccgtgggcccaacccgtcggctgggttccccaccctacaacgcgtgcctcctgcgctcgagcgcggcgtggaccatggcgtgctcggtgcggtacgtgagcagcaggtagcccccgtacacgaccacgaagatcgttgccgccatgaccgagctggaggccaggttcacgaagccgaacgtctccaccagcggcaccaccacggccagggcgcaggcggagtgggcgagaccaaccacgagcggcagcacgaaggccagcaccgtctgggtgcggagcgacccgtacaccaggcgcgtggggcaaccgagctccgagagggtctggtaggcgggggaggagtcctcggcggacgagagctgctggatcgcgaggatggcggcgcacgccacgaccagcacgaagcctatgtacagtgcgaggtagctcacgacgccggtggtggaggatccctccgagtaggtctccgtcgccgtgccggtcatgttggcgaccttcgcgccgtcgagggcgtcggccagggcccggatccccctgtccccctccgcgatgccgtgggcgtactcaaagtcgatcacggtctggtacagggggcagctcgccaccacgtcgtcggggagcacgtagatgcccgggttgctcgcgatggtgctgttctggaccaccgcggaggagtccgtgacggcgtggtcgagcgccggggtgtacctggttccaccgatggtgaacgagtagcccttagccagcgccttgctgtaccgctccgacacgttggccatgctgctggtgaccaggtactggtgctcgcccagctcgatgggggagaggcccttgagcgccctgagcgcgttgaagtcgctcaggcccatggcggtggcgtagttgtcggcgctgaagccggacgggagctcctgcccggtcgcctgcatgaccgcgttcatggacatccccgccccgtcggcgaggtcgctcgcgtcatagagggttacggtcgcatggctcccgatggcatcgaggtcaacgcccgtgcccgccagcgcctggctcaccccgtcgggggtgccggtcccctccgccgggaagatggccaccgaggcgtcgtaggccacgttcttctccgccgcctcgttgatggcgctgcagatgctcatgccagcagtgaccgaggtgatcgccaaaaataggatcagcgagatcatggccatggagaggctcccgctgttgacgcgcgcggcaaactggcgggtggtgaaggcatgcaggtcgcgccagtacaggcgcttggtgcgggtgagaaacgccaccgccgttcccgccagcccaaagaacagcaggacggtgcccgccatcatcatgatcgtcgtgacgttgaaggtcgcctgcgaggtgccgttggtcgcccccggcagcccgtggtggaggagacgggcgtaggccacgcccacgagcgccacgcccacggcaaacagcgccacggagagcggcaggctgcggaggcggttggtctcgccccgcctgcgggcacccatgaggtcgatgaggcgcaccctccggagggtgatgccgttgaagaccatcatcaccacgaaggtcacggcaaagcagccggcggtgaccccgagggcgtcgagcgagaagaagaagtggaagtccctgatggcgaccttgaacaggctccccgtcacaaacagcaggagctgcgagaggagaaaccccagcagcacgcccgcagcgagcgacaccagggcgaccacgagggtctcgagggtgaggatgcgcgcgacctggccgcgcctcatgcccaggacctggtacagccccagctccttcttgcggcggcggaggaggaagttgttggcgtacaccatgaggaagcccatgaccaccgccaggaagaaggtcaccccctggaggatgtcgcccacggccttgagcatctcgcccacgtcgccctgcacgaaggtggcctgggccgagatcgtgttgaacgcgtagaagacggcgacgcccagcgccagcgtgatgaagtacacggcgtagtcgtgcatcgacttcctgatgttgcccagggcgagcctagcggtcattcgcctcgcccccgatcatcgcgaccacgtccatgatgcgcgagaagaactcccgccggtcgtcgctacccctcacgacctcggtgaacagcctgccgtcgcggatgaagaccacccgtcggcagtagctcgccgcgtactcgtcgtgggtgaccatgaggatcgtggagccctggctgcggttgagggactccaggctctcgagcaggagcttggcgttcttggagtcgagggcgcccgtgggctcgtcggccaggatcagccggggcctggtcacgatcgcgcgcgacgccgccacgcgctggcgctgcccgccggacatctggtaggggtacttgtccaggacctcctccacgcccagggagcgcgccacgtcctggacgcgcgcgcggatctcgtcgggggcgacccgcccgatcgtgaggggcagcgcgatgttctcgcgcgcggtgagcgcgtcgagcaggttggagtcctggaacacgaagcccaggctcctgcggcggaagtcggcgagctggcgctgagagagcgagctcacgtcgcgcccgtcgatgaggatgctccccgcgctggggacgtcgatggtcgagacgcagttgaggagcgtcgacttgcccgagccggacggtcccatgatcgcggtgaactcgccggcgtccacgttcaggctcacgccgtccagcgcgcgcgtgaccccgtccctcgagccgtacaccttcttgaggttgcgcacctccagcacgcgggcgtgggctgcgcttcccgcgttcttgcgtcctgccatgtgggtggccatgagcggtcccttctccttgggttgtggtccaagaccatggtcgccccgcgcccgcccgcgggccatcgattgggcttacccctcccttacggtttcgtaagggaggcatcgtcaggggagaggggcgtgggcacgcggcagtggcggggccgttccgctcgctatgacaccatgcgcgaacggttggcggggaacaggacgtcgacgcgcgtccaggcgccctcctcgctgtccacgcccacgtcgagccccatcttctggcacagcgtcgccaccaggtacaggccgatgccggtcgacctcctgcgggagcggccgttggcgcccgtgaagcccttgtcgaacacgcggcccaggtccgcctcgcgtatgccgcacccgttgtcggtcacggagagcacgaccgtctcgcccgccctcccgccgccctccacgcgggcgccgaagcggatgcggggcgtccgcccgtcaacctgggggtcgcagcggtagcgcaccgcgttgtccagcagctggcccagcacgaactcgagccacttggggtcgcagtacaccgtggggccgtcggggtcgtccccgcacgccaggccggacaggtccacggagacgtgcgccccaatgagctgcgacatccgggacttgagggcggcgcgcacgagctcgcccaccttgcacgaacgcaccaggtagtcccgctccagcgaggcgccacgggcgtagaagagcgcctgctccacgtaggcgttgacccgctcgagctcgcgcgagagggggcggaggcggtcgtcgcccaggttctgcaccatcagctcggcggccgcgaggggcgtctttgcctcgtggacccaggtctcgatgaagtcgcggtagtccgcctcgcgcgacgtcgcctcgctcaccaggtggtttgcggcgaggagcgtggcctgcagggcgtccacggcgccgtcgccctccgcgaagccggggtgcgtgacctcggcggcgagcgagagcgtgtcggggccggagtcggcgacgcgcctcaggtcctcgacgcagcgcctctcgcgcaggtagccggacagcaggaggagggcgagtcccagcgccagcaggaggtccaggagggtcgccgcgtcgcgcgtcgcccccaccgcccgcagcagcggccacgcggcggcgaccatcgccaggcagaggagggcctgtcccgcgtgggcgcccaggtactccgcgatgccaaagcgggcgctcgcggggatggcgccgctcctctcgccttccgtgtcggtgggccggcccccgtcccgccgcgcgctcatgccgagtacccctggccgcggtgcgtggcgatgtagtccctcacgcccagcttggcgagcgtctggcgcagccggttcatgttcacggtgagcgtgttgtcgtccacgaaggcgtcgctgctccagagggcctccatcagctcctcgcgagagacgatgcgccccgtcctcctcatcaggagctccaggatgcgcagctcgttcttggtgagctcgtcctcccgtccgttggcggaggcggtggagcgcgagaggtccagcgtgaggccgcggctctcgaccacccggtccgcgtcgtgcctcgccatggtgcgccgcaggatggcgtcgatgtgggcgagaagtacctgaccgttgtagggcttcgccacgaaggcgtcggctcccatggacatgctcatgagctcgtccaggtcggtcgtgcggctggtcagcaccacgatggggacgtcgctcgactggcggatctcgcgcgccacgtactggccgtccgtcccgggcaggctcaggtcgagcagcaccaggttgcagcccgaggcaagcgcctcccgggcaacgtcggagaaccccttgcagccggtggcgtcgtgcccggcgttggcgagcagggtcaggagctcgcgcctgacgttggggtcgtcctcgaccacgaagattcttgccatccgccctcccctcgggaacgccgcccgcaaggcggcactggtcacccatggtagtacgtaaccgggcgccctcccggcgcgcccgtggtcgcgacgggctcccgtcgacgatccgccgctgccaccatctggcataactcgttaaaactttttatctctcacgtcccctagcacaaaactcgttttgggggagtctggttcttgtggagctttggcgttggccgaattgtcgataagtggggaataaggtgaaatgttgttctggatggcaatttgccacctgcggcgatgtcggttatcgacaaggtttcaacgctttcaaccagcaatcaacaatatcttgtgccgactcgtgggaaaaaacactacggattgtgtcatagtgaggcacgtcagatagggccgccctgcggtcgcgagctgggggaagaccccggaaggcggcagaggggcggcgtgggagaccagaacagcgggggatgcacgagatgaagatcatcaagcgcaacggctcggaggtccagttcgacctctccaagattaggaacgccatcaaggcggccaatgccgaggtgcccgaagacgatcgcctcaccgaccgcgaggtcgagtttgccactctcaacgtgcaggacctgtgcgccgacgccggccacaccgtcacggtggaggaggtccaggacatggtggaggaccagctcatggccctcgaccgcttcgtcgtggcacgccactacatcatctaccgctacgtgcagaaccagaagcgccgcaagaacaccaccgacgaccagatcctctcgctcatcgagtgcaacaacgaagaggtcaagcaggagaactccaacaagaaccccacggtcgtctccgtccagcgcgactacatggccggcgaggtgagcaaggaccttgccatgcgcacgctgcttcccgccgacgtggttgaggctcaccgcgagggcatcatccacttccatgacgcggactactacgcgcagcacatgcacaactgcgacctcatcaacctcgacgacatgctgcagaacggcacggtcatctcgggcacgctcatcgagaagccccacagcttcagcaccgcgtgcaacatcgccacgcagatcatcgcccaggtggcctcgtgccagtacggcgggcagtccatctcgctcacccacctggccaagttcgtggacgtgagccgcaagaagatccgccgccaggtctatgccgagatggaggccatcgacgcccatcccagcgccgacaagatcgaggccatggtggagaagcgcctgcgcgaggaggtcgcccgcggcgtccagaccatccagtaccaggtcgtcacgctcatgaccaccaacggccaggcccccttcatcaccgtgttcatgtacctcaacgaggcggagagcgagcaggagaagcacgacctcgccctctgcatcgaggagatgctcaagcagcgctaccagggcgtcaagaacgagaagggcgtctggatcaccccggcgttccccaagctcatctacgtgctcgagcccgacaacatcacgcctgacggcgagtacttctacctcaccaagcttgcggccaagtgcaccgccaagcgcatggtgcccgactacatctccgagaagaagatgaaggagtacaagctcagcaagggcgagaccgagggcaacggcgactgctacacctgcatgggctgccgcagcttcctcacgcccgaccgctcgggcaacgggtacgacaacgtggccaacgccaagaactacgaccccagcaagcccaagtactacggccgcttcaaccagggggtcgtcaccatcaacctcccggacgtggccctctcctcgggcggcgacatggacaagttctggcagatcttcgacgagcgcctggagctgtgccacaaggccctgcgctgccgtcacgaccgcctctgcggcacgctgtcggacgccgcgcccatcctgtggcagtacggtgccctcgcgcgcctcaagaagggcgagaccatcgacaagctgctctacggcggctactccaccattagcctgggctacgccggcctctacgagtgcgtcaagtacatgaccggccacagccacaccgatgccgaggccacgccgtttgccctcgccgtgatgcagcacatgaacgacaagtgctccgagtggaaggccgcggaggacatcgactactccatctacggcaccccgctggagtccaccacgtacaagttcgccaagtgcctgcagaagcgcttcggcatcgtgaagggcatcaccgaccacggctacatcaccaactcgtaccacgtcaacgtgcgcgagaagatcgacgccttcaccaagctcaagttcgagagccagttccagcgcctctcgcccggcggcgccatcagctacgtcgaggtccccaacatgcaggacaacctcgaggcggtcgtgcgcgtgatgcagttcatctacgacaacatcatgtacgccgagctcaacaccaagagcgactactgccaggtgtgcggctacgacggcgagatccgcatcgtggaggacgacggcaagctggtgtgggagtgccccaactgcggcaaccgcgaccagagcaagatgaacgtcgcccgtaggacctgcggctacattggcacccagttctggaaccagggtcgcacgcaggagatcaaggaccgcgtgctgcacctgtagaacgcgggggagaagcgacttcccagaggggcccggcgcgatggcgtcgggcccctctcgtgcgtgcggtcaacctcctggctggccaggcaagtggtgcaggggatgtgcacatgtggcatctcgcgggtcccaagatgtgtgggcagtgtgtctcccacgtgtgaaactcgtcccatttgcgtcaggtgattgcgatgcaagagcgttcgcccatgtccctctcctataatgccccccgctcagcgagcgaggtattgaatacgcacccaacccaatgggagaggaaatatgccactctggaacactccggtcgaggtcaaggctgcgttctttgatgcagacggaacgctcatctcgcccagcactaatcataggattcccgaatccacgcaggtcgccatctcggagctgcgcaaggagggcgtcaagtgcttcctggccacgggccgtcccccgtaccagtgcgacgagatccccatcgacaacttcgagggcttcatcctcttcaacggccagctcgtgctgacgcgcgacgagatcctgttcagcgagtgccttgaccgcgacgacgttgccacggtggtccagcaggtgcacgagggcaagtatcactgcctgttcatggaacgcggccgctgctacatcgacggtcacgacggcctggtacgctcggccgaggagttcgccggcctcacctacgaggagggcaacatcgaccaggcgctccacaacgacatctaccagctcaacgtcttcttggggccgggcgagacgggcgtgctcaccgaggccaccaacagcttcaaggtgaccaggtggagccccaactttgtggacgtgttcccgcgccacggcggcaaggcccgtgcggtccgtcgcgtgctcgacatctacggcatcttgcccgaggaggccatcgcgtttggcgatggcggcaacgacctggagatgtttggcaccgtgggcacatccatcgccatgggcaacggtaacccgggggtcaaggagcaggccgactacgtcacggacgacatcgcgcacgacggcatctacaacgcctgcttcaggctcggcctggtccgcgaggcgtagctaccgcccggcgtaccgctctcgcccccgtaacgggtccaagctgtcccgtcccgtgcggggtgtctaacgcaccgctcccgtccctccctccccgcgtctgcggggcgagaggggcggtctgccaacgcgggacattcggaccacgggagtgggtatctctcccccctgagggggcgcagaatcccatggcgtgcgccccggggaggggagtacccatgactggaagtgagttccacgagctcgtgcgctcgtccaggaccatccgacgctttgacgaggggagccgggtcacgcgcgagcaactgctcgggctggttgacacggcgcgctttgcccccacgggaaacaacacgcagctgctgcggttccacgtggtcgatgaccccgcgacggtcgagcactgcgcggcaagccacggttgggcggccctcttcaaggactgggacggtccccagccaggggagaggcccacgggctacattgccgtgtgcgcccccgttggcgccacgggcagcgcgatccgcaacctggacgccggcatcgcggcgcagacgatcatgctcgcggcgcggagcgaaggcctgggcgggtgcatcgtcaagagcttcaagccaagcctggcggatgacctcggcatctcccagcaggggtacgagatcctggtgctgctcgccatcggcgtcccggcggagcgcgtggtgctggaggaggtcgatcccgaccacggcacgcactactggcgagacgagaagggcacccaccacgtccccaagctgccgctggaggacctgctgatatagccggatggacgctcccgaggtccttgcggcgggcgagcgatcgtctgtcgccccgtttgcatgcgtggggttggcgtgactttacgaaagcgtaaggcaccgtaatgcaaatcgatggtacccgccggcgcgtttggggcagaatcgattgtgcgggagcgcgaggatccgttggggatggcgccccgccgcgcggggcatcgggctccgcgccagagtcgtggatgtgtgggaacggagttcgtcgtgggagttcttctcgcccttgtccttgccatcgtgattgtgcccgttggcatcgcggcgcttgtcgtgagggtctcgctcagggtgatcggttgggtgcttggggcatgcctgtccctcgtgctggtcctctttgccctggcgcaatgcgtcgccctggtgtagccgttcccggcagtgttccctcatcccggctgccctcgctcccatggggggcgcatgctgacgacacccgccgttcgcggtactgacatcccccaaggctgacatctgactgaaaatggagccatgtcgtatgccattgagagggtgatgtcccatgggaaccagtctcgagagcgggcgggctcgccaccccaggcgcagggtcgctgccgtggttgccatcgtctgtctcgtcgccctcgtggcgggtgccgtctaccttcaccagcgggatcactacgtcccctcgggcgaggcgcgcatcgtcctagtgggggaggagcacggcaagaagtcccagtacgacgaggagctgcgcgtgtggaagtcgcactactcgtcggggagccgagacctcttcgtggagcttccctattacaccgcccagtacctcaacctgtggatgtccgcgaacgacgacgcgattctcgaccagctctggagggactgggacggcaccgcggcccagaacgccgactacttcgagctgctgcgctccatcaaacgcgagtgcccccagacagtctttcatgggaccgacgtgggtcaccagtaccagaccacgggggagcgctacctcgcctatgcgagcaagaggtatggtgcggactcggaggaggtggccctcgcgcgggagtgcgtgaaccagggcatccactactacgagcagaccgactgcgacgacgactaccgcgagggccagatggtcgccaacttcgagcgggcctacgacgacctgggcaccaagtccgtggtcgtggggttctatggggcggcgcactccgacccgcgcggcaagagcttcaacggtcacgtggacagcatggcaaaccagctgcgccagcactatggggacgtcgtgtcgtaccagtatgcgggggcgatcgtgtagcgctgctgggggctccgtgctgtcgtctacttgcggctcattcgaggtcaaagaagggaaggggcatgcctcggacggaggctacccgagggcgatgtcccagtcacggggcctccggcgcaacctccctcccggcacggaccccgcggccatggcgggggcgcctcgtaaggattggcgcgtttatctcccgctaaacgcgccttttcttattgggttggcggttccgtaagaattgacgcggttacgcgcaccctaaacgcgtcaattcttacggggagaccttgcggagtgggtcgggggcgggatgtggacggggaggaccgtatcccgcggctttgcctctcgggagctgacttgcaggcacggggtgctgccgttagggaagacctctcctcgcgaccgacggtgcccctgccagcgcgcccttctatgatcctttcctcagccgtccacctgcggggggcttggtgctgaagtgttggcttcggccgagggatcctggtgtcaaagaagggaaggggcatgcctcaggcggggggctacccgagggtggtgcccatccctggcccaagctgctctccgctcttgtgatgacatcaagggtagaactatggcagggaaggcccgatgtgagtgctctcgtcgtgagcctcctatcacagacgttgccgtgccatgcgttttcccggctggtaaggagccgaactctcaacgttggcaacgcgctcccgaaatgagcactcacatcgggagtgcgttgccattttgacctgacacagaggttgggtggcagccgtctcccgatatgagcgcacatatcgggctcccgccgccacccgctagggtcgggagccttagacaacgcttcccacctgtggaaacgcatgaagggaccggctttccggtggagacccacaagcgaaggcgctcacgtcgggagcttgccgacatggcaagaaagctgatgccaatctgttccatgtgcgactggtgagactgtcaggggagacctctcctcacggctaccagtgcctctgcgagcccgccccttccacgagttcttccttgggcgtccacctgcaggggagcttggcgttgaagtgttggcctcgaccgaggggtcctggtggcaaaggaagggtgagctggcggatttcctccgttccccatccgccggcagcggaggtctccgtgcgagtcagcagagcggccccggttgggagcgggccgggggctccgtaccgtcgcctactggcggccaaccgaagtcagggcggggggggcgcctcgtaaggattgacgtgtttgtctcccgctaagcgcgccttttcttattgggttggcggttccgtaagaattgacgcggttacgcgcaccctaaacgcgtcaatctttacgggatgaccctaggggcatgttgggggcacggggcgtggaagagagggccatgtcccccgtccggcctctcaaaagcgaatcctgcgggcccgtggcgtcgcagacaggggagaggcccgcagcaccgtgcccgcgagcctctcccctggcaatgcctatccctgctgcagcgactccagccccagcagcgccgccccgatggcgccgcacagctgggagtcctcgtgcgtggcgaccggcgcgcccagcacgtcggtcagcgcctgcaccacaccggcgttgttggcgactccgccggtcatgaggtagggggcctccccgttcacgcggcgcgccagggtcgcggtcttgcgggccacgctctcgcaaagcccgtggatgatgtcgggcgtgggggtgtcctccgccacgagcgacaccacctcgctctcggcgaacaccgtgcacatgctcgagatcttgacctcgtgcttccactccagcccggtgcggcagaagtcctccagcgacatctccagcgtccgcgccatcatctccatgaagcggccggtgcccgccgcgcacttgtcgttcatcacgaagttgaggacgttgcccctctcgtccaggtggatgaccttggagtcctgcccgccgatgtcgatgatcgtgcgcgcctcgggcatgaggaagtgcgcccccttggcgtggcaggtgatttcggtgatcgcggtgtccatgtccgggatgttgtcgcgcccatagccggtcgagaccttgagagccatgtcctcctcgcgcagcccggccctctccagcacctccgccttggctcggcgtgcgctctcggtcgcctttgcgccggtggggagaatgaccgtggcgacgaggttgcccctctcgtccatgatcgcggcgtccgtggaggtggagcccgagtccacgcccatcacgtagccgcggccgcgggcctccctgccgccggcggcctcgcgcgcgacgtcggcgccatggagcgtctcgccaaatgcctcgagcctggtgcgaagctgccccaggctctgcgaggtgccgtccgtctcgatcttgaccatgggaaggtcctcctccttcgtcgccagggcgtactcaaatccgtagtagtcgcagaacttcatggtgtggtagatcacgccgcgctgccccttgccgccatgcagcttggctcgctggctcacgtcgtccatgcgcatgcagggcatctgattgagaagcgctccggcgtaccagtccaggaacgtgtccagggtgccgcccgcccggccgacgcccgtgtccgcgtcgtcgcaggcggagcagttgccctccgacgcggcgcgcgcaagctccggtgggggagtcacgagcaggtgccgctcggtgcacgtgccgttctccaccgggtagcccacgccctcgcccacgttgtccaggagcgcccgcgtggcatgcgcccccagcagggtcacgtggtcgcccacgctgcgcacgggcggcttaaaggcggccagcgccgcgcccacgtcaaagctcctgccgctgtacgccgcgtagcgcccggcaaggtcggcgagacgtgcgcggaacagcctccgctccgcctcgccccgcttgtggggcaggtccagcaggtagatgaagtcgaagtcgccctgctcgcacagaacgtcgtatgcgcgcttgatcacgtcgcagcaggtcacgagcaccacctcgcgcacgtcgtcgcgcagcaggcgctctatcaggcccttgccgtagccgcacaggttggggtgcgccagccggtcggcctcgtcaaacgacgagacgtccgcctcggccagctccgacctcgccccaaagcccgccagcagctccacgggcgtgtacttgcaggcgtagtagaccacgtgcccgccgtcctggcgcgcctcggcccggttgcccgcgcccctctccacactcacgctattgggagtcatgcaccctccccttcctctcttgcagcagctccaggaacgccgagaaccgcgtggacatctggccctccatgcagttggcccggtccaccgcgtcgccgtccagcaccagggtggggaagcccgcgccctccagccgtcctcggatgagctgcgcggcccccgaggtctccttgcacccccagtggcagaacaccacggcgccgtccgcgcccgtgcgctccgcgagcctcacgagcgcctgcgcccttctggtcgcgggcccgttgaagcagtttctcacgacccgctcggccatggcctcaaaggggtgcgtctcgtcaaacatgcgcccctccggcggggtcaggcagtcgaacatcatgtcccccgccacgacctgggcggtctggctgcagtccacgatcgagcctatggatcccaggaagtagggagagacgtgcgcccacaccagattggcaccgccatacgctggctgtcgggcaaagtcgtcccccatgccgcgcgccaggccaagggcctcctcggtccccagcagcaggtggaggtcgagcatctccatcatgtccagggtcatggtgtttgccaggtagcgcgcccccctgtgggggagggtcgcctcgagcgcgtcctgcgtggcgagcgagcgcgcgaccatctggcgcagcagcgactcgtccagcctcctgccaaagaggtcctctgcctggtgcgtcacgtccctcagctggtccgccacgtaggcgatgccgtcgcgcgtgacgtcgtagggaacgtccacgtaggcgctctgagccccccacctgcgggcgagcgacttgaagctgaggttgttggcatcgcacgccacggaggtgctcgcgaggagcctgcgtgggcgcagcacgcccgactctgccatgcccatcagggcgcgatggtacgagcagtacgtctcggggatgcccgagccctcggcgcaccccaggaatgcgccctcggcctgcgcgccgctcacgaacgacgcgaccgcctccgacgtcatcggcttcaggccgagcgcgcggagcgactcggtgggcatgaagacgctcgtgagcaccgagttgtcggggtcagccatggcgtcgaccatggagcgcatgaacagggcgtagccgcgctgccctgaggggaggaacctgccgtcgggcacgagctgggacttgcgcgccatcaggcggaaccccgtcatgagccagtggcgcaccgcatccgggtgcgagtccagcccgcgcgcggcgacgtcgccgtaccagcctatgaccgagtcgcccagcgagcggcccgccatcacgctgcctcccggcgggcgcgcagcatctcgaggaacgccgagaagcgcgtggacatctggccctccatgcagttgccgcggtcgcacccgtcgccgtccagcaccagggtggggaacccctgcgcctcgagctgccggcgcatgagctgcgccgcgccggcggtctccttgcagccccagtggacgaagaccacggcgccgtccgcgcccgtctgtctcgccagcgagcagagccggtccgcgcgcctggtggcgggtccgttgaagcagtcgtccagcaggcgctcggccatggcctcgaaggggtggtcggcgtcgtagcggggctcgtttggcccaacctggtcgtagagcatgtcggtagcgatgatctgcgcgtccctgctctggctggtgggctcggcgatggagcggaggaagaatggggggatgtgcccccacacgatcgagacgccgtcgtagtcctgtgcgctcgcgaggtcgcgctccatgtggcgcgccatgcgcagggtgtcgtcggtccccagccacaggtgggtcgccagggcgagctgcatctcgttgcccatgtcgctgcgcatgaagtggccgcggcgcagggggagggaccgacgcagcgaggcgagcgtctcctggctgttggccacatggcggcgccgctccgcctcgtccaggtcggtgccgtaggcgcgctcggcggcgtgcgccagggagcggagctggtccgccacgtaggcaaccgccgccgcgtcgtccgccgtggcgtagggtacgtccacgtacacgtgcggggtcccccacacgtgcgagagcgccttgaagctgaggttgttggcgtcgcaggggaccgagcagctggccaggagccgcggcgcggggagcacccccgacgtcgccaggcccatgagcaccttgtggaacgagcagtaggtctcgggaacccccatgccctcggcctcgcccacaaagcccgtctcggcatgcgcggcggtcacgaagccgctcagcgcctcggcggtcacggggtggacccccatcgagaggaacatctcgctgggcaggaagatgctcgtgaccacgctcgagccaaagtcgttgagggcgtcggtcacgctcctgagggcgatgctggcggcatcgcgggagaagggatggaccttgagctcggggaggagcgtcaccttggcgcgctccacgttgaaggcgacgctgagcgcctggcgtaccccctcgggcgcgtcgtcgatgtgctgtgctatgaggtcgccgtacccgtcgaggatgcggccacccaggctctgctccgccatcagtccctctcgccctcgtcctgcagggtcacgacctcaaagtccacggcggacgagtcgatcgcctcgcgcgggccaaagaccacgacgtcgcggttgcccgccagaccctcgagctgcggcgcaaggtcgcgcagcgagtccgcggacacgcccaggatctgctccctcacccggtcgcgccagccctcgggcctgagcgagatcaggtcgccgtcctgctgacgcgcgagcgcccggggcttcacgggcgagtcgtgggcggccacgcacgacaccacgtagccctccagctcgtcctcgccgccgtcccacgagcgcagccaggagccggctccctcgaagcggccgagggtggggtcgatggcggggtcgcggtacgaccagaacgccggcagcccgttgagggcgtgccggaagcccacgccgtaggccccgcccttcacgcggacctcgttccacaggtagtcaaacgagagcgcacgtgacgccacctgccaggctcccacctctgcctcgttgcgcacgcccgacatgccctcggcgcagaagcacacgtcggaggggatcacgaacgcctcgttgcgggccacgggctcggggaccagcagcctctgggccgcctgctcgcccgccggcgagagccccaggctgccgcctgccgcccagaagcgctccatgtcgtcgcgcgagcaggtcaggctcaccagcacgtcgtcgctcgtgaagatggtgcgcgccagttcggcgagcctccgcgagacgtcccccttgcgctcgtcccagtcggcgatgagctccttcacaaagaggtagtagcccacgcctgcgcccagcgagtccgagaccagcgcggcgctcgagtggtgggacgcaaggcgcgccgcggccgccgcgtggccggacgactgaaagtactgctccagctcgatgcggcgctgctgcagcatggcgagcatgcggtcggtgtcggcgaacgacgtggtgccccagacctccgcgggcagggtcgccagcgcgtccacgttctcgctgagggagcttgcgccgaccacgagcttgggaacgacggagccaaggtcgtcgtgctcgctgtaggtctcgcagaagaagctcaggttgcccaggctcctctcgaccagcgtgtccagctcggacgcggtgtggtcgctcgtgtccagcttgcccaggaagtcggtcaaaagcgccacgtagggcaggtccccaaagccgacgcgcctgaggtcaaagtagtggtaggcgtacacgatgcggtgcgtgggcaggtcgtggaacacgcaggggagaggggcgtcaaccctggtcgcgggcgtcaccgccggggcgtcctcgatgtccgacaggtgcaggcgggggagcgtcgcgagggcctcgggggagtcgggcgcctcctgctcggatcgcagtgccgcgacctcgtcccggatgccctggacctgctccgggcccatctcttcgcgcagctgcgccagctcgcgggcctcgtcgctcgccgcgccgtccgcgagcggcaccagctccacctcggcgctgtgggacgaaccgcacaccagggagccaaggagacgctcgaagtagccgttgtccaggccctgccgcatggatgcgatggcgtcctcgtagcgcaggtagtccacgggcctgctgtcgtcgtagagccagctcgagagggcgaccatcgagatcgcgacgccgtcagcgtacgagccccagtcgccctcgcgcaggttgaactccgcctgggcaagggacgcctcaagccggtcgcggccgatgccgtcgcgcgcgaggtccgcgcacgtgccctccagcagctctcggaagcggtccgccacgtcgggcttggacccgcgcagctgaaaggccacgagcggctgctgcgtgccgtccagcaggatcgcgtcaaagtcgtccgccaggccggagtccagcatggcgcgcttgaggggcgcctcgttggagccggcgatcgcgtcgagcaggacgctcgtggcaagcacgcgctcgcggtcggcgtaggtgccgatcacgtagcccgcggcgacggacgcgttctggggcgtcgtcgccatggtcacgtgcgagaggccagcgcgcacggcgggctggagcggcagcgggttggggtcgccggcgtcgcggcgggtggcgccacggaacctctcgtccacaaacgccagctcgcggtcaacatccaggtcgccgtagaggatggtgtagctgttggagaggtcgtagtggcgcgcgtgggtgcgcaggaactcctcgtaggtgagcgtggggatggcacgggggtcgccgcccgactcgtagcggtacggcgtctgggggaacagcgcacggtacagcgtgtggaacaggacgtcgtcggggtcgctcatggcgcccttcatctcgttgaggaccacgccgttgtagctcaggctgccgtcgtcggcaacctcaaggtgccagccctcctgctcgaagatgcgcttgcggtcgtagatggcggggtgcagcaccgcgtcaaggtacacgtccatcaggttctcgaggtcggccacgttggtcgacgccacggggtacatggtcttgtccgggaacgtgagcgcgttgaggaacgtctgcatcgacgtcttgagcaggttgacgaagggctccttcacgggaaagcggtcgctgccgcacagcacggagtgctccaggatgtggaacacgcccgtgtcgtccgcgggcggcgtcttgaacgcgatcgcgaacgacttgttgttgtccgggacggcgatccacatggcgcgtgcccccgtcgcggcatgggagaacacgtaggcggtgccgccaagctcggggacgggctcgacggcggtgacggtgaacccggcgtgcgtggacccgacgcccaggcgcgggtcgggctttgcgaacggcgcgtccgcgccgatgctggtatcggtcatgtcaaatctccttctggcgccatgccacggggccggcacctgcggttaacgggcactaatttacccctcgacgacgctgcggataacccgttggatgttacagtcctatgtgcttgctcaaaacgtcgcaaagggggcaccaagtgggggagagggacgtcgtcgccctcgagagggttgacagggacgacggggactccgtttccgggggagagacgcgtggacagcaggctcgcaaaccctccctcatgaggggggtcatcctcaccctcgcgggcgggacgctctggggcctcaacggcacgctctccaaggtgctcatgggcacctacggcgtggacccgctctggcttgcctgtgcgcgcgagctcaccgcctgctggctgttcctcgccgtggcggccacgcaaagccccacaaggctcaagggctgcctgagcagcggccgggcgctgctcggcgtggcgtccgtgggcatctgctcgatcctgctgtcgcaggtcgcctacctcgaggccatcgactggaccaactccgccacggcaacggtgctccagagcctctcggtggtcatcgtgatgctcttcgtgtgcctggtgaacaggcgcctcccgcgcaggcgcgagctcgtgggggtggcgctggcgttcgccggcacgtacctggtggcgaccggtggcgacctgggggcgctcaggctcccgcccatggggctcgcctggggcctcatctgcgccatcgcggcgaccatcctggccatccagcccatcagactcatcgagcgctggggaaacttcaccgtcaacggcctggcgttcctgatgtcgggcatcgtgctctcggtcttcgtccgtccctgggcgcacatgccggcgctcgacgccatgggctggacgctcgtggtgctctccatcgtgttcgggacctttggggcctacgccctgtacctgcagggtgtcaaggaggtcgggtccatgcgcggtgccatgctggggaccagcgagcccgtcatggcaacggtcagctcggtcgtcctgctcggggcggtgttctctcccggtgacctcctgggcttcgcgatgatcatcgcgatggtgttcctcacggcgtagcggcggcgggtcgtcccgctgcgtagccgcacacaagggggcggcgcggaccaggagtcatcgcccggtccgcgccgcccgtcacgtcttgcgggggtcgcctgtctccgctaccgcttgaccaccagcacgtcgcacttggcgttgcgggtgaggtacgtcgagatggagcccagcagcgcgtacttgatggacgagaggccgcgcgcgccacagatcacgaggtcgggctcgatggcgtcgagcatctcctccttcagggtctcgcggatgcgcccggccttaacgatgacctcgatcttcttgatctggttgttctcctcctgcgccttcttgaccttgtcggcgatcgaggcgcggaagctcttctccaggtcgttgatcaactcgaaggggtaggtccccgccgtctcgagcgcggtcgagtcgataacgtggccaatgtagagctctgcgttgttgtttgccgccacgatgatggctcggtcgagcaccttgtcctgctgctcgctgccatccagggagacgaacaccttgtcatacccaaggtcctgatacaccgtcatgtcaaacacctccggaattgtgtggtagcgccatccgttgcctgcaatctacccgtttgaaacccgccgacgggggaggcatccgcaaacggccctcacggtcgcctcgtggtctgtgggaggggaccgtgcccgcgacagtgccgccaacccgcggacttcatggtttctcgccctgccgcccccgggcgtaggggtggcgcatcactattggtaggctgcctatctgaggaggagatccttgaatctgatcgaattgctcaaggccgcgctgtacggcgtggtagagggaatcaccgagtggcttcccatttcgtcgacggggcacatgctcctgctcgaccagttcgtcaagctggacgtgtccaaggacttctgggacatgttcctcgtggtgattcagctgggcgccatccttgccgtgtgcgtgctcttcttccaccagctcaaccccttctcgcggtccaaaaccgcagatgagcgcaagtccacctggggactctgggcaaagattatcgtggcgtgcctgcccgcggcggttatcggcatcccgttggacgactggatggaagagcacctgggcagcccgttcgtgatcgccgctgccctcatcgtctacggcgtcatcttcatcgtcatcgagaacgtgcgcgagcacagggcgctcgagatcgccgagtcgggtacgcgacccacaggccccaagcacctctcccgtccgagcgtcgaggacgacgcgagtcttgcctccctcgccgacgccgaggcacccgtgcaggacgtcgactccatcggctggggtaccgcgatcggcatcggcctgttccaggttctgagcatggtccccggcacgtcccgctctggctccaccatcatcggcggcctgctcctggggtgctcccgcaccgccgccgcggagttcacgttctacctggccgtccccgtcatggtcggtgccagtggcctgcgcctggtcaagtacttcatcaagggcaacgtcttcagcgccaacgagacggcgatcctgctcacgggctgcatcgtggccttcgtggtctcgctgctggccatccgcttcctcatgggctttgtgaagaggcacgacttcaagcccttcggctggtaccgcatcgtcctgggcgtcgcggtcatcgcgtacttcgccctcgcggcgtagggcgactcgggcaacgtcttgacgcccgccggtgggttccctcccgccgacgggcgcctctcgtctctgtcgcatcgacaaaagggagtgctgatatgaccaggatcctctacgtgtgtcacggcaacatctgccgctcgaccatggcgcagttcgtgatggacgagctcgcccggcgcgcgggcatgtcgggcgaggtgtcgtgcgacagcgccgccaccagcacggaggagctgggcaacgacgtccaccccggcacgcgggagcagctccggtgggcggggattccgtgcgggcaccaccgctcgcgccagatggggccgcgggactaccgcgacttcgacctgatcgtggggatggacgcggacaacatggacggcatcacgcgcctcctcctgggcgagacgggcccgggctggtcgtggcggcccaccacgggggagcagcgccgtcgcgcggaccccaagggcaaggtgtcgaggctgctcgactgggcaggcctcgaccgagacgtcgccgacccctggtacacgggcgacttcgtggcgacctaccacgacgtgcttgccggctgccaggcgatgctggatgcgatcaaggagggccgcacctctcccctggaatagcgtgccgtagggcgcgcgacggtgccgatggtgtgtcccggggtcccaaacgctaccatgggggagcatggtacctcgaggattggtggagacatgccgggcaagcgttctaacgtcatctcgtgggacgagttcttcatgcgcgtcgcgatcgcggccgcgctgcgcagcaaggaccccaagacgcaggtcggcgcctgcatcgcggacaccaacaaccgcatcctctccgtgggctacaacggcaccccctcgggcatcaacgacgacgagttcccctggggcacgtcggacgacccgctcttcgacaagcacaactacgtgattcacgccgaggcaaacgcgatcctcaactatcgcggctcgctcaaggacatgcagggcgggcgcgtgtacgtcacgctcttcccctgccaggagtgcgccaagatgctggtccaggcggggataggcgaggtcgtgtacctggacgacaagtacgaggggaccaccggcaacctggtagcgcgctcggtgttcgaccgctgtggcgtgggctaccggcagatccaccttcgcgagcaggcactcgagtagggatggagctcctctctcccgcaggcggtcccgagcagctggcgctcgccatccactttggcgccgacagcgtgtacctggcgggcaggcgctggggcatgcggtcgcgggccgccaacttcgacgacgaggaccttgcccgggcggtcgcctatgcccatcgacatcgcgtgcgcgtgcacgtgacggtcaacaccgtgatgcgcgaccgcgacgtggacgagctgcccgcgttcctcagcctcctcgacgacatcggggtcgacgcggtcatcgccgcagaccttgccgcaatctcgcttgcgcgggagtttgcgccccacgtcgccatccacgtctcaacgcaggcgagcgtcatgagcgcccgcgccgccgaggagtacgcgcggctgggcgccaccagggtggtcctggggcgagagatgaccctctcccaaatcgccgagctgcgccgtcgggtcacggacgagctggagctcgagtgcttcgcgcacggctcgatgtgcatggcatactcgggccgctgcctgctctccgcgcacctcatgggccccgggcggtccgcgtcggacggttcctgcgcccagccctgccgctgggcgtggaggctgggggaggagagggacccgtccatctcggccacgctggaacgcgacggcgaggcgagctacctcctctcgtccaacgacctctgcatgatcgatcacctgggcgagctgcgccaggcgggcgtggactgcatcaagctggagggccggaacaagggtgcgtactatgccgcggcggtcaccaacgcgtaccggcacgtcctcgacggcgacccggtgcaaccatggcgagacgagctcgacctcgtgagccaccgaccctactccaccggcttctacctgggcgagcccacgcagaaccccggacggtgggactacgcgcgcgaccgccggctcgtcgcggtcgtggaggggtgcgagaggtgcgagggaggttggctggcgaccgtccggtgccggaaccgtgcggaggcgggcgtggaggttgacgtgctgtctccgggcgcgcccgtccgctcggccacgcttggggaggccctcgttaccaacggacaggcctacgacgtgccgctcccgttctcggtggagccccttgatctgctctgcgtgcgagaggaccgtggcgactgagccgacggttccctgggaaccgtcggccgaaggaccggattccgctggctgtcagcgctgcgggaattcgggtggaggaagagcgcgaagaagggtgcggtcggcccatcccgtgtcgccgggaaagaactcacttttgatggatgactatcaggattcaaaccgtggcgacaaactcccgacgtgagtgcacatatcgggttcccgctgccaggatagtccgtttcccgggtatcaccccagttgaatatcaatcagaaattgagccatggcagcaagctcccgatgtgagcgctcattccgggcatccattgccatttgaccccaaaggagggatgggttggcaacaaactcccgacgtgagtgcacatatcgggaatctgctgccaaccgctggcctctgggatttcgtgtgacccaactacctgcataaactcggtattggcctgaatgacgggaagagatgatgccggcaatggcgctcatatcgggcttctgccgccatggtacgaaccttgatgcatggtacgtgtggctttggaggtcccggggaaggcggcactcgttgaacgcacgttcacgctatcgggcgctcgtgcctgaaatcgtgttccgtgtgtacacgcgggatggactttctgacaacgtggggttgctgacgcccctccaacgggggggatgcgccggggtgacgcctccatgtcagaaacctcatggcgcgtgtacacgcgggacggactttctggtacgacggagacgtccttccccttctttgactacgagggcgtctaggtgccgttagcaagggaacccttgagtttacctgcgtgcgggtcaccgttgagctcaagcacgtaaggtaccgggcccacggtgccctggatacgccggaagcgcccggtgctacttggcgggggacacgtacccactgtccacggtgatctggcaccgggcctcgggaacgcgctccctcacggcggcacacacgcgctcgcgcagctcgtcgtcgctcatgccaaggtcgtccggcctcaccacgtccagggtcaccaggtggtcgtcgctgtccttgccgtgctctgtgtccacgtcgtgcacggagagacgcgggtctatctgccgtacgcgcacattgagccagttcatgaggtcgcgtccgcccgcgcccatctccacagggtcgcagtgcagcacgatgcgcaggttgtcctgctccagcaggtcgcgctcgatctggtcgagcacacgatggctctcgcgcaccgtggtgtcggcgttcatctgcacgtgcgcgctcgcaaactgtcggccagggccgtagtcgtggattaggaggtcgtgcgtccccagcacgccggggtagctcaggatcttgtcgtggaccctctgcaccagctgctcgttgggggtgtcgcccaggagggggttcacggtgtcgcccagcaggccaaagccactccacacgatgaaggcggcgaccgccaggcccatccagccgtccaggtccaggggcgtggtggcagagacgatcgcggcaaccaggaccgcggagctggttatcacgtcgttgcgcgagtccaccgccgtggcctccagcgtcacgctgtcgatgcggcgcgcgagcgtgtggttgaagtgcgccatccacagcttcaccccgatggagaggagcagcgccaggacggtcgccacgccaaactctgccgggctggggctcatgatgcgctctatgctggagcgtcccagctccacgcctaccaggatgatcatgaccgagacgagcatgcccgccaggtactcgtagcgcccgtggccgtaggggtgaccctggtcggcgggtcggctcgcgagcttgaagccgacgaggcttacgatgttgctagaggcatcggagaggttgttcacggcatccgccacgatcgagaccgatcccgagagcacgcccacaaggcccttggcggcacagagtaccaagttgagcacgatgcaggtcacgctcgagagaagcccgtagcttgcgcgcacgcgggggttgcccacgtcgtcggaatccctcacgaacgtcctcaccagccaggagaccatggtcttctctccttccccgagcccagacgacgagtgtagcgctttccaacgcccatgggagccgcgcgccccgagtgatgctactcccgctccctgacgcgcagatggacgctgtcgccgggtttcttcccaagcttctcgcgaatcgacttgagcatcccgatgatgtagcagacgcttccgtcctcgttcctcacgcccatgttcacgatgctgccgtcgtagggcacgccgtcgaactccacgtgcaccttcactcgtccgcggccgaactcgtcgcggatgttccagggaaacgggacataggccccgcccctgcccggtacgccccggatgaccgcgtcgtactcgtaggtgcgctcgttcacgactgcctcccagccccgttagctgccccaagattccaccatcataggggaggggtgcccgtgctccgcccatcgcactccgctcatcgtctggagtcctcgcgggaggggcgccttcgtccgcggtcacggctagactcttcacggacaaaccaagacagaggagacgcatgcccagcacattccagaccacgctctttccgtcgcccgtgccgtccgacagcagcgcggacaacctcgcgccggcgccccacgtcgacctgagcggcctcaaccccgcccagcgcaaggcggcggagtgcacgcacgggcccctcctggtgctcgcgggtgcgggttcgggaaagacgcgcgtgctgacctaccgaatcgcccacatgatccaggacgagggggtcctcccctggcaggtcctggcaatcaccttcaccaacaaggcggcggcagagatgcgcgagcgcctgggcaagctgcttcccggtggtaccaggggcatgtgggtctgtaccttccacgccatgtgcgtgcgcatgctgcgggaggacgccgacctgctgggttacacctccaacttcacgatctacgacgacgacgactcaaagcgcctggtcaagtccatcatggcggacctcgacatcgaccccaagaccagcccggtccagaccatccgtgcgctcatcagcaaagccaagaacgccatggtgtacccggaccagatgctcgaccaggcaaagtcgcccgccgagcgtgccgcggcgcgcgtgtacgacgtcctccagaggaggctcgcccgcgccaacgccatggacttcgacgacctgctggtcaagacctacgagctcctctccaagaacccccaggtgctggacaactaccaggatcgctttcgccagatcagcgtggacgagtaccaggacaccaacggcgtgcagtacgccctcaccaacctgctcgcgcacaagtaccagaacctcatggtcgtgggcgacgacgaccagtccatctacagctggcgaggcgccgacatcaccaacatcctgagctttcgcaaggactatcccggcgccacggtggtcaagctcgagcagaattaccgctcgaccgggcacatcctcaacgccgcgaacgccgtcgtgcgccacaactcgcggcgcgaggagaagcgcctgttcaccgaccgtggcgacggggagaagatcgaggtgttccaggcctcggacgagcgcgacgaggggcgctggatcggctccgagatcgagaagctgcacgatgctggcaccagctacgacgacgtcgccgtgttctatcgcaccaacgcccagtcgcgcattctcgaggacatgttcctgcgcgccggcgtcccgtacaagatcgtgggcggcacgcgcttcttcgaccgtgccgagattcgcgacgtgatggcgtacctcaagctcgtggtcaaccccaacgacgacgtgagcgcactccgcgttgtcaacaccccgcgtcgcggcatcggcagcacgtccatcggcaagatccaggcgtacgccgcgagccacggcctctcgttcttctccgccgccgaggcgtgcgtggcggaggatgggctcctctcgcccaaggcacgcacctcgctcgcgtcgttcaccaacaccatcgagaccgcacgccactgcgacggagagctcgaccaggtggtccagatgatcgtggagcacgccggcctgatcaaggcgtacgaggcggagcagagcgttgaggcggacggtaggatcgagaacatcaaggaattctttggcgtggcccaggagttcgacgagagccacgacgacgcggtcgagacgctcgagagcctccagcagctgagggccgccggggccctcgacgcctccggggagacgccagcagacgaccagactgccgtgacggtcccggcgggtgacgccctcccgcccaccgcgtccgccaagctccccgcgttcatggagtggctcgccctcaggagcgacctcgactccctggcggggcagtcgagcgccatcaccatgatgaccgtgcactccgccaagggcctggagttccccgtggtcttcgtcgccggcatggaggagggcatcttcccccaccgcggccacgaggacgacccctcggggatagaggaggagaggcgcctggcctacgtcgccatcacccgcgccgagcgcaggctctacctcacctatgccaccacgcgccacatgttcggcagcgtctcgagcaaccccaggagccgcttcctcaacgagattcccgcggaggacgtccacgccatcggggtgggcagctccggcttcagcggcgtgggctgggagaagcgcggcgaccgccatggcacgtacggctccggtcgtggcagtcaggtatacggcgggcacgtgtttggctcccgcacgcgctccacgggagggtcgccctccgcgcgtcccaccgctccagcccccatcaagcgcgaccgcgccaaggttgccgagaccttcgcccccggcgaccgcgtctctcacaagacctttggcccgggcgtggtgcgggctgcctcgggcgacacgatcgaggtgttcttcacgcgcaccggcaagaccaagaagctcatgaagggctttgcccccatcgtcaaggtcgagggctagcccatggaggcacagtcggtcgacgaggtggtggacgtcgcgggagagctcctgggcagggggatcttcctcgccgttgtcatcgtcgtcgcctacctggtgcagcgcgtcctcgtccgtatgctccgtcgcgcgttcaagagcgccgacctccccaacgtctcgctctgggtcaacctgctgaaggtcctcatctgggtgttcgccctgctcgtggtgctcgagcccgtgtttgggatcaagcccaccgccgtggtcgccgccctgggtgtgacctctgttgccgtctcccttggcatgcaggagaccatctccaacgtggttgccggcttcgcgctcacggccaatcacgtcatccgacagggcgacgtgatcagcgtgggagacgtcacgggcacgatcacctcgctcaccctccgtcagacggtcatccacacctttggcggcgacgacgtggtcattcccaactcggtgctcaactccacgtcgctcacgcgcctctccgacgccagtgcctgcctcacggtggtgcccatcatggtcaagcccaacgccgaccaggcggtcgtggtggcggacatccgccgcaaggtgggagaggcgctttccgactcgctccgtcccgacctcggctgccaggcgttctacgcccaggtcgacggcctgggggtgcgcgtcaacatccgcctgttcctgcagtcgggcgtgttcccctcggtcgccgcggacaaggcgcttcgcgccatcgcgggctccccctggctcgttggggtcccgggggacgcgaccgacggggacgaaggccgcaggtgaacgcgccggcggacgctatcatggttcggtcaaaccctacgagaggagcctccaagtggagaagatagcaagcttcacggtcgaccacctgcgtcttgagcccggcgtctacgtctcgcgcgtggactcctggcagggcgtggacgtcacgacctttgacctgcgcctcacggcacccaaccgcgagccggtcatggacaccgccgcggtccacgccatcgagcacctgggcgccaccttcctgcgcaacgaccccgcgtgggcctcccgcaccgtgtactttggccccatgggatgccgcacgggcttctacctggtcctctttggcaagctcgagcccaaggacgtcatccccctggttcgctcgctgttctcctttgccgccgggtttgagggagaggtgcccggcgcccggcccgaggactgcggcaactggcatgacagcgacctgcccatggcgcgctggtgggccacgcgctacctgcgcaacacgctggacggcattgacgaggcccacaccacctaccccacgcgtgggggagaggagtagggtccgtctcgcccaagggggcaccaacggcacaaacggcatcacggctgatgggagacacgtgaagatcggaatcatcggggcaatggaggtcgaggtcaggcacctcgtgagccatgtggagggcgaccgcgtcaccacgatggcgggcatggagttccacgagggggccctcctgggcaaggacgtggccgtggttcgctgcggcgtgggcaaggtcaacgccgccgtatgcgccaccatactgtgcgacaccttcaacgtcacccatgtcatcaacaccggcgtggcggggtcgctcgacgcctcgctcgacatcggcgacatcctcgtctcgaccgacgccgtgcaccacgacatggacgtgaccaaccttggctacgcctacggcgaggtgccgggcatgggcgtcatagcgttcccggccgaccccacgctccgcgcggcggccgttaaggcggtccgcacgtcagacctgggcgtcaacgtggtggagggtcgcgttgcctcgggcgaccagttcgtgtgccggcaggaccagaaggaccgcatcgcccagaccttccaggcaagctgctgcgagatggagggcgcctccatcgcccacgcctgctacctggcgaacgtccccttcgtggtcgtccgtgccatctccgacaaggcggacggctcctccagcgtggagtaccccaccttcgagcgcaaggcggcgcacgactgcgcccgcatcgtccgcgccatggtgagcgcgctctagccgtggcctcgctccctacgcgggaacggcaagctcgttcacggcgtctgtcgggcgcctcccgtcgagtgcctccaggacgttgtgcagcgccctggagcgcatctcgcgatacgagtccgagctgtggtaggcggcgtggggcgtgacgatgcagttgtccaggccgatgagggggctcctcccgtgggcctcgtcgcggatcacgtccacggcggccgcccgtatggtgccgtcgcggagcgcggcagccaggtcctcctccaccacgcacccgccgcgggcggtgttcaccaggaacgcgtcgggcttcatgagcgagagggtccgctcgcacaccaggtcctcggtctgggggaccaatgggcagtgaaggctcaccacgtcactcgtctcgaacagctcctcgaccgtcgggaccttgacgcagccgcaccgtgccaggcattcctcgcccttggtgggggcccacacggcgacctccatgccgatggcttggagcatgggcgcaagggcctggggtatcgacccaaagaacaccagcccggcccgcttcccccgtgggcgcggcggctcgtagccctgcatgtcgtcccaggtgccggccctcacttggcggtcaaaccaggtgatcttcttgtacaggtccacgatcaggccaagggtgtggagagccacgtcgtaggtgcagtacccggggacgttgctcacccacacgcccccctgcgaggcggcggcaacgtccacaaagtcgtagccaatggccatgatgcccacggccctgagcgacgggttcgcccgcagcgtcgcggcatcgacccttccccactccagtaccagggcgtccgtcccgtccagctcgcccgggaggggaatcccatccccgtctgccttggcgtcgtacagctccaccccgcggacgccccactcctccaggagcgagcggtcaaagtcgagcggcctcgagcttcccaggtaggcgatcctgtgcgtggtcattgccgggtccccctttcagggcgtgggatgggcgagaggtgcgtcggcctcccgtccgtgcccattccggacgggaggccgtgccctgcgggaaccagggacgcgcgggctagtagcccagctcggtcatggagcggtcgaggatgtcgacgccctcgtccagcacgtcggtggtcacgttgagggcggtggcaaagcgcatgccgttgccgtggacgccgcagttgagcgtgatcatgtggtgctccagcgccttggccttgatggcctgccacagctcgggggcgggggtcccgtcctcgtggtcaaactcgatggcgcgcatcaggccgatgccgcggacgtcgcccaccacggggtggtctgccgcgagcttctcgagcttcttgcccaggtagtcgcccatcttgttcacgttggtaaggatgtcctggcgctcgaactcgtccaggacggcaagcgccgccgcggctgccaccgggttgccgccaaaggtgccgccatgcatgcccgggtgccagcggctcatgatctcgtgcgtgctcacgaccgcgctcatgggcatgccgccggcgatcgccttgcccaggttcatgatgtcgggggtcacgccaaagttctgccccgcccacatcttgccggtgcgcccgtagccgctctggatctcgtcgaagatcagcaggatgccgtgctcgtcgcacatcttgcggacgccctgcacaaagctcgcgggaggcacaaagtagccgccctcgccctggacgggctccatgatgatcgcggcgacctcctcgggcgagaccaggtagtcaaagatctgctgcaggtcgttcaggcagtactcggagcgctgctcctcgtcaaagcccttggggcacaggtccttctgggggtaggtggcaaagtagacgccgcccatgcagggctggtacgagtggcggtacttggcggcagagccggtcaccgacatggcaccccaggtgcgcccgtggaacgagccgcgaaaggcgatgatgcacgggcgaccggtgtatgcgcgggcgagcttgagggacccgtccgtggcctcggcgcctccgttggagaagaacgtgcatcccaggtcgcctggggcgatctctgccagccgctccgccagcgtgagggtggtggggaagttgaccatgttgaagctgccgttgatgagcttctccacctgctcgtggatggccgccttcacggccgggttgttgtgcccgagcgcattcaccgcaattccctggacaaagtccaggtaccggtcgccgttgacgtcgtacaggtagcttccctcgccacgctcgatgaccaggtcggtggtctttgcgagtgcgggggagaggtaccgctcgtagtcctcgtagcgcatgggcatgatggcttcctctcgtcgggtcctgacctcgtccgtacctccgtgcgaacgtctctaaggtaggaagccatcgttgccctgaggttgcgccttcaattcgcacgtgatgccctcgcgttgcatgtgagttagtgaaatgtgcacgataatgtttcacatgtgcggtgccgagggagcgcatgcatagacagggggtgacggcaaaacctccgtacacccccgtggttgaccctatgtcttgtttcgttggccctcgagcgccgtccccgatgcgcttggcctcctaggcgtaggggagcgccgtctcgagcgagacctccatcatgttggtgaagctcttctcacgctcgtctgccgagagggactcgccggtaaagaacgtatcggaaaccgagaggatcgagaccgccttcttgtggctggcctgggcctcgatgtagagccccgccgtctccatctcgacgcacaggagtccgaggtcgcggtagcgctggggcgcgtcctcgcgggggttgtagaacacgtcggagctcacgacctggcccacctggtagccgtaccccagtgcctcgcaggacctcactgcgtcccggagcatgtcccagctcgccgtgggggcaagcttcacgggggagtcgtacaggctcgcgatggacgagttggttgcggcgctctgggcgatcacgatgtcacctgcgtgcaggccgtcttgcagcccacccgtggtgcccacgcggattatcgcgtccacgcccacctgggtgtagagctcgtgcgcgtacaggcacatggaggggatgcccatgcccgagcccatcacgctcacacgcctgcccttgtaggtgcccgtatagccaagcatgttacgaacgtcgttgaagagtatggggtcttccaggtagtgctcggcgatgaacttggcacgcagcgggtcgccgggcatgaggacgaccttggcgacgtcctccttgttgcagcggatgcaggcagagaccgactcgaacatgggattcccttctccttggctactcaaacagtgcggcgaggctctggtcgtacggcggacggcagatgcccctctcggtcacgatggcggttatgaggtcgtggtccgtcacgtcgaaggcggggttgtagcacctcacctcgggcagggccttgggctcggcgtaccacatggtcttgatctcgtccgggtcgcgctcctcgatcttgatgtcgtcgccggtggggcagtcgcggtcgatcgtggacgttgggcccagaacgtagaacgggatgccgtagtggtgggccaggatggcgacgcccgaggtgccgatcttgttggccacgtcaccgttcatggccacgcggtcgcagccgaccatgcaagcctggacccagccgttcctcatcacgatggaggccatgttgtcgcagatgagcgtgacgtcgatgccggcgcgctgcagctcgtagctcgtgagacgagcgccctgcaggagcggcctggtctcgtcggcaaagacgtggacctctttgccgtggtcgtgcgcgtagaagaggggcccctgaccggtgccgtagcctaggcatgcgagtggaccggcgttgcagtgggtcaggaccccatcgccatccgagagtaggctcgcgcccaggcgactgatctcctcggacatcgccaggtcctcgcggtggatggcgacggcctcgtcgcgaagcgcctcgacaacggcgtgcgggtcctccccggaatgggcgagcgtcaccccgtgcatcctgtcgagtgcccacgagaggttgaccgccgtggggcgagacgagttgaggtagtcgcgctggcggcccatcgcggcggcgaaggcgtcgtacgaggtttcgcggtcggcctcctgccgcgcgagcacgtagtagcagtagcccgcgcagacgccgattgcgggtgcgccgcggaccttgagcctcaggatcgcgtcgtacatgtcctgtgcatccgagagctctacatattccagccggttggggaggagcgtctggtcgatgatgaccaccgcgctcccgtccggcttgagctccacggcatccacgttggtgacgccgtcggatgaccccctcagctgcgactcgggtgtctctccacctgccatgcctgcctccatcgtgttgtcttccctcctaggacctgccgtcgctcccgctggcgtcgttcctcgccgaggctcgcctgcggtagaagtcgtgcatcccctgcaggtggctgacctggcctgggtcaagctccacgccgcctcccaggtcgtgaaccaccttgtagacctttgcgctgtgctcgatggtttccatgaggtcgaacgccttccagacgtccccaccccaggcgaccgcgccgtggttggcgaggagcacgccattgtaatcgtggacgaaggggaggatgctccggggcacctcatcggtggagagcatcgcaaagtccgtgacgggaatcctcccaaagttgaggatcagctcggggaggtagggctccgacagttcgcgccggcagatggcgaaggcggtcgcaaagacggggtgggcgtgcaccaccgcccgcacgtcgggccgctcgcggtacacggcaaggtgcatcttgacctccgacgaggggaaccgccccgactcgtcatcgggcaggacgttgccgtccaggtcgcagcgcacgagcatgtcgggcgtcatgcgccccttgctcacccccgagggggtcacgaccacctcgtccgccccgaccctcaccgagacgttcccatcgttcgacgcgacgtagccgcggtcgtacaggagccttcccaccttgcagatgtcctcgcgcacgtcctcgtgcatggttcctcccaatgaaaaagacgaagggcgccggggaggttgatcccccgacgccccgctaacacggctatcccacctcgaccgcctgcgctcccatgccaaccaggtcggggccagtgtgcacgagcaggtcgggcgagatgcccgacctctgcacctcgacgaggccgggaatcgcggcacgcagcctctcctccaggcggtcgaacagctccgaggtgttggacgagcagcatatgcccacccgcgagcgggcaaactggttggcctgctgagagcagagcgagaccatcgtgtcgagcgccttgttccagccgcgcgccttgcgcgcgaccacgtagtacccggcgtcatcgcacatcaggaccggcttgatgttgagggcgttgcccagtcggtacacggtgccgttgatgcgcccgccgcggtagaggtactcaagcgacttaaccgcaaagaacacgctcgtctcgcgcgcgcagcgacgtaggcgcgaatccagcagggagaagggcacgccggattccaccagctccacggcgcgctggaccaccatgcccgccatcaggccaattgacttggagtcgatgacggtgacggggaagtcctccatctggcctgcgaccaggcggcaggtctggttggtggcggagagcccggcggagatggtcactatgaccgctgccacgtacccgtctgccctggcgccctcaagcgccgagagcacctgctggggagaggggagggaggtcttgggaatctcctgcccaaagcgatggatgacctcgtcgctcgtgatgtcgacgccactctggaacgagctgccgtccgagtagttgatgcggagcggcaccacgcgcacgtcgtgctcgcttgcaaaggtgcttggaacatccgtgcccgagtcggtgatgattgcaatgcgctgctcgttcattgcgccctctcgctttccgccttgtgggtgagaacattctgtctctcttatggtggactatatgcccattcgaggccccctcgcccaaagcggataccatatcattcgttgctttcacatcttgcccccgcggacgtgtgcctacctgcggcgccccgcgtggtgcgatgtccgaaaggaggccgattaggcatgtccgacctgtctgagatgacccccgagcggcgcgagagggtgcttcgcaagcgctcagcgatcattggcgagccagcggtcgtgaggaggatgtcccgcacgacgtccctccagaaggtgacctccaacggtaccatcgccgccgcggtgatggtcgcggcggcgctccttgccgtcatcgtcgccaactccccggcgtacgaggcggtcgagcacgtgctccaggcgcccctctccatcaccatcgggggcctgaccgcctcgatgagcgtcgaggcgttcgtgaacgacttcctgatgtcgatcttcttcctccttgtggggattgagctcaagtacgagatgaccgttggtcagctgagaaagccgcgccaggcggcgctccccatgctcgccgcggtgggtggcgtcgcgttccccgcaatcatctatctgctgttcaaccacgccaccgccccgcacgggtgggcgattcccatcgcaaccgacatcgccttcgcactgggcgtcatgtcgcttctgggcgaccgcgtggctcccgagaccaaggtcttcttccagacgctcgccatcgccgacgacatcctggccatcgtggtcctggccctcttctacgggcagacgcccgacatcgcttggtgcgcagccacgctgctggtcgtgctcgtcctcgccggcctcaaccgcaggaaggtgtactctgccaggccgtacctgctcgttggcctggtgctgtgggtctgcatgtacaactcgggcattcacgcgaccctcgcgggcgtcatcctcgccttcttcctccctgcgcgctccgacgtcaggctggggcgcctgcgtgcgtggctcggggtgcaggcgaggttgctcgacgacacctacgacgacgagtcccacgtgctgggccaacacgacttcaccgccgcggccgagaggatcgagggcatcatgcaccacgtgaccccgccgctcgagcgcgtcgagcgctccatctcggtccccgtcaacttcgtgattctcccgctcttcgccttcgtcaacgcccaggtgcgcctggtgggggtcgaccccatggcgatcgtctccgaccccgtgacgcagggtgcgttcctaggtgccgtgataggcaaaccgctgggcatcatccttgtgacctggctgctagtgagagtcggcttcgccaagctgcccaggcacgtcacctgggaccagattgtcgccgtcggcatcatgggcggcatgggcttcaccatgtcaatcctcatcgcggggctcgcctttagctccccccaggaggtcatggcggcaaagtgcgccatcctcgccggctcgttctgtgccggtgccctgggcgttgcctacgtacacctggacggccacttccgctcaaagaagcccgggggagagaagggcggcgacgccgccgcggctgctcccgctggcagtgacggagcggcgggggagtgagcccggtcctctcccgcgaacgcagctctcgtggagccgacggtcgcgccgcggctcccgcccggctgctggtaccattacccgcatgacgagctatgactacaaccccttcgcgtacgagccccttgggcgcaaggcccccgtcacgggcagctacacgccagcgcccgagttcggcgagctgcagcgcctcgtggacgaggtgttcgaggcgtccgccgcaggcggcaccgtcgccaagctcgatcttgtgatgcgggccgagatcgacgacatggcggccgacctccaggaggtcatcgacctcctgcccggcgggcgctacgaccgccatcggctctgtgaccagatgaactcgatcatcaccgcacacggctggggctacctctacggcaccgtggagtagcttgccaagggtctcgtatcggccgaggcgcctacgcgggtgacggcccgtgtacgtatcccgctccgggggctcctcgcatcgggcacacactatacttgcggatgatgccgacccgacggaggaggaccccatgcccaacgcataccagtccatgtcaaccgagtccctggacgaggagatcaagcacctcgagaccgaggtcgcccacctgagggaccagcacctcaagctcgacatggcccgtggcaagccctccccgcagcagaccgccctctcaaagcccatgctcgacgtgctgggctcctccacgccgctcgtcgacggcgatgcgatcgtggacaactacgggaccccggaggggcttccctccgcgcggcgcctggcggggcagatcctgggcgtcgaccccaagaacgtggtggtgtcgggctcctcgagcctcaacctcatgcacgacctcgtcgcccacgccttcatcaatggcgtcgccggcgccgagcccttctacaggcagggcgaggtcaagtggctctgccccgcacccggctacgaccgccacttcaaggtgaccgagtcgatgggcatcaagaacgtccccatccccatgcgcgaggacgggcccgacatggacacggtgtgcgagctcgttgagggcgatcccacggtcaagggcatctggtgcgtgcccaagtacgccaaccccacgggcattacctactccgacgaggtcgtccgcgcgttcgcctcgctcaagcccgccgcccccgacttccgcatctactgggacaacgcctacgtggtccactgcttcggcgggacggacgaccagctcctcgacatcttccaggcggtgcgcgaggcgggcaaccgcaacctcgtgtacgagtttggctccactgccaaggtgaccttccccagttcgggcatcgcgttcgtggcggcgagcgacgacgacatcagcgaggttcgcaaggcgttctcggtggagcgcgtgagctccgagaagatgagccagctagcgcatgccctctacctccgtgacctcgacggggtccgcgcgcacatgcgcaagcacgccgccatcgtcgcgccccgcttcgccctggtgcagagcaagcttggcgaggggctgggcggcctgggcgtcgccacctggtccaacccgcacggaggctacttcgtgagcttcgagggccccaaggggtccgccaagaggatcgtcgcgctgatggcagacctcggggtcaagctcacccccgccggcgccacgtggccgtacggcaaggacccaaacgactccaacatccgcatcgcgcccacgtacccgtcgctcgaggaccttgggcaggcgctcgacgtcttcgtggtcgcggtcaagctcgtgagcgcacggatcgcacgcgaggagcgggactagcggtttgcgatgggggcggggccggcggtcccgccccctccctctcgaggggagagcgacgggcgtacggcgtccacgcgtcttcccacggccgtgcaagccagctgcgagcgcacctatatatagtcgtcagatggcgccatccacacctggaatggcttgcgagtgtggatgtgacatgcttgacaggtttggtttgtagaatgtagctttgcgttcgttgcatggacgtcgcgcccctcgccgggcggcacggaagatcgaagggatgggcggatgtcgggaaacaagggaacgtcgggaaagcgactcgcccgggcaaaggttgcctcgggagcaaacgacaagggcgcatccgacaaggccgccaagggtgccgcacggcacgacgggggcaagaagcccggcaagcctggcaagggcacgcagatcgccatcgtcatctttggcatcgtgatggcgctctccatgatgctcccgtccctctcggcgatcttcgcgggcggaagctcgtcgtccagctcccaggcgagccaggagaccgactccgcgtcctccgcggactcgtccgactcctcctcgtccggcacgtcgggcatggccagcgttgactccaagtactcctcggtggtgtccgagctcgaggccaagctcaaggagaagcccaagagcctcgcgaccctgctcaacctgggcaacgactacatggcctgggcctactccgcaagcacgtacgccacggacgacacgtcaaagcagcacgtgaacgacctctaccagaaggcgatggggtactacgaccagtacctcgccctcaacgactccagcgcggtgcgggtcaaccgcgcgctctgccagtactactccggtgacgtggacggcgccaagtccgccctcctcgagctcacccagagcgactccacctatggtccggcatgggccaacctcggtctcatgtacgaatcctccggcgacaccgccaacgcaaagtccgcctaccagaaggcggaggagacggacgccaacgacgagtacggcgccaagtccttcgccgagcagcgcctctcggtcatcgcgagccaggaggcggaggcgagcgactcgtcctcctcgtctgccacgacgacctccggatcgaccacccagggcctgtccgagacgctcgccaactccagcggaaccaacctctaggacaagaaacggagcatcatcccatgagcctcgaaatcacatccagcaaggacgggtccaagaccctcgtgaaggtcgtcggggaggtcgacgtgtccaacgccccccagctccgccaggagctcgaggcggcactcggcgagtcgacccctcaggtcgccgtggacttctccgaggtgccttacatcgactccacggggattggcgtgctggtgggtgccgcccaccgcgcccaggaggcgggcgggagcctgaccctgagcagcccgcagaagaacgtcgcccgcgtgctctcgctcctgggcgttgacaaggaactggtggcgggggagtagtccccctcctgcggcactggaggtgcgcgcgtgtttggcataggcgagacagagctgttcctgatcgtgctcttcggcttcctgctctttgggccggacaagctcccgggcatgggcaggaccatcggcaaggcactgaggcagttcaggcaggcccaggagggcttcaccgaggtcgtccagagcgaggtcatggacccgctgagcaacgcggtgagcgagggcatgggggacgaccccaagagcaaggacgcggcagccaagcgtgccgccgccatggacgaggactccgacctcgagtccgccgacggcgcccccacggaccgcaagcgcgagaccttcgcgcagcgcaaggcacgcctcgaggcggagaaggccaagcgcgaggccgaggcggcaccgaaggcgcagcaggacgcagcaacgctggcgtcggacgcagactccgacgacgacgcgccggagcaggatgagcccgctaccgagccgcagcccaaggaggggcccaaggtcgcgagtgcggcgtccctctatgcgatgaggcccaggcgccacgaggcggaggccaaggcagatgccgatgccaacgctgacgccgacgagcagaccgtgacgcaggacgacgccgagccctccgctgacggcgcgtcgaaggaggaggactaatgcccgtaggaccagcacgcatgccgctgatggatcacctcggcgagctcaggcggcgtctcaccatcatcgtcgtgtccgttctcgtcaccgcgatcgtggtgtacgaggcgacgccgacgctgatccagatcctgatggaccccatccggtccgtcatgccggcgggctccaagctcaccgtcctctcggtcctcggcggcttcaccatccgcttcaaggtggcgttcttcgtgggcgtgatcatctgcacgcccatcatcatctgggagatcatggccttcttcctccccgcgctcaaacccaacgagcgcaagtgggtcgtccccacggtcgcggcgatggtcatcctgttcgccctcggcatggtcttctgctatttcgtggccctgcccgcggcaatcgggtggatggtgcagcagtcggttgacttcgccaacgtcatcgccgacgcggaggactacctcaacatcatcatgctgctcgagatcggctttggcatcgcattccagatccccctcgtgatcttctacctctcggtcctccacctggtcccctacaagaccttccgcgcccagtggcgctacatctacgtgggcctcatggtgctctcggccgtggtcacccccgacgcctcccccgtcaccatgctgctcatgttcgccgccctcgtgctgctgtacgagatagcgctggcagtggcccgctacgtcctcgtcgcgcgcgacggcaaggagtccctcaagtggacgagggaggactacgaggagcacgagctccagaaagacgaagaggacgactaggtgaagcttgttgtaaccgagaagaacgacgcggcgcagcagattgcgcggctcctctccacctcgggcaagcccaaggcggacaaggtgtacgacacgcccgtgtaccggttctcgcatgacggcgaggagtgggtgaccatcggcctgcgcggccacatcatggcccccgacttcccgcccgagctcaagtacgaccgcaaggaggggtggtacggcctcaccgccgagggggagcacctgccagcacgccttcccgacgacctcgccaagccaccctacgagaccaagcgcaagcccttcctcaaggacggcatcgacatcaaggggtggaaggtcccgagccttccgtacctcgtgtgggcacccatcgagaagcttccggcggagaagggcatcatccgcgccctcaagaacctcgccaagaaggcggactccatcgtgatcggcacggacttcgaccgcgagggcgagctcatcggctcggacgccctgaggcagatgcgccaggtggcgcccgacacgcccgtctcgcgcgcccgctactccgccttcaccaaggccgagatcgaccatgccttccagaacctcgtggagcttgaccaggacctggcggacgcgggcgagagccgccagtacatcgacctcatctggggcgcggtcctcacgcgctacctcaccatggcccgctttggcggctttggcaacgtgcgcagcgccggtcgcgtccagacccccacgctcgcgctggtggtgcagaaggagcgcgagcgccaggcgttcgtccccgaggactactgggtgctgtggggcatgttcgcccccaagggctcggcgtcggaggacgacgccttcaaggcgacccacgcaaccgcgcgcttcaaggacaaggcctcggcggacgcggcgttcgcgcgcgtgagggacgcgagcgaggccagggtcctctccgtcgagaagaggcgccgcaccaccaacccgcccgccccgttcaacaccacgaccatgcagaccgccgcggcggcggaggggatcagccccgcccgcgccatgaggctcgccgagtcgctctacatggacggcctcatcagctacccgcgcgtggacaacaccgtctaccccaagtcgctcgacctcaaggcctgcgtgcggaccctctccgaggtgccccagtaccggcccacctgccaggcgctcctctccgggggcccgctccacgccacgcgcggcaagcaggagaccaccgatcacccgcccatctacccaacggcggcggccgacccgggaagcctccagcccgccgagtggaagctgtacaacctcatcgcgcgcaggttcctcgccacgctcggcgacccctgcgtgaccgaggggaccaagctcaccttcgacgtggagggggagcgcttcacgagctccggcaccgtggtggtggagcccgggttccgcgccatctacccctatgggcagcgcaaggacgagcagcttcccatgctctcggagggcgacgtctgcgacgtccgcaagatgacgctcgacgccaagcagaccgagcctcccgcccgctacagccagggtcgtctcatccaggagatggagaagtgcggcctgggcaccaagtccacgcgcgcctcgatcatccagcgcctgtacgacgtgaagtacctcaagaacgaccccgtcgagcccagccagctgggcatggcggtcatcgacgccctcaccgagtacgcgcctcgcatcaccagcccgagcatgacctccgagctcgaggacgacatgaccaaggtcgccgagggggtcgatacccaggaggacgtggtcacgcactcccgcgcgctgctctccggcgtgatgggcgccctgatcgagcacaaggacgacctgggcaacgccatcgccgatgccgtgacggccgacgccaaggtgggcgtgtgccccaagtgcggtaaggacctggtcatgaagacctccgccaagacgcgcgggagcttcatcggctgcatgggctggcccgactgcgacgtgacctatcccgtcccgtccaaggtcagggtcgagcccatcgagggcgaggcgggcgtgtgcccggtgtgcggcgccccccgcatcaagtgcaagccgttccgctccaaggcgtacgagatctgcgtgaatcccgcctgccccaccaaccgggagcccgacatcgtggtgggcacctgccccgtctgcgaggcggacgggcgccacggcgaccttgtggcccacaagagcgagaagacgggcaggcgcttcatccgctgcaccaactacgacgtctgcggggtgagctacccgctgccccagcgcggcgagctgcacgccacgggcgagacctgccccgactgcggggcgcccatcgtggaggtcgtgaccgccaggggcccctggcgcatctgcgtcaacatgaactgccccggcaaggagaagaaggccgcctcccgggttgggaggggtcgtggcacctccgcgtccgcgaaggcatcgggcgcaaagcgcggtacgagggccaagtcgaccaagtccaccaaggccaagtccgcggggggcaagtcttccaaggccaagtcctccgccaagggggagtcgtaggggcacgtcccacgcgatgccaacgcccccgctgccgagcgcggcgggggcgtctctctccccagccttcgcgcgcgtccccgtgaccacgggcgcgccacaccaacctgctagagtaagctgtcccagaccgccagcacaccatggagccgccatgccaagcaccagcaccgcaccaggcacgtcgcatgcgcgcggcgcgttcgtgacgctcgaggggatcgacggctgcggcaagtcgacgcaggccacgatcctggcggccaggctgcagtctgagggctgggaggtcgcgcggcttcgcgagcccggcggcacggtcataggtgagaaggtgcgctcgatcctcctcgaccccgccaacgccggcatgtgcgaccgcgccgagctgctgctgtacgaggcctcgcgcgcccagctggtgtgcgaggtcatcgtccccgcgctcgagcggggtgccgtggtggtgtgcgaccggttccacgactccacgtttgcctaccaggcggggggccgcgggctctcggaggacctggtggacgaggcgaaccgtctgggcacctgcggcgtgacgcccgacgtcacgatcgtgctggacctggatccccgggtcgccttcgcgcgtgccaccaggggaggtgccgaccgcctggaggcggagggccttgccttccaggagcgcgtgcgcgcgggctacgcccggctcgcccggcgcgatcctgaccgtgtccgcatggtggacggcgcgggggacgcctcgctcgtctcgtcccgcatcgacgcctgcctgggagaggccctcccgtggctgggcggcggggtggtcgagcatggctagcgtcgacggcgtgccgctgcccgcggcactcgcgtgcctctcccagcagccgcgcgtccaggagttcctgggcgacgccgtgagggagggtcgggtctcgcacgcctacctcttcgtgggtgccccggggtccggcatggacgaggcggcacgggccctggcgcagtgcatcgtgtgccccaacgggggagacggcacctgcgacgagtgcattcgcgtctcgcatgggacgcaccccgatgtccacgtgtacgagccggggagcgtgaccggctacctggtgtcacaggtgagggagctcatcgccgacgtgagcctggcgcccgtgcgcgcccccggcaaggtctacgtgattcgcgaggctgccctcctgcggggcgccgccgccaacgcgctcctcaagaccatcgaggagccgccggagggcgtctacttcatcctcatcgcccgtaccgccgcggcactgctgcccaccatcgtgagccgctgccagcaggtgcccttccgcatcgtgagcccggacgccgcccagcgcgcggtggaggccaagagcggaatcggcgggaccgacgcgcgcgtcgccctgagcgtggcgggcacgcccgaccgcgccgccgagttcctggcctcgtccgggcgcagggaggtgcgccgcctggtggtgcagacgttgggcgagctcgcgaacgacgactcctgggacgttctcgtggcggcacgccagatcgtggaggcggtcaaggcgccgctggcggacgtgcggagcgcccaggaggcggcccttggccaggatggcgactacctgcccgcgaaggcgctcaagcagcttgaggacgccaacaggcgcgagctcaccgcccgggagcgttcgggtatgatggaggcgctgtcggccgcggagtccctgctcagagacgtcctcctgcgctgcgagggcatccccgagggcatcgtcaacgaggacgcggcagacgtggtcgaccgccttgcctcctccaccccaacggagggcgtggtgcgcgccctggaggccgtgcggtcggcggcggacgacctcgcccacaacgtaacaccccagctggccatcgaggccatgcttctctctgtcaaggaggcactcgcatgcccaccgtcataccggtgaagttcaagtatgccgcccgagacctgtggttcaatccccgcgagaccggggcgcaggagggcgaccacgtgatctgctcgaccgagcgcggggccgagatcggccttgccaccatggacgcccgcgaggtcagcagcaacgagctgcgcgacatgatcggcgagtccaagctccagcccgtggtgcgcatctgcaccgagggcgacctggaccgcgccgaggagctcgcgcagcggggcgacgacgcgctccccgtgttccggcgcctggtgcacgagtcgggcctcgacatgaagcccgtgggcgtggagtacctgtttggcggcgagaaggtcgtgtgctacttcagcgccgaggagcgcgtggactttcgccagctggtccgcgacctgtcgcacgagctgcacgagcgcatcgacatgcgccagatcggcgtgcgcgaggaggccgcgatcgtgggcggctttggccactgcgggcaggagctgtgctgcgcgcgcttcggccaccagttcgagcccgtctccatccgcatggccaaggagcaggacctcccgctcaactccaacaagatcagcggcgcctgcggcaggctcatgtgctgcctgcgctacgagttcgaggcctaccgcgacttcaagcagcgcgcgcccaagcgcaacgcggtgatcgacacgccgctgggcaaggccaagatcgtggagtacgacacgcccaaggagcagctctgcctgcgcatcgagaacggcaagaccgtccgcatcccgctcgccgacatggccacctccgaggcagcggtcaagaagagcgaggagctccattgcccctgccgtcccgacaccgtcacgcgcgaggcgctggacaggctccagtcgcccgacgtgcagatggcgctcgcggagctcgaccgcaagaacggcgtcacccccgccaagtcgttcgaggcggaggacatcttcgtggagaccaggcgcaagcgccgtcgccgcgggggagaggggcaggaggcctccggccagcggcagcgtcccgagggctccgtgcgccgtcgcggcggccagcccgaggccggcgaggcggaggccaagggcggcgcacgccagggcggggagccgtccgcccgtcgccgccgcaagaaggtctccgcggccgccccgaccaccgagggcgtgcccgaggccacgcaccgcaggaggcgccaccacagcgcctcgggcgagggcgctcccgcacaggggggagacgcgcgctcccagcagccccagcagcgcaaggatgggcaggggcgcgacggctcgcagaagcccaagggcatgcagcccagcaggcgccgccggcaccccggcgaccgcggcggccagcaggcccagcaggggtcggcgggcggccagcagcagcgccagggcaggcagaagccggcgcagggcggcggcaagtctcagcccacgggcgaggcgggggacgcccagcagaggcgtcgccggcgccaccgcgggggccgcggccacggcaagggcggcgacgccccgtccgccggcggtgacggctccgcctcataggacgccaaggggacctcgtccgggcaacgggcggggtccctctcccatgcgcggcgcccccgccgcacgtcccgtttttgtccgcaccccaccccatactgaaacacgtgttcggtgggaaggggacgcgatggagatgccacgtgtgacgccgcacgcacggggccctcggggagtgggccccggggccggcgggggagagaccgtgccacgcaggaggctctatgtggaggtggagtccaggaccgatgccgagggccgcatcacgccgctcgtggtggtgtggcgcgacggcgtgaggtaccacatagaccgggtgacggaggcgcgcgaggcgtactcgccaagaacgtgctcggcggggctcaggtactcggtctgcgtgggcgggacgcagacctacctgttctacgagggcccgcgctggttcgtggaggcaaaggtcccgcctgcctcgccggacgccctgtgaaagaatggccctcgtatggacgagggttgagcggcgcgagaactcgccgccgcggaaggggaggacccatgggatacggactcaagacggaggcgagctttgacggggctcacttcctcaccgactactacggcaagtgcgagaacctgcacgggcaccgctggcgcgtggtggcctaccttcgccaggacggcctgagggacgagggcaccatgcgcgacatggtgctcgacttcggcgtcttcaagagggcggtgcgcgaggaggtgggcgcgctggaccacaccttcctggtggaggagggctcgctcaagccgggcaccctcagggccctcacggaggacgaggggttcaggctcaccatgctgcccttccgcaccacggccgagaacctcgcccgctacttcgccgagcgcctgctggcgcgcgacctgccggtgagccaggtggacgtgtacgagacgccgctcaactgcgccagctacttcgtggagtaggggcaaggctggctcccgcggccggcgggaggggaggggcgacgtcgggtggctcctctcgcctgtcgttaggtccatgccaccgctgtgcgctccgtcccaggttggcgtcccaggggagaggggcgcggcaagggaggagccacccgtccgagggacggatggctcccgtgatgcctgccgttgggtgtggcccgccgcgcggggctagtctgccacgtgctccgcgacggccttggccaccacgtccgccacgcccttgtccagcgcggatgggatgatgttctggggtcccagctcgccctcgggaatcaggctggcaatcgccttcgccgcggcgacctccatctcctcggtgatctccctcgcgcgcgccttgagcgcccccttgaagatgccggggaacaccagcacgttgttgatctggttggggaagtcggagcggccggtgcccacgacctccgcgccggcggcgagcgcctcgtcgggcatgatctcgggcacggggttggccatggggaacacgatggcgtgactcatgctcgcgaccatctcgcgcgagaccaggttgccgcgggagacgcccacgaaggcgtccgcgccgcgcagggcgtccgcgagcgtgccgtgctcgtggttggcgttggtgatgtggctgatggcatcctggccggcgttgaggccctcgtcgccctcgcagatgatgccattgacgtcgcacatgaccacgttgccaaagcccatgtgcgagagcagcgtgccgatggcgcagccggcggcaccggcgccgttgatcacgatcttgacggagcccatccgcttgccggtgaccttgagcgcgttgatcatggcggcggcgaccacgatcgcggtgccgtgctggtcgtcgtggaagacggggatgtcgcagacctccttgagcctgcgctcgatctcgaagcagcgcggggcggcgatgtcctccaggttgatgccgccaaagctcttgctgatcagctgcaccgtgcgcacgaactcgtcggtgtcgtgggtgtccacgcagatggggaaggcgtcgacgtcgccaaactccttgaacagcgcgcacttgccctccatcacgggcatgccggcggcggggccgatgtcgcccaggcccaggatggcggtgccgtccgtgatcacggccaccaggttgccgcggcgcgtgagctcccagctcttctggtagtccgcctggatctggcggcagggctccgcgacgcccggggtgtacatcagagagaggtcgtctcgcgtctccacgtgcttgcgcgacaccacctcgatcttcccgtgcagctgctcgtgaagctccaggctcctcctgctggtctcgtccatgtgctagaccatctcctctggcttgaacaccctgtcgaactcttccccggaaaggaatccgagcgagacgcacgcctcgcgcaggctggtgccctcctcgtaggccctgtgggccaccttggcggcgttctcgtatccaatatacgggttgaggcacgtcacgagcatgagggagtcatgcaggttgcgacgcatgcgctcgcggttggccttgatgcccgatgcgcagtgcacgtcgaaggacctgatggcgtccgagaggagcgtcacgctctgcaggtagtcgtacgcgatgaccggcatgaacacgttgagctcgaagttgccctgcgacgcggcgaagccgatggtcgcgtcgttgcccatgacctgcacggccaccatcgtgaccgcctcgcactgcgtggggttgaccttgccgggcatgatggagctccccggctcgttggcggggatggtgatctcgcccaggcccaggcgcgggccgcttgcgagccagcgcacgtcgttggcgaccttcatcatgttggccgcgagcgcccgcacggcgccgtggctgaacgcgatggcgtccttgcccgtgagcgcgcggaacttgttggggtcggtcacgaactcctgccccgtgagggcggagagcttggcggcgaccagcgcgtcaaagcccttgggggcgttgaggccggtgcccaccgcggtgccgcccagcgccaggcgccggagcgggggcaggctcgcctcgagctcctcgatgcccgcctccaccaggccgcgccagccgcttatctcctggctgaaggcaatgggcacggcgtcctgcaggtgcgtgcgcccgctcttcaccacgccctcgttctcctcctccaggcggcgaaaggtggagaccagctcttgcgcggcgggctccagccgctcggtcacggcgagcacggccgccacgttcatggcggtggggaaggtgtcgttgctgctctggcttctgttgacggagtcgttggggtggagcggcttcgagagagcgatgccctgctcggaggcgatctggttgcccctgttggcgatgacctcgttgaggttcatgttgctctgggtgccggagccggtctgccacaccttcagggggaaggcgtcgtcgtgcctgccgtccaggatctcgtcgcacgcgaggcagatggcctcccccgcacctggctcgagcacgcccagctccacgttcgcctgcgcggcggccttcttgagcagcgcgaacgcgcggatgatcaggggtggcatggtctcggtgccaatgcggaagttctggtacgagcgctgcgtctgcgccccccacagcgcctgggcggggaccctcacctcccccatggagtcgtgctccacgcgccagtcgtcaatcgcgtctccagcgtcgcccatgggggctccttccctttggcccggacccggcggatgcgggctcgggcatggccgtggcccctctcgcctagtcggtcgagatggccgtggatatctgctcgatggccctctgtccctcggggatggggtagagggggtagttcgcgttgagcccgctgcccaccacgagctcggtgtggatccccgtggcgcggacgcgctgggcaaacagcacggcgtcggggtggaagacctccctggtgccggtgtacacgtacacgttgcgcagcatgcgcacctggccgttgatggggctcaccatggggtcgtggacgtccgtgccctttgcccaggtgtgggcgatcttgcgcaggccgcagagcgagaacatggggtccacggcctggtaggcgttgaggtcggggttgtgcaggctcgcgtcgacccagggcgagatgaggatgaggcgcgcgggctggggcaggccgagctccgggagccgctggcagaagccggccgcgatgccgccgcccgccgtgtcacccatgatggtgacgccgccctcgccgtacttggagagcaggtcgcggtagaccgcctcgatcttgtcgtacgcctcggcgtaggtgtgcacgggggcgagcgggtacagggggaccctgacctcggccctggtccggcgtgccaccgagtcgaggaacctccagtggtagatggtcggctggttcacgtaggcggtcccgtggatgtagagcacggcgcggtcgttgatggagcggcggttgaggacgaaggtctgcatcccctggaaggtggtgtcctccacgctcaccttgaagctcatgaggggagagacgctgtagtgggtctcgttggtctccgcgtgcttgaggatgtagttgtcccaggccacggggtcgcccatcttgtccttgtcggcggtcacgcggttgtagacctccgaggcggtcgcgatgttggagcggtggaagaggaggtgcgacacggcggtgtatcccgcgaacgccagtgtcggggtcgccgtcgccacggcaatcgccctcagtgccctgtcgctcaggttcctcttgtccatgctcaagacctccgaatcgtgggcgtcttcgcgcccgtttcccctccgcacaattctagggaactgtcaggcgcgtgccagggacccattctcgcgtagcgccaaatatcgggggagcgtcgcatttgccgcaggccccatgggacggtcctcccgtcgcccggctgcgggtgcctcccacatgttttggcgtatgcggcatttgggccacggcggccgatttcattcgtggggcattccggcggcatgggccctagctgcgatggttcatcgcccgtctcgcccccgtattcattctcatatgcataaatatagacgtattacaagcaaatcaaggggataatgagagaagtttgccaaaatgattcctattttccgtaagaacatgcgatacgagatgctaccatcgtcgcagagaaggacgaccggggaggacgcatgaagaagtttgtggtggaggactcgttctgggagctgttcccggacgtggagataggcgtgctgtgcgtggacggggtgcttcccacggaccagatctcgccggagaacgctgccaaggccgcatcgttcctggaccacgccaacgccagtgccgagaggtggctcaccagcaccaccatcagcaagaacgaggtcgtggcggtgtggcgcgacgcgtataggaagttcaagaccaagggtggggcgcgctgctcggtggagaacctcctcaagcgcgtgctcaagggcaatcccgttggccacatcgtgccgtccgtcgacgtctccaacgcgatctcgctcaagtacgcgctgcccatcggtgcggagaacatcgacgccatacagggcacgttccggcttgcccagaccgagggaggggaccgcttcctgcccatcggcgaggaggagagcgaccccacgctcccgggcgaggtggtctacctcgacgacgcgggtgccgtgtgccgctgctggaactggcgagacgggcagcgcaccgaggtgagcgacgccacgccgcacgtgatgttcatcatggagtgcgttgacccctcccgctcggcagacctgcacgcggcgatcgacgagctggccgagaagtgccagcagctgctgggtgcgacggtcaccaacagggagttcgtgacgcgggagcaccccgaggcaacgttggaggcatagcgatggagtttcccatgcgccgggcggaccgcgccctgggggagggcgaggccctgcggttgatcgcggagtcgtcgcacgcggtcctctccaccgtggacgccgacggcgagccctacggcgttcccatcagctttgcgttggagggcaggtcggtgtacctgcacggtgccgcggcaacggggcaccgccttgccaacgtgggcggctcctgtcgcgcctgcctcacggtcgtctcgtcagacgaggtggtgccggcgcagttcaccacgcactactcgtctgccattgcctttggcacgctgaggcccgcccgcgacgacgccgagaagcgggagggcctgcgcgccctcgtgcgcaagtacgcgcccaaccacattgaggcgggggagaggtacatcgacgcggcgatagaccagacgtcggtcctggtgatggaggtcgaccgcgccacgggcaagtccaacgcgcccggcaggcggcggaactgaggggccagcggtccagggttcgcccgcaacgtgggacgtgcgataagattggtcggtcaatgcatgccaccaccccacgagggaagggaccagaccgtgaaccgcaccaagatcgccgcgctctacgcggacaaggaccagctggacggagagggcgtcaccgtcgccggctgggtccgctccatcagggacatgaagaactttggcttcgtcacgctcaacgacggcagctgcttcagggacctccaggtggtcctcaaccgcgaggcgctcggtgacgaagcctacgaccaggctgtgtcgcagagcgtgggcgccgcgttggtgatcgacggcacgctcgcgctgacgccggaccgcccgcagcccatcgagctccaggcggcgcgcgtgagcgtggagggtccgtctgcgcccgactaccccatgcagaagaagcgccagtcgcgcgagttcctgcgcacccagcagcacctgcgcagccgcaccaacctgttccgcgcggtgttccgcgtccgcagcgtggccgcctacgccatccacaagttcttccaggagcgcggcttcgtctacgtgaacacacccatcatcacggcgagcgacgccgagggcgccggcgagatgttccgcgtgaccacgctcgacctggcgaacgtgcccaagctcgaggacggctcggtcgactggagcaaggacttctttggcaagcccaccaacctcactgtgtcgggccagctgcaggccgagaactttgccatgagctttggcgacgtctacacctttggccccaccttccgcgccgaggactccaacacccgccgtcacgccgccgagttctggatgatcgagcccgagatggccttctgcgacctcgagcaggacatggacgtggccgaggagatgctcaagtacgccatcacctacgtgatggaccactgccccgacgagatggacttcttcaacaagtgggttgacaaggggctcaaggagcgactgacgcatgttgccaccagcgacttcgcgcgcgtgagctacgacgatgccatcaagatcctggaggaggcccaggatagtggcaccaagttcgagtatcccgtgagctggggccttgacctgcagaccgagcacgagcgctacctcacggagcaccacttcaacaagcccacgttcgtgaccgactaccccaaggagattaaggccttctacatgaggctcaacgacgacggcaggaccgtcgccgcggccgactgcctggttcccgggatcggcgagatcatcggtggctcccagcgcgaggagaggctcgacatcctggagtcgcgcatccacgagctgggcatggacccggagcagtaccgctactactgcgacctgcgtcgctacggcggctgccgccacgcgggctttggcctgggcttcgagcgcttcgtgatgtacgtcacgggcatcgacaacattcgcgacgtgctcccgcacccccgtaccgtgggcaacgcggacttctagtctcgcgcgccagagcgcaaccaacggccccggcagcctggtcgtcccaggccaccggggccgcctcgtttgcaccgggggagaggaacgctgtaccgtggggccgatcgggcttcgacgggatgcggggtggcaccatggcaggcggggacaggggcacgcccaggcgtgacgcgcgtgggggtgacgtcgcacgggggagcggggtctcccggcgcaccgcggttctcctcggctgcggggtggcggcgcttgcgggcggagcggcggttgcctcccgttgcgccagggtggccgggtcgtcgacgcggtcgtcgtccgactcatccgcctccggagcgacgctcgaccagagggtctcccaggcggttggctccctcacgctggagcagaaggtcgcgcagatgttcatgccgaccccggaggcgctcaccggcgtgggccaggtcacggcggcgggcgagacgaccaggaaggccttcgcgagcatccccgtcggcggcctgtgctacttttcccagaacctcatcgacccctcgcagacgaagcagatgctcgcctcgtcggatgccatctcgcgcgatgccgtgggtctccccctgctcatggcagtggacgaggagggtggcacggtcagccgcatcggcggcaacgacgggttcgacgtggacaacgtgggggacatgcgcgacgtcggagatgccggcgacccccagcgtgcccacgacgtgtgcgaggggatcgcgggctacctgagcccgctgggcttcaacctggacctcgcccccgacgcggacatcgtgagcggcaccagccagaccatggcgaggaggtcgttcggcacgagcgccgacgtggtggcccccatggtcggccaggccgtgagggggtttctcgacggcgacatcatgtgctgcgccaagcacttcccgggcatcggcggggcggagggcgactccgagaccgaggccatacagaccaccaggacgctcgaccagatgagaggggaggagcttctcccctttgaggaggccatcaggcagggcgtccccatggtgatggtcgggcacctctcgtgccccgcggtgacgggcgactccaccccggcgtcgctgtccaaggcgatcgtgacggacctcctgagggacgagctggggtttgatggcatcatcatcaccgactcgctgcagatgggcgccgtgagcgggctgcactcggcgagcgagctgggcgtcgccgcgatccaggcgggcgtcgacatgctgctcatgacccccagcctgggggagagctaccagggcgtgctggacgccgtctccgcgggcacgctcgacgaggcgcgcatcgacgagtccgtgacccgcatcgtgcgcgccaagctcagatacacgtcgtagcgcaccacgcgctgcgctattgcctaccccagcacctcggctgcgatcctcgcggactccgcggcgtccttggcgtagtagtccgcccccaccatctgggcgtactcggggttgaggacggcgcctccgaccatgaccttgcaccagggggcgcgctcgcgcagcagctcgatggtctcctgcatcgccggcaccgtggcggtcatgagggccgagagccccgccagccgcacgtggtgctcgaccaccgcgtccacaaagaccttggggtcaacgtcgcgtcccaggtcgagcacgtcgtagccgtagttctccagcagcatcttcacgatgttcttgccgatgtcgtggatgtctcccttgaccgtgcagatggcgacctgccccttcgaggcaacctgcgcgcccgaggcgtcgttgacctccttcagcacgtcaaagccggccttggccgcctctgccgacgccatgagctggggcaggaagaacgtgcccttctcaaacctcacgcccacctcgtccaaggcggggatcagcacgtcgttgatcgcgaacatcacgtcgtggtcggccaggatgtcgcgcatcagctggggcatgggtccctttcgcccggcaagcaccatggcacgcgcccgctcggcgggggagaggcccgcgtcgtcctgcccgccgcccgtcccatcggccgccggctggctcgcgcccgctgctgccagcgcccccgcggcgtcgctgcgggtggcgtagcccgccacgtaccgctgggcgctctcgtcctcgcccgagaggacgcgccacgagttgaccacgtccatcatgcgctgctgcttggggttgatgatgcccatgtccaggcctgccgagaaggcggccgagaggaacgtggcgttgacgagcgggcggaacggcagcccaaagctgatgttggagacgcccagcaccgtccgcaccccgggcagctcgcgcttgacgaggcggatgccctcgaggatggccctcggcgcgcgctggtcggttgaggccgccatggcgaggcagtcgatcaccacgtcctggcgggggatgcccgcggcgtccgtggcctccacgatgcgccgcgcgatggcgaggcggccctcgggggtctgggggatgccctgctcgtcgatggtcaggcccaccagcgcgcagccgtagtgggcggcgatgggcaccacggcgtcgagggtctcgcgcttgccgttggtggagttgatgagcggcttgcccgggtagctgcggacggctgcctcgatggtctcgggcaccgcggagtccacctgcagggggagcgacgtgacgccctggaggtcggccatcaggcgctggagcgtggcgctctcgtctatctcggggaggccggcgttcacgtccagaatctgcgcgcccgcctgctcctgctcgatggcgagggacataacgtagtcgtagtcccctgagcgcagggcctccctcatccgcctcttgccggtggggttgatcctctcgcctatgacccccacgtcacccggcctgagcacgcagagctgctgggagctgcacaccacgaagtcgtcccgcactgcccggggggctggctccatgccctggaccaggtccctctcgcccctgatgtactcgggggtggtgccgcaacagccgcccacgaccgagacgcccgcgcgcaccatgccgcccacggcctcgcagtactcggcggggtggacgtcgtacagcgtgacgccgtccaccacgcgcgggaggccggcgtttgcctgggccatgaccggcacacgcgaccaggggagcatgcgctcgacgatgggggcaacgtccttgggcccaagcgagcagttgacccccagcacgttggcgccaagcgacgagagcgtgacggcggcgacctcgggggtggtccccaggaaggtgcggccgtcctcgtcgaaggtcatggtgcagaagatggggaggtcgctgttctccttggcggcgaggagggccgccttggcctcggcgaggtccgccatggtctcgatgatgaagaggtccgcgcctgcggagtcggcggcaaccacctgctgggcaaagagttcgtaggcgtcgtcgaacgagagggtccccatgggctgcaggagcgagccggtggggccgatgtcggcggcgacgtaacgccctcccgcctcgcgcgcgcagcgcacggcggcctcgaagacctgcgggaccatgtcctcgccgcccagcttgggggcgctcgcgccaaaggtgttggtggttatcgcctcggcgccagcctccacgtacgcgcggtggatcgcggtgacgccctgggggtcggtcaggcacaggagctcgggcgtctcgcccgccgccatgccgcgcgcctggagctgcgtgcccatggcgccgtcaaagcgcaggaagtccctgccctgcagcacgcggcgcaggtgctcgtccctcacacgcagcgtcctcttgtcgtaggtgccaaagcggggcttgcgcctggcggtgctatccatggcaggtcctcccggtgggtcggatggtgcagaagtcaaagcaggggcagcccttgcagctgcgcctggtggatgcctggggcctggcgcacattcccaccacggcagtcacgctcttggtgggggtcatgagcagggtgggcgagagcgtgatgcccagcctcctggttgcgtccagcgcggagaggatcgtgggctggatggagagcggcaggtcgccgtagccgggggagaagcggaagttggtgtacagcccccgcctggtggcctccgccacgacgagggactccgcggcgtccgcggcgcgctccaccagggtggtcgacgcgctgtccaggaggacctggccaacgtggtcggtgagccccaggcgatggagctcgcgctcgtctcccatgcccaatgtgaccgcgaggacgcccacggcaaccgcgtcggccatgtgctcctccatggagtggcccgcgagctcgatggacgtccccctcagccgcaggacgggcgttccgtcgtcgcgtgcctcgcaactctccacgtcgaagaagtcgatggatgcgcggggccgcgacacctcgatggcccgggcgatggcctggtctatgcgctggtccagggaggggtcgtactcctggccggcgtagcccatgtagcggagcacctcgctgcggtcgacggagtcgatcgagaggtccacaatctggggcatgcggctatcccctcaggtagccgcaggaggccagcgcgtcgtgcgtggagcgtcccacctcgggcttgttcatgctgtagatgtggatgccgtccaccccgttggctgcgaggtcgcgaatctgctcgcaggcgtactccaggcccgcctggcgctgcgccgcggggtcctcgccggcgcgcgcgaggcgcctgatcaccgagacgggaatcgaggcgccgcagttgaaggccatgcgctggatctgcttcacgctggtgaagggcatgatgccgcagacgatggggaccttcacgcgggcacgcgagcactcgtcgcggaagcggtagaagtcctcgttggtgaagaacagctgcgtcaccagaaagtccacgccggcgtcctgcttgcgcttgaggttctcgatgtcctggcgcaggctgtcgctctcgaggtgaccctcgggatagcaggcgccgcccaggcagaagcccttgtccttgaggtaggcgaccaggtcgcaggcgtgctcgaagtcgatgggctcgcggcctgggacgcggtcgccgcgcagcgccagcacgttgcgcacgccggcggagcggaactcctccacgaagcggtccacgtccgccttggtggcgcccatgcaggtgaggtgggcgagcgcggtggtcctgccggactcctcgatcctacgggcgatggcgacggtgttctgggagttgcccgagccgccggcggagaaggtgacgctgatccagtcggggtggttctcgcacagctgcgaggcgacgtcagccgcctggtccacggacatctcccccttgggcgggaagatctcgaacgagaacgactgcttgctgctcaggatgtcgcggataagcacggtgggctcccctcgtggtcgcataatcctcaccatcataggttcggctggcttgagggaagccaaggcgagacgagcgcttacattgtggaaaccgcggcgtgtggctggtccgcgtcgggtgcgcccaggccctagtagagcggcagcctgcccgtgatggggtccacgtcctcggcgtgaaggggctcgaacgccaggcaggtgtaagtgggctcgccgtggaactcggtgaggccggcgtcgcggacgagcgcgaccgcaaacccgcgctcgcgcccctgtcgggcgatgtccagcagctcctcctccgagtcaacgtacacgcagacctttgccacgcccgcctcgaaccagtcgctcagggccgtgggcttgcgaccgtcgtcgtccaggtagacccagccctcgtcgggggacacgcgcacctctcccaggcgcccttcgcgcgcgagcgccatcagcgttgcctcgacgcaggcgtggcccgactgcgcggcgatcttgcccttgcgcatcttgaggtcgcgcctcatcacgatcatctgcttggacttgtaggacgagcctggcatggatcaacctttccccagtgcgggcgcgagggtttcgtccccgcgcccgcttggccttgcgttctggtgggggagggacgtaccgccatggaggtgcggcccgcgacctcgcgggcggttccctctcccctgcgtcggagcgacgctagtcctcgacctccagcagctcgatgcggaagttgagggtcttgcccgccatctcgtggttgaggtcgaaggtgatggtcttgtcgtccttctccaccacggttgccgggaagggctggccggtgggggaggtcagcatcacgcggtcgcccacgttgagctcctccgcgcccggcagctgctcaaaggtcagggtctgcaccagctcgtcgcggtgcgggccgtaggcttcctcgggcggaaggcgcacgtcggtgacctggccaacctccatgtcgcgcaccgcctggtcaaagccggcgatcatctggcccgccatgcaggtgaactccaggggctcgttgcggtcgtaggacgagtcgaacacgctcccgtcgtccagggttccgcggtagtggaccttgaccttcttgccctcgttgctcatgggctcttctcctcttgtcggcgccatcgggggcgcgcttctctggcgagttcactgtacccaagcgcccccacggcaacgggcggtcgccccagtttgcagaaaaaccttggcggcgcaggtcaggggtctgggacgggaggcggttgggcggcggcgtcgtcgttccacggacggagcacctgctccgccggcggagcaggcgtcccgtgcggaaatggggagagcgtctagggaatggagggtgcggcgagtcctgcccgggttggcattccgccctgggcgccgttgaccgcctcgagtacctctagcgaaccctgtcagggtgggaatcccgctggccaatgggagagggtgcttggggaacgtgtcgtgcgagtctccctgccggcatcgagggctggggctttctcacacacacgttcgcagagacgtgcgggcatgatgagtccaaacctcgcgggatttggcaacgaggtgcttagcggcgctagccttcgtgtgagttcgaccgtgggctgcttagcaaccctagccctcatgcgagttttgttgggctcaacctgcatgaggcctagcgtggctaagcatttggcatccaaatccacatgagggctagcgacgctaagcatcatccccgggacccggcgcattgcactgtgaatgcgccgggtcccatgcggccgctcgtgagggctgcttagaaagatcggtgcccgtacggcaattgggagggggttgtttaagaaacccggtgcctgcacggatttccgtctcccagacccacacgcgccccgacgggattaagcatttggttccaaaatccgttctggcaccaggttttctaagcagcggctcctcgccactcgtgcgcgcaccagcatttctaagcaggccggcacctcctcccatgaggggagtcttggatgacaacttcagcccgatgtgagcacatgcgttgtgctccggctgccatttcacatggtgcgagctctggtgcaaagcccgtttcgaactgctgggtgccgaggaacatccttccccggggggtcatccctgcggcggaggctcgcctacctcctccttctttgaccagtgagaaccttgccctccgcattgacctgggacccttcgctcacccccgggtggtccgcccccggcgggcttgcgcgccggggcaaccctccccgggggtcatccctgcggcggaggctcgcctgccttctcctctttctctgaccttcgataacccttgcctctgcattgacctgggagctttcgtttcacccctcgggcaatcgatccaagggaggccctcggaaggggaacgacccacgatcacggggagaggtgcatgtccgcgatccccaggtcgcccacgctgacgggcaacccatgagcgcggagagaggccgccgtgcacccctggggagacgctcggaccaagatgccccgcccctctccccttcgtcgtccgcacctgccaagatgtcgcaggtgtggtgcacgggcctctgcgtgcggtttccctagaatagtcaagtaagcttgagggaatgtatgccaaaccttactttttgacgaccgcattgcgtgagagaagcgagttgccgatgcttgatagaagactcattgggcttgtccccggcgccatgaggcgggtgctcgagacggtcctgttccagctgctggggcttgcgtgcgacatagcgctcgcctggtgcgcgagcacgttcgtggcgggagtcgtggcgtcccgcccgcccgcggtggcgcccatcgcctgcctgctcgcgctggccatcgcgggcaaggccgcctcgtccaggctcgccgggcagagcgcgtttctcgcctcccgagacgtgcggaggctccttcgcgagcaggtctttgccaagctcctccgcctggggccggactacgcgcgggaggtgccgaccgcggaggtggtccagcttgccgttgagggcacggagcagctcgagacctactttggccgctacctgccccagcttgcctacagcgtggtggcgcccctcgtcctgttcctggtcctcctgcccgtgagttgggcgtcggggctggtcctgctcgtgttcgtcccgctcatccccctggtcatcgtcgcggtgcagaaggtcgccaagcgcacgatgggtgcctactgggacgagtacgccaacctgggcgacacgttcctcgagagcctgcaaggcctccccacgctcaaggtcttctcggcggacgcccgtcgccacgagcagatgaaccaggagtccgagcgcttccgcgtggcgaccatgagggtgctgcgcatgcagctcaactcgatcgtggtcatggacgtcgtcgcgctgggtggcgccgccgcgggcatgtgcgtggcgctctcgcagctggctgccggcacgctctcgctcttcggttgcctgatggtggtgctcctctccgcgagcttcttcatccccatgcgcaccctgggatcctacttccacgtcgccatgaacggcatggcggcgtcccgcaagatcttcaggctcctcgacctcccggagccccacgactcaggcacggccgtcgccgtcccgggcgaccacctcgcgatgagccacgtgagcttctcctacggcaagggcctgggagacgcgctgggcgacgtgagcctggacgtccccgccgtgggcctcacgggcatcgtgggcaagagcggctcgggcaagagcacggtggcgtcgctgctgagcggccgccagcgcgactaccgcgggagcctcatgctgggtggcaagcagctgcgcgacttctcgcgtgaggcacttgcccgctatgtcacggtcgtccccaccaacgcctacctgttcaggggcaccgtgcgagacaacttgcagcttggcgacccaacggggagcgacgagcgcatgtgggaggtcctggcgagcgtgcggctggcagactacctgtgctcgcaggacggcctcgacacgagggtcgaggaggagggccagaacctctccggtggccagcgccagcggctcgcgctcgcacgagcgctgatgcacaactctcccgtgtacgtgctggacgaggccacgagcaacgtggacgccgagagcgaggacgccatcatggacgccgttcggggcattgcgcggtacaaggcggtcgtggtcatctcgcaccgtctggcaaacgtgacctcggctcaccgcatctacgtgatggagtcgggtcacgtcgtgggggcgggcacccacgacgtgctacttgggacctgtccccagtaccgcgagctgtgggacgagcagagtaggctcgagcactttgaccccgtcgagtttgccgaggaggaggcgcgccgcagggagcgggaggccgctgcccaagacgctgccgccgtccgggaggacggggatgccgttgccgccttcggcgaggatgcgggcgagacggacgccccgctcgcccccgacgatggcgctggggcagagggcggcgaggtgcccgagtcggtgctcgaggacgacgaggccgcggagaggctcgcgctcgcgagcctgctcgacctcggcgacgtggacgagacggacgacgacgatgaggcgggcgagaccatggtgctgggttccggcgacgaccagccggcgccagagccgggggtcacggcccagatcgaggcgattctcgccaccccgctcgaggagatggtgcgccagggggcaggtgagagggacgcgggcgactcccctgaaccgtccccggatggcgcggagccgccgtcggccgccgatgatgcgggggcggacaggccccgcgtggaccccagcaggattcccctcgtggatgggggagaggacgacgcgaacgagggtgcaggcgacgaggaaggggatggtgacgaggatgagaggcgatagccgcagggtcgtgtggaggctcctgggcctcaccaggccgatggcgggagtgatgctgcttgccatcgcatgtggcgtgctgggattctgctgcgccaccttcctgcccgtggtcgcgacgaggttcgccctcgacgcgcttgcgggctcgctcccgccgatgggggtggtcgccggggcgctcgtgggcctcgcggtcgcccgcggggcgctgcactacgccgagcagacctgcaaccactacatcgcattcaagctgctcgcgcacgtgcgcgacctcgtcttcgggaagctgcgcgagctcgcccccgccaagctcgccgggcacgaccgcggcagcctggtatcaaccatcacctccgacgtggagcttctcgaggtcttcttcgcccacaccatctcgcccgtctccatcgccgtggtgatggccgtggtcatgaccgccttcctcgcggggatctcgcccagggtcgcgctcgtcgcgctcgtgggctacctgtgcgtcggcgtcggcatgccgctgctgggcgcgcacctctcggccgacgcggggagggtcacgcgcgcgcaggcgggccttctctccggcatcgtgctggacagcctccgcgggctctcgcaggtgctgcagtttggtgccggagacgcccggatgagcctcatcgacgacgagtcccgtcggctctcggacgcccaggggcgcctgagctccgcctcgtcaacggtggccgcggcgtcgggtgcgctgatcatgctcttctccctcgcggtcatgctcctgggagggagtcttgttgcctcgggcgagatgaccgtggatggcatggcgattgcgacggtcgcggtcatgggatcgtttgggccgttcgtcgcgctcgcgaacctggggaccacgctgcaggggacgatcgcgtcgggcgcgcgcatcctggcgatcctggacgaggagcccgccgtggccgaggtcaccgacggcgaggacatcgagttctccggcgcctccgctcacggcgtgggcttctcgtatgacggcgaggaggtgctggacaacgtctcgctcgaggtgccgcagggcaaggtcgtgggcatcgagggcaagagcggctcgggcaagtcgaccctgtgccggctcttcatgcgcttctgggacgtcgaacgcggaagcatcgccctatcgggcacgcgcgtggacgccatcaacacgcggagcctgcgtgccagcgaggggctggtggagcaggacacgttcctgttccacggcagcatccgcgacaacctgctggtcgcccgccccgacgccacgcaggagcagatcgaggcggcctgccgcgcggcctcggtgcatgacttcatcgagggcctgcccaagggatacgacactatggtcggcgagcttggcgacaccctcagtgggggagagaggcagcgcctcggcctcgccagggccttcctgcatgacgcgcccttcctcatcctggacgagcccacgagcaaccttgactccctcaacgagggcgtggtcctgcgcagcatcgcacgcctgcacgggagccggacggtcctgctcgtctcgcacaggcccagcaccatggccgtcgcggaccagacgtactccatggactccgggagggtgagctagccacaggcgagaggggcctcccagaccgcccatgcgaccgccgttgcgtggaggggaggtgcccctctcccccaaggggtatgcttacgagagtgtgtcaggtgtctgcgcgggcggtggctcgcgccgcgagaaggggcggatgtgtctaacggcgacttcgttggggtcttcgactccggtctgggcggcatcagcgtgctcaagaggctagtggccgagcttccgcacgagcgcttcgtgttctttggcgactcggccaacgccccgtacggagacaagccggtggagcagattcggtccctctccactggcatcgtcgaccgcttcgttgccgagggggccaaggcgatcgtgatcgcctgcaacaccgcgacctccgcctcggccagctacctgcgcgagaaatacctgagcattcccatcgtgggctgcgagccggcgctcaagcccgccgcgctcgccccgcggcaccgtcgcatcctggtgatggcgactgcggcgacgctgcgactgcagaagttccgcgacctccgggaggagtgggggcgcgagtctgaggtcatctgcgtgccctgcgtggggctcgtgcagctgatcgagacgggtgaccttgactcccctgagctccactcgctgctccagaggctggtgggacagtatcgcgggcaggtcgactccgtggtcctcggctgcacgcactaccccttcatcaagaggcagatcgccgacgtcctgggggacgtcccgttcttcgacggtggcaccggtgccgcccaccagctgggtcacctgctgagggagggcgggcttctcgccccggatggcgccgagggcggcgtcgagttccgctccagcaagagcaccccgcaggagatcgagctgtaccagcacttctacacgctcccggtgtagccccggctgggctgctcgctgaattgatacggggcaagcgccattctcatcgtctcggcccattcgctcaatctcaattgagtgcggttccggctgacccgctgacggtccgtagcgctgacgtttgtccgtcttccaatggcagcaaactcctgaggtgagcgcgcacatcgggagcttgccgctattggaagacgggtcaacaacatttcggcagtaaatacgattccaatagaccctcttagttctgttgatggtaacgggagcccgatatgagcacacgcatcgggagcttgccgccaaacgaggacccttcttgcgctgaatggcagagaacgactgatatgagtgctcatataaggcagttgtcgccagggagagcctcccaactgcaaagacacgctgtcgaagtcggcgtgagctgcgggtatgctgacctcgtgttggctgatgaatcgacacgagcgcacacatcgggagtttgctgccgcctcgacctcctcccgcaataacatgggttgggttacggcaggagcccgataggggcactcgcatcgggcgcctgctccccgcggtgagcgtctctcaattctgcgagcgaggtgtgcgtgtcaaatcatgcatcgtgcacagttcctctggaagtgcatagatgggccgtctgaaggctcccgtcccatagctccagggaagtagttctccaatcaacttggtgcgcgcttggaggcagcccgcgggcggccgacgtagtcgcagcccatgtagtccggcaactctccttaccacagacctcagttgagtttgattgagcacctgttcgagtgcaatcgtctgaatcgtgatcccctcctcgcttagtgcaagctcacgccgcaggtcacgagcaacatcggtgtgatactcgaaaccgttgtactcaagcccaaatcgaatctgcggccaatagaggtcgattatgaaatgatccgtctttgcgattgcccgcgccgctcggccgagctcgaccctgtggttgagctcgggccttgggaggtggtagcctccgtctcgtcggtccatggtcagcaggagcgccgtcgcggactccattggggagcgagatccgcccaatgccgtcctgacgggttttctgcagagctttgttcccctggtgtgtggcgggacgagggcgaggaacctctcgattgaggcaatgcttgtgattcccttggtttcgacgaagcctttggggcagtccgccgggaagtacctccccgcaagggagcaggtgagaagtgacagttcgatgggcgtgagcgatggcgccatctgcgtgacacagagctctgggctgcagaccagcacgttctcatgcactcgtttgaatgctccgtggggcatcctcattccaaggacgtgaggatgtgcgccgtgaatggaatgtcgctgctgcgctgaccgtacgagtacatcaatctccctggggaagctctccatccccagaatctcctggactgcctttctggcggcggaaacctcctgagagcgcatacttgcccggcagtgtgacgaatcaggggcctcaaacgactcggccctaaccccgcattgtgccagtgacgcccagatccagagcgcggttgtgtgcgagatgcacaccatgccttctcccgccattacgagaccacctttcctcgagcctgccgttgcaccatcatcgcaagcgatatttcgttggagattgcattagactttcaatgggtgcataaccgttatgaaacaccaggtaaaagcagtaaaatcaattacggcaatatctgcaatcaatcaaaataacataaattattactatctgctaggagggaatggtcttgcgactccaagggtaatgggatcgagaaatgcgatggactttgtctcgactctcctcaaacacggggatgggcgggggcgtcgaggttaggtattgcgcgtgcaactgaggtttggaacaacaaaggattccctataaaagatcaaagaaggggggaggaggcagtccacggagggccaggagcattgtgtctggtcggaagttgactgagcctagctgctcatcatgtgggatggcggctcgtgcgcatcttgcggtcgccgctacacttgagtttccaagtcgaagggatcgcgcgcacgagcgtggtgtaagaaggcacatcacctgctgccgacgctgccagaatcctactccttcttgaggccgcagctctcggctatctccgagactatctgtgcggccctcctctcgattgcctccctcccctccccccttcccccccctcgagggggcctccctgggtccggggtccctgaagccgagggcggcggactcctcgctgaagacgcgctggtgcccagctcccctcctccgagagtatgaggccacgctcaggcgcacatcgactcgccgagggaaaggactgccgacccgtactacgcttgatctcccggttcgccctccgatgcttctattggtgtcaacgccgtcggcggggtcttcctgcatccatcgggaagccatcgtcacccactttctgtaacggagcgcgagtctctaaactggtggtgccaagctcgaggtcgcagagggtcgaggccgtgacccccagcgccttcgccccgtcttctgcgagacgccccgcgccatcctgcctccctcagcccgggccctttccctccggagcctcccgggattcgtcatgagccggtacggcctcggccgttagcgcgcttggcatcggctatctctcggtcggagagcccctcgtcccttcgcctctccacgtaggcgatggtcctggaggtcggtgcgcatcctgttcatcgcgatcagggggggcatccggcgggaccggccggaggggagcggggtggacggaaaagtgcacgccctgttcccccccttctcaccgccgcgttgagccatgcgcctgacctgccgctggaggcctctataatgcgccgcagagggcggcgaacgaggcctccgagccatcctccctgggttgtcgccggcggccatccgcgacgcgccgcggccgagagcccccgccgcacccgtacatcgcgcggcggcgcgggtttccctttctgacggcgtcggctaatcgcccccttcggtcccgggcggacagcgctgggcgacccaggccttccccagcgccctgagcgagaccatggccgccctctcgacgagggcggccgagagcatcgtcctcccagacgcgcacgcgcgcatgatgccaaagagaggataatcgtagcacgaagcggcaaaacaatgcgggcctacgaagagcaagacgagagggagcgagcttaatggacttaggtcggaaagccaggaagaaatatgttcttcctgattgcgaagttgcacgatgtccgggccctgctatggcgagtaggggcctcttcccaggcgcaggcaatggcggtcgccgaacccagagtccctccctggcgactagagtgcctcacctcctcgccccgtcctgggacttcggcgccaggtcatcgcccgagagcaacctgcctggcggccctgacgcgtccgccgcgtcgtccttgccggcgctgctgcctcctgcggctcctcgtcgggaccaacacgatcctcgtagcacgcgacgaggccctcgtgccatctccctcgcgagccccgccccgaagtgcccgtgcactgacgccggccgccacgagcgtcccgagcgacgcgcttgcgctcgcgagatggacctcgctatccctccgcgccggtggggaactccccggagaagatctcggccccgaggcggtcgacaacgctcagccagttcgtgtcggcgtgcgtgtcgaccggcccacacggcgtcccgagggacgccgtcccatctacctccatgcccatcacgtccaatccgtcttcggcaccgggtatgattcgacatgccccgcggccgcggacagggctccgatggtgacggcgccctccgcaagaccgccgcgcccaggcttctatcaggtcacagcagccgcgggcacgccggccgcggcgggacatatcaagaggaggacagccccgcgacggacgtcaatcaattgtggggtcaccacccgcgccggaacgaaccatagaccagggacaacggctcgtcgccccagggcctcttcgattatcgaggacgtttgtggtcctgagcttcgcccagtgggcctcggggaacgcctggaaggcgagggccgagtcctcggccgcgggaagatctccgcgcctttgggagggccctcctgaccgggctcggcctcctcccagatggccctggagagctccgggtccctctcgtagcaggccgcgtgcacagcccgtcacgcacccttggaggcctcgggcctccccgccatggcggacaggaggttcctctgcaggtgggtgatgcagcgctgccaggcgcatccctgcagctggcgcgctataggccgccacgagccccgcatggcgtcgagatgacgacctgacgccccggagtccccgcgccttgaggcccccaggaagccgttccagccctcctcgctctcggtgtccatggcctcgacgcccaggacgtgcttgcgcccgtccgcgcccacccgatggccgtcaccacggcgtgggaggagacgacggagtcctccctgcagctcatgtaggtggcgtccagcctggtagcagcagggcatccgggagaggtcgcggctcctcagggcctccacctcgaggtccagctcctggcacagcctcgagacctcagagctcgacaggaggagatgccggcttctcggctaccctctccaccttccggtcgagacccccgagacgtcatctcctgcacgagccggccaccgaaacgtccaccccgaccagcgggtgagcatctcctcggggaagtaggagccctccctcagcttggggatcctcatgctcgacgtcccccgtggcggtcctcagggtgcgcgcgctgtagccgttcctgctgttggtgcgggctgcgtgcgctcgccccggtgccgccccgcaggcgagctggcctgctcgtccatcaccgcgttcagaccacgacaggaccctgcatgcgaactcgcgggcgtcggcactcgttccagacctggaagtatagggcctcctcgaggccatcggcattacactctcatcgaggacatcgtcttcctttcaatctcctttcatctttacctgaagcaacgacggattgtaggcgatgtccctcatctgcccttggccacaagctgtcgggtcgggggcacgaggccccgctccccgccagctcttacaccacgtctatgcgcactaccgtcgaaggacttcttcttcacgattgtggctgtagatacggggctctgaaggcaacaggagcccgatgtgagcactagtcccggggaaacgctacgtcgaaccgagcttttcatattgtgagctgagaaaacgttagcctctccccgttgctttggcagcaaactcccgatatgagtgcgcacatcgggagtttgctgccaaatgagagcccttcttgagctgaacggcagagaaggactgatatgagtgctcatatcgggcagttgctgccagggagagcttttcagctgtgaagacattgggccgatggcggcgtgagcccgatatgagtgctcacatcgggtcgtagctgccaggaggttggaatgccccgtcgcctgacgtccaggcgcggatccccaggtccgtaagcgttcgacccgcccccttctttgacttggtcaagctgcgaatggagacgcgcacggcgaaaggggaggacacagccggacattcggggaggggggttgcccggggcaggaggaaggtcgcaacggccggtaccctcgccgtgactgaagggctggcgacccaacgggggcgcgagggggtgaagccggcgtgaatgccgcgctgcagccggcacctcgcccgtctcgcccaggtcgcctcgcgcagaaaaagggaccgccacctcgcgggtgacggtcccagggcagaacgaaagccaaacaagcggcaggagcctacctgttcatggcctcctcgacggcgacggcgcaggcgacggtcgcgccgaccatggggttgttgcccatgccgatgaggcccatcatgtcgacgtgcgcgggcaccgagctggagccggcaaactgggcgtcggagtgcatgcggcccatggtgtcggtcataccgtaggaggcggggccggcagccatgttgtcagggtgcagggtacggccggtgccgccaccagaggcgacggagaagtacttcttgccggcggccaggcgctccttcttgtaggtgccagcgacggggtgctggaagcgcgtggggttggtggagttgccggtgatggagatgtcgacgttctcgtgccacatgatggcaacgccctcgcggacgtcgtcagcgccgtagcagttgaccttggcgcgcgggccgtcggagtaggggatggtctccacgatcttgagctcgctggtgtagtagtcaaactgcgtcttcacgtaggtgaagccgttgatgcgggcaatgatctgggcggcgtccttgccaaggccgttcaggatgacgcggagcggcttcttgcgggccttgttggcgttgttggcgatgccgatggcgccctcggcggcggcgaaggactcgtggccggcgaggaaggcgaagcactcggtgtcctcgcccagcagcatggcgcccaggttgccgtggcccaggccgaccttgcgctcgtcggcgacggagccgggcacgcagaaggcctggaggccctcgccgatggcggaggcagcctcaggggcggtcttgacgcccttcttgatggcgatggcgcagcccgcggtgtaggcccaggcggcgttctcgaaggcgatggactggacgccaaacacgatgtcgcgcgcgttcacgcccttgtccaggcaaatcttctcggcatcctcgagcccgttgatgccgtagctgtcgagcaccttgttgaccttgtcgatgcggcgctcgtaaccctcaaacgtaactgccatggtgttattcagcctcctcttcttctactcgtggacggggaacttggactcggggtcgtgggtctcctcgtcggtgcgggggtcgatgaacttcacggcctggtcccactggccgaagtggcccatggccttgtccacggcctccttgggatcggtgccggccttgacggcgtcggtgaacttgcccaggttgaggaactcaaagcccacgatctcgtcgttcttgttgagggccatgcgggtgacgtagccctgcgtgagctcgaggtagcgagcgcccttggccttggtgccgtacatggtgcccaccatggagcgaaggcccttgcccaggtcgtcgaggccggtgcccacgggcaggccaccctcggagaacgcggtctgggtgcggccgtagacgatctgcaggaagagctcgcgcatggcgacgttgatggcgtcgcacacgaggtcggtgttgaggcactcgaggatggtcttgccgggaaggatctcggcggccatggcggcggagtgggtcatgcccgagcagccgatggtctcgatcaggcactcctcgacgacgccatccttgacgttgaggctcagcttgcaggcaccctgctggggagcgcaccagcccacgccatgggtatagccggagatgtcagaaatctccttggcctggacccacttgccctcctcggggatgggcgcaggaccgtggtatgcgcccttggtcacggggcacatcttctccacttctgcggaatactgcatgattctcctctccaccacaacggcgtccgggccctgtcccagacgcacattcggtgccacgccgtccccctggatggcagggcaccgccggcaacatgccagacacattcattttaggccagcggatgcaaggccgtatccgtgaacggtgacaacatccaaaatagggggtggccctttattcactggtcaacttgatgggggcgtcgttattcacatccaagataaccctgacgccgggggagcgtgccgcgaccaaggggagaggggcctctcccccagctccggaccgtgtcgccatggcgtgcctgctacaattcggcgcatggaaatcaggcatccgcgcataccgacctggggctaccaggtcctcctcgccacggtggctgccatctggggcggggcgttcatcgtcctcaagggggccctggggcagatgacccccggctggcttctcaccctgcgcttttcgctctcgaccctggtgatggtcgcgatcttctggcggcgcctcgctgaaaacctcgactggtcccacgttttggccgggctcctcatcggcgttcccgagggcctcgccttcctggtgcagaacgtggggcttgacggcaccacgcccgggcgcaacgcgttcctgaccaccacctactgcgtgatggtccccttcatcaactgggccgtcacccgccatcggccccatgccaacaacgtcgtgggggctctcctgtgcctggtgggcgtcggcttcctctcgcttgacgggagcatggggctctacctcggtcgcggcgacctcctgaccctggcatccgccgtcctgttcgcgctcaacatcgtggccgtgagcagggtggggagcgcgcacgacgcggtgaccatgaccgtcgtgatgtttgccgtgagctcgctcatctgcctcggctactccctggccgccgagcccgcccccgacttcgctgccctcacgcccgacttctggggccaaatggcctacgtggttctcctctcgtccgtggcagcgctcctgatccagaacgtggcgcagcagcacgtgcagccggccaaggccgccctgctcctctcgctcgagagcgtattcgctgcgttcttcagcatcacgctgtatggcgaggccctgaccccgcagcttgccgttggcttcgcgctcatcttcgccgccgtgctggtgagcgagatctgggtgggcaggcgcgccacgcgcgaaatagagtcgcacgaagtgcccgcgagggactaacctaggagtttgcacccttcccgccaacggaacggcgggggagaggggcatgactcgcgggaggcgccattgatctctgagatcgccctcaacaaggtctgtaggccggcaattctcggccgcggtcgcatcatcgcccagcgcggtgcgagcatacgcgaccgggagtgctcgtacgatgggggcgtcaccaggatcaggggcaaggtcgcgtcgtcgtcggggtacgcggaccactacgacgcgaccatagagttcgacgaggcggcggacacggtcctggacttcgactgcacctgccccgccgccgcgcgctaccccggcccgtgcaagcacagcatcgcgctcgcgctcgacttcaaccgcgacccctccgggtaccgcggctacgaccggctacagcatgcgagcacgtccaccgtgctgggggaatacctcgaccgtgccgccatcgccgcccgtccccgggtgggcacctccacccccgagccgccggggggaatccgccttgagcccacgctcgtgcacgaccgcgacctgttcctgcggctgcgcgtgtgcgggtcgcgcgggtcgtacgtcgtgcgcagcctgggagacctcgtggcagacgtctcgagcagggcgttccgcgagtatgggcgcaagctcgccttcgtccacgagccggacgccttcgaccagcgctcgcgcgagcttctcgacttcctcgcgcgctgcgtgcagaaccggcgctcgtacgcgtcggagcgcatgtacggccgcgtgtacgcctcgagcggccagtcctcggccatgccgggccgcgagctcaggctctcgggtcccgaggtggacgacctcctgcaggtcatgctggagggcgagctggtgtttgagtcctcctcccaggatggcgggtaccatgccgtcaccgtgcgcgacggcaaccccaacgtcgccctgaacgtggtggaggcgggcgacgacggctttgagctggtccgccgcgggaaggccgagttcttctccggtgggtcgcgcctgtacgccgtgcagtcgggcacgctgtttcgctgcacgccggcccttgccgcgcaggcgtcgttcctcaccggggtgtacgacagcaccacgccgcacctgaccctctcgcagaaggacgcgccccgctttgccgcgacgctgcttccgcagctcgagcgcgccatgagcgtgagcgttcccgaggaggtcgcgcgcctccgtcccgtcccctgcaagctggagttctacctcgactttcgcgacgtgggcgtgacctgcgacgtccaggcggtgtatggcgagaggcgctatcacgttctcgcgcgcgagctggggcagcacatggacgtggggagggacgtggctgccgagacggacgctcgtcgtctggcccagcgctacctcacggtgggcgagggcgccatcgccaccatccccgccaaggcggacgtgcccatcgcccggctgatgttcgagggcgtgccggagttctcccgcatcggctccgtgtacaccacgcccgagttcgaccgcctcctcaaccgctccaagcccgaggtcaggctcaagctgtcggtgcgctccaacctcatagacctgtccgtctcggccaccgacctgccgctcgacgagctatacgcgctcctctcgagctaccgcaagcgccgtcgcttccaccgcctgcgggacggctcgttcctggacctctccacgctcgacctgggggaggccgagcgccttgccgaggagctgggcctctcgtcccgcgacctcgcgcgcggccacgtgagcgtgccgtcgtacaaggccttcctgcttgactcgatcatgggggacgacgagaaggacgcctcgttccgcgactacgtggagtcgttccgctccgtggacccctcgcactaccagcttcccgccagcctgcgggggagcctgcgcccataccaggtcgcgggcttccagtggctgagcgccctgtgtgacatgggctttggcggcatcctcgccgacgagatgggcctgggcaagtcggtgcagctcatctccctgctgctcgcgcgccgggggagcggccccacgctcgtggtgtgccccgcgtcgctggtgtacaactggcaggccgagcttgagaagtttgccccgcagctggacgtcgcggtggttgcggggaccgtccccgagcgcgcccgcgtgcgcggcgagtcgcacgaggtctacgtgacctcctacgacctcctgcgccgtgacgtggagagctgggcgcggatgccgctctggtgcgaggtgctggacgaggcccagtacatcaagaaccacgagaccctcgccgcccgcgccgtgaaggcgctcgacgcccagcaccgctttgccctcacgggcacgcccatcgagaaccgcctgtccgagctctggagcatcttcgactttctgatgcccgggctcctgggctcctacgaccgcttccgcgagcgctacgaggcccccatctcggagggtgacgacgaggttgccgagcgcctgcgcgaggccgtcggccccttcgtgctgcgaaggctcaaggcagacgtccttcgcgacctgcccgacaagctcgagcaggtggtgtacgcgcgcatggagggcgagcagcgcagcctgtacctggcgcacgagcaggccctgcgcgtctcgctcagcaagggcgacgacgactcgtttggcacccagaagctgcaggtgctggccgagctcacgcgcctgcgccagatctgctgcgacccccgcctgctgtacgaggactacgacggcccctcgtgcaagctccagaccatcatggacctggtggactcggtggtggacgcgcagcagaagatgctggtgttctcgcagttcacgagctacctggacatcatcgcgggcgagctggacaagcgggacgtgccctactacaccatcacgggtgccacgcccaagaggcgccgcctggagctggtggacgccttcaacgccgacgacacgccggtgttcctgatatcgctcaaggcgggcggcacgggcctcaacctggtgggcgcgtccgtggtcgtgcacgcagacccgtggtggaacgccgccgcgcaggaccaggccactgaccgtgcgcaccgcattggccagaccagggacgtgaccgtgtacaaggtgatcgcgcgcgacaccatcgaggaccgcatcctggcgctgcaggaggccaagagcgacctggcggaccaggttgtgggcacggggggcggcatgagcctggggtcgctccgcaaggaggacctcatcgagctgctgggagactagcgccaggtctgccgggcgacgggggagagggacgcacctctcgcctgccgcccgtcccgctggcgcgtctgccttgcgggagatatgctgttccatcgtgcgtacggtcgtctgttgggggttgtcgtgatactgctcggtgcgttggtgaatggtctggaggctgccgccggcggcatcattggcctgctgttcaagggtcgggtctcggacgacctgggagacttcctcctgaagggccagggcctcgccgtggtgctggtgggcgtccagggcatggtcaacggcggcagcgtgattgtggtcaccctcgcgatggcgctggggtgcctgatcggctaccggctggacatcgacggccacgtgcaccggctgggccagcgggtgcagcgcaggctcaacgagcggtttgcggggtcggagcgcctggggagcttcagcgagggctttgtggcggcgacgctcttcacctgcacgggtgcgatggcgatcatgggctccatccagagcggcatccagctggaccactccacgctcgtggcaaagggcctcatcgacctggtggtctgcgtcccgctcgccgcgaccatgggcataggcgtgccgttctgcgggctgtcgcttctcgcctacgagggcgcgctctccgcgctggcggcgctcttggggagcgtggtcaccaaggcgatcatcacgcaggtcgtgtgcacggggtcgctcctgctgtttgcggtgggcaccaacctcctcaaggtgacggacatcaaggtggccaacatgctccctgcggcgttcgtgcccttcgtgctggtcccgctcatgcagatggcggggctggtgtagggctggggctggcgagcccatcgccttgcgcgtcatgggagagaaggcccggggcccgcggaacgctgagtcgctccacgggctccgggccatgtgtgtcgcttgtctctcgcctggctacagcgtggtgccgaaccacttcttctccagttcgtccaggctgccgtccgacttcatctcctcgatggcggcgttgaggtccttggtgagcttggtgttcttcttgctcacgacgatgccgtactgctcgcccgtggcgatggagatggcgacggtcaggtcggtgtacgacttggtgcacatgtagctcgcgacgggcaggtcgatcacgcaggcgttgtagaggccgctctgcacgccggtcatggcctggatggcgtcgtcgagcgggacgcaggtggcgttgggcaggttctccttcacccagtcctcgccggtggtgccggactgcacggcgatcttcttgtcgctcttgtccagtgcctcctgggtcttgtcggtggcgctcttctgggtcaccaggccctggttggagtcgaggtacgactcggtgaagtcgatctcctccttgcgctcgtcggtgatcgtgaacgcggagacgcccacatccgccttgccgccctgcttgatcatgggaatgatcgtgtcgaacttggtgggcgagagccacgtcatctcaagcccgagtttcttcgccagggcatccatcatgtcgatctcgaagccctcgggcgtggtggagccgtcggggatggactcgagcgggggatacgccatgtccgagacgcccgtgagcttgcccttggtcacgaggatgtactcgcttgcacccgacgcgctggagtctgctgcggcggcgccggagtccgaggatgatgccgacgaggacgaggccgagctcgagttgcctcccgagctgcagccggcaaggcccatcgcgaacgccatgccgagcgcggagccagctcccttcacgaatgccttcctggtgatgttcctctcgttcgaagctgtcatggctcccaccatcccttgtcgtccctatttgcttggctgtcagttgcgcgcccgggggttgctccgtgcgttgagtgcattgtgccgcttgctttcagggtgggtaccgtcgtcgcgtccaccgtaactgaaaagttataatcaagactcaaaacgtaaaagaaagagaataaatagctcagtatttgcacaatagatagagaaaaagatagggcccacgacattgtcgcaggccctatcggcaccgccggcgttggagactgggagcaccggcggaaagggaggtcgatcttggagttaggaggagatgacggagccgaaccaggtcttctcgatgctgtcctgcgtgccgtccgccttgatgtccttcagcgccttgttcacggccttgagcagggcggtgttgttcttgttgatgaccgcgccgtactgctcgcccgtggggatctctccgccgtcgggaatctcgaggtcggagtaggcaatcttgatctcgtactgcgtcacgggcaggtcggcgacgcaggcgttgtagaggccgctctgcacgccggtcatggcctggatgatgtcgtccagtggcacgatggtggctttgggcaggttctccttggcccagtcctcaccggtggtgccggactgaacggcaatctgcatgccgcttgcgttgagggcgtcctgcgtggttgccgaggcgcccttcttcaccacgatggactggttggagtccaggtaggggtcgctcatcgcgacctcctccttgcgctcgtcggtgatggtgatggcacccagcgagatgtcggccttgccaccctgcttgatggtggggacgatggtgtcaaactggacggaggggaggatgttctccgccaggttgagcctcttgcagatctccttgtacatgtccacgtcgaagccgacgaagtccttgctgtcggggtcaatggagacgaacggcgggaagttgaagttgctgatcatcgtgagcttgccatcgttgaccaggttgtagtcacccgaggagctggaggagtctgacgcggaggagtccgagcctgagctcgagtccgtgctgctgctagagctgccggaggtggagccgcaacccacaaggccgaccgtgaggccaaggccacagacggcgaggaagtcgcgacgagaaaggtttgccttcatgctagtgtctccgtcccttgttgcttgcacctgacgcccggtgtctccgtgcgttgacttagttctattgtcgttgcggcctcacgggcggccgcattccccatccgtaacaaaatggatttggaaatgaactaaattcgcaaacctccgatacgagctgaaataaatgtagattcatgcatacgagagatgcgagcgtacattcatccgactcatctgccatggggtgtcggctttggagaaggttgtctcttctctcgcctgattgcgtggtgtggacccgtcccgtgtaggtttggaatgcgggctcgtggtctttcctccccttggtcggatggtgcgtcgcccgcccaataagatttgacgcggttagggtgtcataaacgcgtcaagttttactgaactcgaaatttcgtaaggattgacgcggataggtggccctaaccgcgtcaaatcttatggatcgcatggggagcccgggtcgagggcacgccaccggccgtggtccccgacggagcctgctgctcaggaatcttgagctgtggcaatcgcaagggggatggtggacctccagaacgccgagggtgctgaggaatcttgagctgtggcaatctggagggctcgccagatgaggaaagcggagttttcgcggcgtgtgcccctcattctgcccccatttcctgccaaaggttgcggtttctcggcggttcccgtccgcggattgccacaactccgttttcctcagcagcccctaggcgagacgttcgatcgcactcgcaaggaacctacccgcgccgggtgcccaggcatcgtagtaggcgaggaacctctcgtccgcgaggtacatctgggccagcgagcggtgtgcctcgggggagtaggtcccctcgggccagaagaggccgagccacgccgcgtgcgcccgcaccgccgcccgggcgtgcgcatcgtcttggtcgccatccgcgaggcccgcgatgacctcgtcgcgcacttttgcctcaagctcgccggctcgtttcaggtcctcactgctcagccccatgaaccgctcgttcgacgcgtcgaccacctcgttaccccatcgctcgcgggcctcggctccatagcgtgcctcgttttggtcgacgagttcctgcttaaatgcctcgaacttctcctccgcgcccatcggcgcacctccgtccatctctgcgagcgatcgctccacgctcctgatgatcccctccaggtggtcccgccgcgtcctgagcctcgcgaggtgtgacgcgagcgcctcccgcctgtcgaagtcggggctgtccaggatccggcggatttcgggtaatcccatctcgagctcgcgatagagaaggacctgctgcatgcggtccacctcctcgcggccgtacacgcgatagccgttggccaggcggcggggatggatgagcccgcaccgctcgtagtggtggagcgcgctcacgctggtcccggtgagctcggcaaactgcccgaccgtgtaggactcctcgttccgccctgctcccatgccagcctcctcctctccgcgagccccggccttctggcagagatggtaaggcctcaagcgacttgagggtcaagcggggatttgtggcgggtgtggggtccgtggtacgcgggggctgtcgtcggacgtggctcgccaaggcctcgtcgcggtcatgcgcctggtgtactaggtggtggaggctctcggcggggtgtttgcgagggggcgggcgagacatgccttggtcatggcagcggggtgcatcctcccggcagtgagccctctccgtggtgtttctctccctagtcctcgaagatggcccagacgcgggcgggcagcccggtcgcgccctcgatgcggggtacggacgcaaagaggaccgctccggtgagaggcaccttgtccaggttggcgagaagctccacctgcaccttgccgcgcgtgaggatgtagcgctcggccaccaggtcgccggcgcgctcggctcccacggaggcgtcggtgtccagggtctcgtgcccaatcgcctcgacgccgcgctcgtccaggaggtaccggatcgtctcgaccgtccagcccggggcgtgctcgcccccgttggcgtccaggttcgcgagggcgtcgccgtcgggccagcgcttgtaccagtcggtgcggagcgccacgaacgagccggcgggaatcctgccgtgcctccgctcgtgctcctcgatgtcggcgatggtcagctcgtagtcggcgtttgcggccgccttgtccgagatgtcgatcaccacgagcggaaacaccaggtcacgctgggagtagtcctgcgaaaatgcccccttggggtcaaagtgagcgggaaagtcgacgtgcgtgccaaactgcccggggaacttgaaggtctgtatcagcgccgacagcacgtcggagccaaagtcgttgatcaccgcccccagctcgatcgatccgtccgggaagccgctccagtaggggctgtcgttgttcacctggtgggacagctccacccaggagaggttcttgagttcgttcacggatgtccagaggctcatcggtcttcctttcgtcggagtggttgcaagctgcgattcgaatgagtggttgcgtgcgaatgtgcgattgcacaaggcagtcccatggcactggggatgtcaccgcacggcgttccgagtctgtggcgcggtggggtgggtgatgggcgagaggcacgttgcctcctgccgtcgtcttcacattcgggtgtctatggggtggccgagccagccaacgctggcatgtggggccgggacgtggcgagggacgagaagggaccctcgggcagggccctgggagcatggcgcggtgtgtctcacctgtgcctttgcctagttggccctgtgccgcgtcccgcacatcattcgagtgcagggagcggggcggcacgcgttggtcattcgtcccgtcgacgcgatggactgtggcatgtgcctcatggctccctccgttctgcactcggtccttcaggttgcggaagatgctactggggaagtgggatttggtcaaacgcatggttccgatgacgggctatctgcgggtcatatggcggagacgagtcgcccgccagtggtcggcgatggggcatcctcccgatgagtccccgtgtttcatgaggtccgcgcgcgtgggtgccgtcgaccgtggcttcccccataggccactgccaggggagagaagcgccggccccaggttgcggctaatctcccgcgggctccgtggccccgtcggccgtaccgcctgcggttgcgtgcgcgttcattgcgggaacgccggcccctgagctgcggctagtctcccgtgggcctctcgttcccgcggtgcgagagcctcgccgcacgccacgtcacgaacctctcgaagtagatcttgaccagcgcggcgcacggcacggccacgaacatgccaagcacgccgcccaccttgccgccaacgatgagcgcgacgatcacgacgatggggtggacctccacggagtcggccaggatcttggggttcacgatctggccgtccacaaactggatcaccgccagcacgatgaccgagaccacaaacgtggtgaggtcggcgccgatcaggcacgagagggccgtggcggcgtatgcaacgatgggccccacgtaggggatgaggttgccaatgcccgtggcgatgccgatgaggaccgcgtacgggacgtccaccaccgacagcgagatggtgaccgcgatgcccatgagcagggcatcgacgaactgcccgcgcatgtatcccgtgaacgtgcggcggacgtcgtcggcaaacgtctgcaggtgctcgtaggcgctctcgcccagcatggagccgagcgcccggcgccagtagtcggccaggttccgggcatcgatcagaaagtagacgcagatcaccgtcgcgagcaccgtgttggagaggaagtccttcacggcgtcaaagctcgatgtcacggtctgtcccaggtttccgcccgacgtggcaaagacgtgctggaggctgctgagcgcggcgtccacgtccgcctggctggcacccagcgacagcgcggccttctcgattccctgaaacgccagggacatgctgctcttgacgtaacccgccagctcggcgaggttgccaaacgagattgaccggatgctgttggtcacaaacgcgaggatggccgagacgatcacggcgaccaggcccgcgacgaccagcaccacgataacgaccgacagcgcgtgtcgggcgccttccgaccgcgggaggatgcccacgcgcgcgagcgaggcgtcgacccgcgtgaccgccggccacaggaggcacgccgccagcccgccgatgacgagcgggttcatgatcgcgaggacccatgcgccagcgtttcccagtgccttcccaatctgcggcaggtagatgcccacgttgacgacgagcaccaggacgatggccgtcgcgatgacatagcggctgatggtcgagtacctctcgttgtcgaggccaaagtggctcacgcgcacctccgtgttggtctgggcgtttgtcgcccccggtcgcatcgccgtcaaagacatgcggcgatgccgccccagccgagatgggacgtttcctctcagcagtatcgcgacgccagccgcgaaacttgtaaggaatgtaccagagaagcgaaaaggggagagacaagcgccgcctgggtcggacgcccgttccgtcggcatcacgggggcccagactgcccgcgcgtctcgcccgtcggatggggagggggctcctcaccccgcggattccccggctggcccggattccccgaggtctcccatgccgcccgcccccagccggcccagactttcccggttccctttcctgccccagccattccgtaaggattgacgcgtttagatgtggcctaaccgcgtcaaatcttacggaacttcgaatcccataagaaaagtcgtgtaaatcccctcttgcagtgagttggtgttttgggttcccgtcattccatctagtagaattgccgcgagggcccaaccatcacacgagagcgcgatggtgggcggcggcgctctcgtactgtggttagtcattctggcgccgtcgccgacaacgcggcgaggactaccacacccatgcacgagagatggcacgcgcctcggcgtccaccacgctgggacggtgccgacgagtcctccctgacgccggccaggcgtcgtgatgggatggcagagggagcagtacggctggctccaaaggtcgggggcgagctcgacgcggcgttcctcaacgcctgcgagcgcgactcgtgccagggtgcgggtccgggaggatagcgatgtacggccacgaccgcaggggcgtgcgccgctgggcctgcactgccgcggcaccacttcaccctgcgacggggacgatcttcgaggacaggaagctcccgtgaccgcgtgggtggagttcgctcggatcatgtccttcgagagctcgcgggcatcgcgaggcgcgaccgcaggtcgcccaccccccggcataccagctcgccaagtgttcatggttctcgacggcatccaggacgccgtggtgctctcgggccgcgtgcaggcggacgagatgatgtacccggtcccggctgccgacagggaccccctgctggcgggcggagggccggcggctactcgaggaacaaacacgtgcatcgcgatcgcctgcgaggagggggagcacggtcggcggtctccggtcctggggctcggccaaagacaaggattaggaggtattacgcagtactggggctaggcaacggccgagcgcggagcgcgccaaaagggggggcggcgtactgcccgcacatgtcccgcggcctcgtgcctcgtccacgacagggagaaccgcaaaaacgccgtggtgcgggaagctcggggggggctcgtgagcgcgacgtatttagactcgcgcgaggcaagatgcttcccgacgaggagaacccgctggggaagtcaaaccgcctctgcttctgctcaggctctttcctcgccggcccacgggcttcgaccgacgccaattccccgggtggctcgactcttctcgggatgatgaaccaacccgaaggacaggctggataaggtgctgctcgaccgggcaatggcctccccgaaaacgcttcgatacagggacttctaccgacaaacgccaagctcagacgggtagcaggtcaatggaacaccaactcactgcaagaggggatttagtcgtgtttagagggggtctaaacgcgagaaatcttacgagacctacttccgggctccgcgacggacgccgggggcgccggggcagacgggtgaccgccatcgtcgagtgccgggggagatggtcggctgccttagtcggatcctgggggagatgggtgccggaggaaacgggcgccgggggagacgggcaacggccttggccggggcaccctcccatggcgcaccggctactccgcgtgccggcggcgccactcgctcgggctcatcccgcaccacgagttgaacgcgcgcagaaagctgttgagctccagataacccagcaggtacgcgatctggtcggtccccatggcggtggtgcccaggtagtgcttggcgaggagctcgcgcgtgtggttgagctgcttctggaacgtggtcccctcgttgctcagcttgcgctgcaggctcctgcgactcacgcccaggcgccgggccacgtcgtcggagccgcactccccggcggggagcatctcgaccagggcactgcgaacgcgcgcggcaaacgactcgtccgcctcgagctcggcgaggcgacgccccagctcggactcaaagtagctccacatggcatcgttgtgactcacgaacggaatgtccatgtcggcagagcggaagccgatgacgttgcgtggggccgcctccacggtgcggcccaaaaactctgcaaacgcgttgtcctccgggggctcctgcatctgggcggacgtggcgtcaatcctctcgcgccgcatgcctgcccccaagcggcaggacgtagacgagcgacgagaccagtattgcttgacgacgagaaggatacggggatgggggagacgaaagaacgtcatcgcgcgccacccctctgccctgggtgggagggtctctgatcttcctgctcgtctggcaaagcactccgcacggtagctatacggccacgatgtccgcaggtaaagcgctcatagaaggggatggcgattcgcccttggcagcaaatggcccttcgttctggtgacccatggcggccaaagcccgatgtgagcacctccctccaagggagaagggccaggcgtcggggctgacgggcgtatcaccagttgggagacggaagggcgtgactgccggctagtccacggcagggaactcccgatgtgagcacttacttcggaagttccccgccaagcgggcctccttacaggaccggatggcagccgcctcccgatatgagcactcacttcggtagctctttgccatcgttgcggggccgacgggagtccagctggggagacgcgacgcataggcgcccgccacggcagccgaagccccgcgaaggcgctcacatcgggagttcattgccggctgcccctccacggggcatgagctctgcagtccgcgagcgagccacagcccactcattcttagaccactgattccccgtcgtgtggagcttggcttgggtccgatgggcctggcgtcgacggcctcatgcgcggatgccgtcgggcaagggcattgcggcaggcgagaggagcgcccctatcctcgggagccgcccgcttggcatccggcgagaccaaggtgccccgtgatgccggcggatggggcaacggccgaggtcgtcgctcctctcgcctgggaactcgcaccctacgagcagcagtccctgacccacgagatgaagtttgcggtgctcgatcccgttctttccgcggtcgtgtgcgcctgtccccacacggtggcaaagtcaacgtccttgaccgccgggttcgccttcagcgccagggcgaggttgagctcggtggtgagcgacgtgtcgccctgctgtatccccgtgcggatgcgccagtgcggtgccggcgtcgagctcccgtacccgtcgagcccctctgccacaaagtacatggggttgtacatctcctgccgcaccgagctcgaggtccccaggtcgtcgacgttgtccatgtcgcccgcgtaggcgctcgcgtagcccgaccgataatcctcgcacgatgcgtactcgtccctctcgctttcgagcaggctggacatgatcgggtcaaagtgcagggcgtccgcatgcgagttgccaaacaggaagttctcggcgcggcttctgtccagcgcatcgaaggcgcccacgtccttggaggtgggcttgaggtgccgcacgaactcgcccacgctcgtgatggtggccgtgttggacgaggggtcgtaggcaatccactctgcgtcggagttgagcgagtcgatgtagtcctccgccgtgtcgtaggtgaccggctcgttcccgtccgatgggctgtcgtcctaggtcgctgcggaggcaacatgcgtcatggccccgcccacgccatccgtgcccgcggtcctctcgcccgtccctccaccacccgcgaacccgccgtccgccatcgacctggagtcgggcgtataggggaatcgcgtgtcctggagaaagttgttgagcgacgtctcgattgcggacttcacctggtcgtagtagctgcccgaggtgtagattccctccccaccctcctgcagcgcgagcgtgttgccgtcgacgtcggtgatgccgaggtcgttgacgtagtcggcaaacttgcgggcgaggtcatgggagaagagcgcggtccacgttccgtccgccctcgtcccgctggcgcagaactgtcccatcatccactcgtaggcctcgttcgcgatgtcgagcgcggtgatggggcaccagcacatggagccggtgattgcgtcgctgatgttagccccggagtcgtcggtgagcacggcgccgattgcctgcaggtagggggtgtagagtgcggagtctcccgtggcccccatgagcgagctctgcgccccgccgcccgagtgcccaaaggtgaagacgcgcttggctcccccggggatggatccggcgttgtagcgcaggcaccgcacggccgctttgaggtcggtgacgccccatggtgcgccgcccgcgaacgcggtcccgtccgggttcgtcccgttgttgcgaccgcgacagccggcgtagacgtagaccagccccgcctcaaggtactcggcgagaccgtcgggctggtaggagatgggcgccctctgcgcggagtagcccgcggtgttcacgggaatcaccacgggtgcggcggatgccgcgtaggcacccaccgtcgcggactcgtccacgtggcaggtgtaggtcccgtcgccgttgctcgtgccgacgaagtacgcgccgggcacgtagattgccatcgactcgtattcggatgcggcggggtttgcgcagtagcggatgccgatctggtagtagacgtcgttgtcccagtcgtagtgccacgcggcgtcgtcgatggtgacggaggcgcggtcgccggaggcggatccccccgtggggggaggccgagccgtccgagccgccagcgatcgggagcgtgggaacggacaagcagccggcaaggccagcggcacccatcaggccggcgagcaggaacgaccttctcgtaagactcttcccgccaccaaggtggccatcaccgcgagtcatggtggaccccatttccctgcaccgcgtcgcgccaagggttctccggcagaggcacgttcttgtggatggtgggttagcccgcggttgcttggattctatctggtgcggcgtccgccgatgccctcgggggtgccgaagcaccgcaggcgcatatcccataagattgctgaaatgccacgcagggcgcatgcaaagtcgcccgcgggtggattgcgcccacgccgccgcggcttgacggggcggggatgatgcaggcgagaggggatgccatggcggggggagaggatcggggcaacaggggtgcgaccgcatccgctggcctcccacggaacggtgcggctgacggggcccgtcccgaggagggcggacggtctgcctgggaggatggcgccgatatggagctgttccccggcgccgccggccccgccggtcccgtcatctacgtgatagacgcgcccgagttcccgttcgacctcgcgcgcgtcgcagccgggcgggagtccaccatcgtgcgcgtgtcggtgggggactggggagacagcctcacgccctggccggcggagtcggccttccgtgggcgcccggactacggtggtcatgccgccgcgaccctggagtggctgacggccagcgcgatcccctcgctggagcgggggcggcacctctcaccctctcgccgagccgtctgcggatactcgctgggagggctgttctcgctgtatgcgtttgcccacgccggcgtcttcgacgcgtgcgggtgcatctccggctcggtgtggtacccggggtgggtcgaccacctgcgcgaggtctgcgcggagccggggacgggcctgtcggggcgatacgccttcctctccgtcggcagccgagagaagcatgccccgcagccgatgctgcgctcggtcgaggacaacatgggcgcgtgcgccaggatcctgcgggcgggcggctgcgaggttgccttcgaagttgggccgggaagccacatgcagcacgaggtcgaacggtacggcctggcgctctcccgcctggacgagttcctgtcgcggtagctcccgcccatctcacgagcccacgaccccatctgccgattttctcccctgcacacgcgcctgcgggcataccgtgcacggtgggcagggcgcgtgaggtcgcccctcgcgcaccggcaacgccaaccattcgaagggatgcggtcgagatggacatcagcgacgtcaagagggtcaccatcgcggggtgcgggacggagggaagccagatctcgtcgatggtcgcgtacaagggcttcgagaccaccgtctggctcaggggcgaggcctccgtcgagcgcgccaagccgcgcctccaggcggtgcgtcggcagattctcgctgcgctcgacgcctggaaggcggaccgcagccagtactgccgtggcctctccgatgaccgcgacctcaccgacgagcagattgaccagctcaaggagcaggcagaggagaggctctcgcgcatccggctcgtgaccgacatggaccaggcgtttggcgacgccgacgttgtgatcgagtgcatcaacgaggaccccgaccagaagcgcgacttctacgagaggctcgcgagccacctgcccgagaggacgctgctccttaccgactcgtccacgttcctgccgagcacgttcgctgactccaccgggcgtcccgaccgctacatgaccctccactttgcaaaccagatctggcgcaacaacctcacggagctcatgcgccacgaccgcaccagcgacgagtcgttccggcttgccgagcagttctcccatgcaatcgggatggtcccgctcaagctcaacaaggagcagccgggctacatcctcaacacgctgctgatcccctggttcaaggcggcgctgtacctggtggcgaccggcgtgaccgacccggcgacggtcgacctgtgctgggagctcgacaccggtgcgacgcccgaccagaccccgttccgcaagatcgacaaggtcggccttccccttgcgctaaagatcatctccatgcagcctggcgcggacgacccgacgtcccctgccggacagatggtctcgctgctcaagggctatgttgaccagggaaagacgggcatcgcggtcggcgagggattctatcggtatgacgacgaggggaacgtgatcgagtaggtcttttctccgcgtttggccaagggtatgttacctgcgttggggtcgtctccgcgtgtgtttgcggggtcggccccgttcgcccacttggagaggttccaaagagtctaagaaggggagagaggcgcagcaacggggcgagagggacgggcttcccccgtcgggacagtccgacggcgtgggcgctccggcgcggactgttccgcggcagcttcgaccacaatcccggtctcagcgtcgcagcccttccctcacggaacgagtcatggaaggggaaggggctgtctgtctgccgatgggtcgcccttggccccacgggctgccggagaaataaagattcgaagcatgacagcggaacgctcataggggcactccgcgagcgagttgccgccaaggtcagagccctgatgtgagggatcccgtacgagtggtcgttgggtctctcccgcagcgaaggccgaacgcccccgagtcaacttcaggctggggcctaggagtcagagagaggggagaaggggcgctcctccatgggacgggctaaccctcgaggaggatcgctgctccgcctttggcaatcggcatcgtccgcgcaggtgctggcgaacgaggtctgcccgaaatcgcgtcccacgtgtacacacgccgcgcgatttccgacatggtgcatgcctaccactgcgtttccactgttggcgctgcgccgagatgaacttctgtcgaaaagtccatcccgtgtgtacacgcggtgcgtgattctagacgggggcggttccttccaaccgccggatgctagaaatcgcgtcccgcgtgtacacacgtcgcgcgatttctgacacggtcgctctctcctcggtgtgttatcccagttggcgggtcgccttgcatcgctcctgccagaaagtgcatcctgcgtgtacacacggggcgcgatttcgggcaccgctaagccagacggcaaggagatgaagtcgcgtggagcgagggctacccggacgcgctcgcgtggaaaggtgccgccactgatacgccacccttgccccgcctccggccccacttccatgagtcccttgttggcgctccccagttgggaatctatggactcccgcgcttgcgcagggtgaggccatcgttggccgaggaatggaagagcccattttccgtctgtgggtctcccggggtgccatctttcctcgtcgagctctttgcaaaggcaggggattgacataagggatacaacgatggcaggagagtcccgatgtgagcacttcctggcatgcctgtctgcatgggtgaattgtcccaaccgagaaagtgcaggtaggggaaacatttcccgtgacatgaaagcaagattggcagataactcctgatgagagtgctcatatcgggagcctgctgccattcagtccacctttggggcttgattggcaacggatgaccgatgcgagtactcacctcgggagtttgctgccagaggtgaaccattggttgggcctcaactgggcaaacaccttggccactggtcaagcgtggcaggtagcgactggtatgagcactcacaccaggaattggctgccagcacaacggggcatactggccgtgccgcctcgtttcctccgtcgcaaatgcccgtcctactgtgaagcgattgtgtctccccgcgagcggtggtcccgagggcagaattccttctcacgttgtgcaatacttcacgcgctgtgcaaaactgcacacgatgtgaagaaacggagacccacacaccatgcgaccagcacttcgcgacacggcatcggagagggtccagacaagggggacgcagacggcttccggccagctcgaccgacgcagcaagcgcactcggcgggcgctgcgcgacgccctcgccgccgagatcgaggaggcgggcgacctctcccaggtgaccgtcaccgcggtgagcgaccgtgccggcgtcacgcgccgcaccttctactcccacttcaaggacatccccgacctcgtcaatgccatcgaggacgagaccgtggcggacctccgccccctggtggagcacctcgcctgttcctccctcgaccagctcgaggacgccatctcgcacttccgcccctgccccgggtcggtcgagatcctcacctacttcgccgagcgcccctacctccgcccgctgctgggggaggggggcgaccccgcgttctcgcagagggtcaagcgcatggcgcgcgagaccgtgcaggaccgcgcgctcgacggcctggacgtccgggcaattcccttctttgactactacctcaccttcgccatctcggcggaggtcggcgtcctggagcgctggctcgccaccggcatggaggagtccgtgcccgccatggcgcgcctgatgacggcgctcatgttcgtgcgcccgggcgacctgtacggcaagagcctggagtttgacgtcaacgccatatgccttgacatgcttgacatgaaggagacggaccatgactaactaccccgagtccaacagggagcaggcccgcgcaaaccgcggcatcgagcttgcccagcggggggcggagctgtatcccaagaaccccgtcgacctgcgccacgcgcacctgcgccttggcatcgacgtgggctccaccaccgtcaagctcgccgtgatcgacgagaacgacacgctggtgtacgccaactacgagcgccaccacaccgacgtccgcgccaccgcgcgcgccctgttcgagcgcgccgagtccgtcatcggcgaccccaccatgcgcgtctcgatcaccggctccggcggcatgctgctggcgaactggctcgacctcgagttcgtgcaggaggtcatcgcctccaagcgcgcggtcgagacgctcatcccccagaccgacgtcgccatcgagctgggtggcgaggacgccaagatcatctacttcgacaacggcatcgagcagcgcatgaacggcacctgcgccggcggcacgggcgccttcatcgaccagatggcctccctcatggagacggacgcgggcggcctcaacgagctcgccaagggcgcccagcacatctaccccatcgccagccgctgcggcgtctttgccaagtccgacgtccagcccctgctcaacgagggcgccgcgcgcgaggacgtggccgcttccatcttccaggcggtcgccaatcagaccgtctcgggcctcgcctgcggccatcccatccacggctacgtcgccttcctgggcggccctctgcagtacctctccgagctgcgcaaccgcttctacgtcacgctcgacctggacgagcagcaccgcgtgatcccccagaacgcccacctcttcgtcgcgaccggcgccgcccttgccggcgagtctgacaagcaggtcacctttgcgcaggtcatctcggcgctcgacaacctcaagggcacgcagggctccgaggtcgcacgtctcgaccccctgttcgccaccgaggacgactaccgcgagttcaaggagcgccacgacaagcaggtggtccccaagggcgacctcaccaagtaccacgggcgcgtgttcatcggcctcgacgccggctccaccaccatgaaggcagccgtggtgggggaggacggccagctcctctacacctggtacgacaacaacaacggcgacgtgctgggcaccgcgcgcaagatcatggacgacatctacgaccacctgcccagcgactgcaccatcggccacgtgaccaccaccggctacggcgagggcatcctcatcgaggcgctccaggccgactccggcgagatcgagaccgtggcgcacctccgcggcgccaagtccttcgtgcccgacgtcgagttcatcctcgacatcggcggccaggacatgaagtgcctgcaggtcaagggcggcgtcatcgagcacatcatgctcaacgaggcgtgctcctcgggctgcggatcgttcatccagaacttcgccgactccatgggcatgagcgtccaggacttcgccaaggcggccgtgcacggcgagcaccccatcgacctgggcagccgctgcaccgtgttcatgaactcccgcgtgaagcaggcccagaaggagggcgccaccatcggcgacgttgccgcgggcctctcctactcggtgatcaagaacgcgctgttcaaggtcatcaagctgcgcgactacgaccagattggcaagtacgtggtggtccagggcggcaccttcatgagcgacgccacgctgcgcgccttcgagctcctcaccgggcgagaggtgattcgccccgacatcgcgggcaccatgggcgcgtttggcgccgcgctgctcgcgcgcgaccgtgcgggcgcggacggcgtgtccacgatcctctcgcgcgacgagatcgacaacctcaaggtcaagcacaccaacgtccactgcgggcgctgctccaacaactgcctgctgaccgtcaacagcttcagcaacgggcgccgcttcatcacgggcaaccgctgcgagaagggcgccggcggctccaagaaggccaagaacgacgcccccaacctgttcgagctcaagaacaagctcctgtttgaccgcccgtgcctggatcccgacgaggcgccgcgcggtaccgttggcatcccccgtgccctcaacatgtacgaggactaccccttctggcacgccttcttcaccaagctgggcttctccgtggtgctgagcgaccagaccaccaagaagacctacgaggcgggcatcgagtccatgccctccgagtcggtgtgctacccggccaagctgagccacgggcacatcatgaacctcctcgccaaggaccccgacttcatctggatgccctgcatccgctgggagcgccaagaggacgacacggcgaccaaccactacaactgcccgatcgtgatgagctacccgcagtcgctcgagctcaacgtggacgagctgagcgaccccaaggtggagtacctggaccccttcatcccctacgacaacaagcgggagctcaagcgccgactgttcgagataatcgcgcagcagcgcgccgaggacgccagccacggcaagggccgcttccacggcgagcccatcacgcgtcgcgagatcgacgaggcggtcaactacgcctgggacgccgacctggagttcaaggacaagatgcaccgcatgggcgacgacgccctcaggtgggtcgaggaccacgacggccacggcatcgtgctcgccggccgcccctaccacaacgaccccgagatcaaccacgccatccccgagctggtgcactcctttggcttcgcggttctcaccgaggactccatcgcccacaagatgaggcccgagcgccccatccgcgtggtggaccagtggatgtaccacagccgcctgtaccgtgcggcgcgcttcgtggcgagcaggaacgacctcgacctgatccagctcaacagctttggctgcggcctggacgccctcaccaccgaccaggtgcaggagatcctggaggcgtcgggcaagatctacaccgtgctcaagatcgacgaggtcagcaacctgggcgccgcccgcatccgcgtgcgctcgctcatggccgccctcaaggagcagcacgccgagctcgagcgcgagacggccgcgggcatcgccaccgaggcgggacccgtgggcgtgcacatggcggacggctcgcttgagcacgcgcgccagaccgacctctcgcgccgcacccccgtgtaccgcgaggccaagagcgccgcgttcgagaaggtccgctacaccaaggagatgcaggaggagggctacaccatccttgctccgcagatgtcgcccatccacttcgagatggtcgaggcgatcctgcgctccgagggctacaacgtggtgctgctgccctccgtcgaccactccgccgtggacatcggcctccgctacgtcaacaacgacatctgctacccgtccatcctcgtggtgggccagctcatggaggccgtcctctcgggcaagtacgacctcagccgcaccgccgtgctcatcagccagaccggcggcggctgccgagccaccaactacatcggcctcatccgcaaggcgctcaaggactccggccacccggacatcccggtgatctcgctctccgtggcgggtggcctggacgagaagaacccgggctggaacatcctcaagcccaagctcatcctcaaggcagggtacgcgctgctctacggcgacctcctcatgaaggtgctgtaccgcacacgtccctacgaggccgagaagggctccgccaaccgcctgtacgactcgttcatgagccgcgccaagacgctcctgacccacagcgctgaccgcaaggccttctacgagctgtgccgcgacaccgtgcgccgctttgacacgctgccgctcgtgaacgaccgcagcaagccgcgcgtgggcgtggtgggcgagatcctggtcaagttccaccccacggccaacaacgagcttgtgaaggtcatcgagcaggagggctgcgaggccgacgtcccgggcctcatggacttcttcctgtttggcatgtccaaccagatcaacatgaaccacgagctggggaccaaggcggcgacccggctcacccacggcatcgggattgacgcggtcgaggggctgcgcaggcccatcgacgagatgctcagggagtccgagcgcttcacgccctacgaggacatcttcgagctcgcgaacaaggcgtccgaggtcctctcgctctgcaacaccatgggcgagggctggctcctcacggccgagatggtcgacctcatcgacagcggcacgcccaacatcgtgtgcgcccagccgtttgcgtgcctgcccaaccacgtggtgggcaagtcggtcatcaagcggctccgtcagatgcatcccgagagcaacatcgtggccatcgactacgaccccggcgcctccgaggtcaaccagctcaaccgaatcaagctcatgatctcggtcgcaaaggagaactacaagaacggtggctccttcaagctccagaacccgcaggaccccaccacccacgtggtggcgccctacgtggacgagagccgctaccaccgcacctacggcgactccatcgtgaacgagcgcgggggagagtcgcacggcatccgcctctcgcccgagcagctggccgagatagagcgcgccaagcgcaaggccggggtcaagtaggcagggcaatccggtcgtggccagggggcggcgtcgggacacggttcccggcgtcgcccctcttttgtatcgagggcgtgcccgccttcgccatcggatgcgtgggcaacgccgttgcgcggcacctctcgcctgccgctcgcgccccatgtggggccgtccgtcccattcccgccacgctcgcggactcggccgctcggcgggcggcaccatcccgcaatcgcctgataccatgtgcccgtgggtttgcaggggggatgccaggggagaggggacatgggttccagtgccgaggacatagtcgagaggcgcacgggcatcctcaggctcgcgaccggctacaacgtgcgcgagctctgcggctacaagacgccgtggggccccacgctccctcaccggttcctccgctccggcgacaccaacgagctgagcgagggcgacgccgggctcctgcgtgcgtacggcgtgaccatggacgtggaccttcgcagcgagttcgaggtcacgcggtcgcccgacgtctttgccgacgacccgcgcgtgcgctaccacaacgcctccctctacagcgtcaacatgcacgactccgacctggcggagggagacgggatggacgactacctggtggggggctacctcgccatgctctccaaccgcgaggccgtgcgccaggccttctcgttcatggcgacggcggagccctcggactgcgtcctgttccactgcgcggcgggcatggaccgcacgggcgtcacgtcgatgctgctgctggggctgtgcagggtctcggagcacgacatcctgcgcgactacctgctgtcgttcgcctcggtcgacctggttgaggacgccctgcgcgggagcgaggagcatcccgacctcctcacgctcgccaacgccatgcgcacggtgcgcaggaggctggtcggggggtacggatcggtcgagagctacctggccagctgcgggctcacgtcgcgcatgctcgtctcggtcaggcgccacctggtgtcgtagccaaggagggctaggccgtcccgcgggcgcggcggaggctgcgctacagttgtcacgtcacacaggattcccgcgcgggcgcccatggcggggtgtcgcgcgacaccggccataaggagacagacgtggcacaagagcagcttcccgacgtcgtcgagcgcttcatgcgctttgtccagatcgactcccagtcagaccccgagaacgaggcgcagaccccctcgacccccagccagcacaagatggccgcctacctgggagacgagctccgctccctgggcgtgcgggacgtatgggtgaccgagcacgcctacgtgctggggaccgtcccggcgtccgcgggcgccgagggccttcccgcgctggggctgtgctcccacatcgacacctcgtttgacgcccccgcatcgggcgtgaggccgcacgtggtgcactacgagggcggcaacctcgtcgccggtgtggtggacggccgcgaggtctccacctcgcccgagcaggttcccgacctcgaccagttcgtgggccaggacatcgtgtgcagcgacggcagcacgctcctctccgccgacgacaaggccggcgtggccgagatctgctcgcttctcgcccgcctccaggacgaccccacgctcccgcaccccaccctcaagatcgccttcgtccccgacgaggagatcggtcacggcgcgtcgctgctcgacctcgacgagttcggcgccgcctggtgctacaccgtggacggtgaggccctgggcgagttcaactacgagaccttcacggcgagcgaggcgaccgtcaccatcaagggcgtcatggtccacccgggcagcgccaaggacgtgatggtcaacgccatcaccgttgcgagcgagtttgagcagatggtccccgcggcggagcgccccgagcacaccgagggccgcgagggcttctaccaccccatcgacatcaggggtaccgccggctcggtccgcctgacctacatcgtgcgcgacttcgactcaaggctcttcgccgcccgcgaggagacgctgcgcaagattgccgcgttcctcaacgaccgctacggcgagggcaccgtccaggtgagcatccgcgaggagtaccgcaacatggccgagaggttccagggcctggacttcctggtcgacaacgcgctcgaggcgcatcgcgaggtcggcatcgagcccaaggtcgtcgccgttcgcggcggcaccgacggcagccagctcaccttccgcggcctcccgtgccccaacatcgccacgggcggctacaacgcccactcggtgcgcgagttcgtccccgtgcccagcatggagaagacggtggacctgctccagcacctggtggcaaagttcgcccgtccgcaggagtaggcggcgcgcccgggcgcgggtgggggagaggctccgccccgcgtcctccccacccgcgcccgctggcgtgcggtcccgtggtcgcccgtgcgccagcgggccaaccgtacggctggttgaccccagtcgtctccctggcgcacgggaagacaccgcttggggttgtgtgcgggatgtggcgttgctgtcatgtctccgttacggagagaccatgtcagccgcctacggccaatatcccaccgcacacatgttgtttgcacaacttgaaccatccctccgctagcatccctgtgcaggatgggggagtgcagatgacaggcgtgaggctgacagggagagaggcgcgtggcgtcgcggtcgcggcgtcgtgccgctggctgtccctcccctgggcgcccagaacccgtcggggggtgctgctgccatgagcatcccgtttctcatcgcaatcaccggaggcattcccatcttctccgcaatcttccagatcgtctcggacaccgacatcgccgagcgccaccacagccaccacgacacctaccgcgcgtccaagacgttcacgcgcatgctggtgtacgcgatgggctgcatgggcggcgcgggcatcctcgtgtgcctgctccagcgcctggggctcctggacgtggacatccccgtggcgatcacgttcttctgctcgttcgtcgtgaccacctgggcggtgtgggtcatgttcggccgctaccgcgtggagacgcattccgactacctgcgcgtggtcccgctcctaggcagggcgcgcgtgatcccctacgaccgcatctgcgacatcaggaccatgggcgagccgctctgggagagcaaccccagcgtgtgcgtctacgagcgcgggcaccgcacgcccgccctgctctggaacctgctcgacgtggagcagatcctcatgcgcatcaaccgccccgacctcctcgagcggcgctagcccctctcccgtcgcccgatgctatgctgctctgggtgacgcttggaggggatgcggcagatgatcaggctagcgctcagcgacatggacaacacgctcctgccctttggccaggaccgggtggacgagaggacgctcaaggcgatctcgacgctgcgctcctcgggtgtgaggtttggcccagccacggggagggacgagcaggagctgcatcggttctttgcgggtgacgactcctgcttcgagacgggcatcatctccaacggcaagaaggtcaaggtggacggcgagctggtgtgggcacgctacctcgaccgcgacgcgctgcagcggctggcggacgccttcgcgcccgtgccgggcgtcttcgtggtcgcctatcccgccaagaccgacctctccaaccccgcgtacgtgctgggggccacgccggcgcaggtggcgccatacgagcgcaggttcaggttcaacgggacgattgtctcgcaggtgcccgacgtcgacgtgatcgccgccaccgtcgcctgcgaggaggacgaggccatggactgggtgcggcgcgaggcggagcgcgtggtgcccgagctcgtggtggtccccccggtccccaactggttcgacgtgctgccgcgcggggtcaacaagggcacgagcctgcggcacctgctcgacgccctgggtattggcaccgacgaggtcgccttcttcggcgacgcggagaacgacctccagatcatgggcgagattcccaactccgtcgccgttgccaacgccactcgcgaggcggccgaggcggcctgctggcacatcggcccctgctgggacgatgccgtcgccgacgcgctgctcgacatcgcggaggtcgccggcactgacgtggcaccccgcttcatgcgcgatggcgacgaggcgtagggacacgcgagcacgtccgcacatccgaccgtctgtatgaacgcctcatttgcaggcggagccctggcttaccgggcgccctgcttcccgtgtctgggttgatgcgggagtcttcgtgcgtgccgtccccatttccgcgcgtcgcggggctttccggtcggacacgcgctgggggactgccagggaactttgggctgcggcggtcggggaggggcttcggacccgctcgccgactccggcaacttaggaaaggcgagtattggcaatcctcatgcggcggtagcttaagaatcgcgagtattggcagatgatgggcatccccagctgccaatactcgcgatttccaagcttaaatcctctcttgcagaaagttggtaaacttctgagctgctagtcctccgagctggcacttctctcgtagtactccctgtagggcagcgaaatcgggacggtcatcgcccggtcgaggaccatcgcctcgcggccttctccagccggtcctcgtggtgttttacgatgaccgagacaggtggagccatcttcgatgcgtctcgctcgaagccggaatggcggtgcatgaactccttcacaaagtgcatgttgttgacgcgggaaagcggttgtggtgtctccacccccttgaggtcggcgccgactgtaggcgacgctcgtcagcccaagccgctcgacgagcatgagtgggagttctccatgtcgtggcagcgtcgcccccgggcgatgtggccgccgtaggcgtcccagcaccctcgacttgctgagcttgcgagcccagcccgcaccgcgaggctcctgccggagtcgtcgcatcccacggcgatgcagatcctgtccctcgagtacgcgcccatcccggccctgcctccagccctgtccctggcgcgagggggtgcatcttccgtcgatctggacctcgcccgtagacacgacgccgtcctgaacgccctccagcacggcgagagcttggccatccaccaggcggtggggtgccgctcctcctgtcctcctggttatcgcctctaggctctcgagccgaacgcctggcacatgaactcgacccagtcggcgacggggagctgtggtcctcgagacggtgcccgttgccggcgtgaggtcctgccgcaggacgcgcacctccagcggcggcgccatcggcctcgttgccccatcgcttggatgtggccgctgccgcatctggggcagcggtccctctcgtacccgttcatgaagtccgcgtccccggtctccatcagagaacgtggcggaaatcgtacacgctcctatggctgtccctgacggccagctgtgccggcgtcaggtcggcgtccgggacgccgtcccagggcgtcgccgaggcagacggggcgtgccatctcgtgccgctcatggttggtagtcctgctccgcggtcggggcggcgcggggactcaatcgccagatcgccgccacccaccgcggcattctggcggatggctatgtcctgtggtgattatagggccgcggagctagtcctggcggaagaccaactttctgcaaaagcggatttttccaagcttttggtccttccaaattgccaatactcgacattcctaagcaggctatgcgtccaggggtcgcggcgcagctgcgacgcgggtgaggtgaaggctccgaagcaggctgcgtgtccggaagtctcgattcctttccatagcagccttggccccgattttccgtgaacgccctagccccagctaccgagatttggatctcccctcgccccttttgggcgaggggagtggagtcaaatgctgcctaccccctcttttggaacctctccgcaatggcggcgcggggcgtcacgccggtggcgactccacggatcgcgtctccgtgcgccaggtacatgagggcggagagcgccaggccgaagagcgccttgccccagctgccgaagagggcctcgagcgcggtgtagcagagcggtatggccatggccccgcggcacaggtacccggtcgccagcacggtcgcaagtccggcgaccgacgcgacggagcccaggagcggcgaggcgaggatgatgcccgagcaggtcgtggcaacccccttgccgcccttgaatcggtgccaggcggggtagttgtgccccagggtcgttcccagcacggcgatggtacccgcggcatccgcggcggcggggaaggccgcccgcgcgagtgcgaacgaggcgacggtcttgaggatgtcgcccgccagcacctcgacggcggcccccttgcccagctcgtgccccacgtttgccatgcccgggttgcccaccccgatgtcgaaggcggactttccgcacctcctgcggctcaccacgtcggcggtgaggaagttgccgcacgcatagccgatggcgaggctacccagtgcacagagcgcgtccatctcgaccacccctccctcgcgaccctagccgcggtaggtgtcgctcacgccgtccgccatgccccatccgcgcgcaaaggccgcgtccacgttcatgcgaacgagcatggtcttggtgagcgggaaccagcgcgtggcgaaggcgtacctcccgccgttggcaaacagctccacggcggactcgtccaccacgatcctgaggtcatccacgtggccgatgggagcccccacctcggtcctgccgccgcccacggtgtgcgggttggggccgcggaatcccaggtacagtacgccctcgcggtgccgaacgtacagctcctcgtccagcacgaccgtgaacttctcgcccgtgatcccctgaagccggatgtcggcgcggtggttgcggaacaggccgcccgcgtgcgggtccatgcttgcctcaaaggtgtgtagctccgccaactcctccacggggagctgcgtcacgttcccgtcctccgcgcggcccacctggcgcgggatggtaaggcagtcctcccacttgagcccgccgcgggtgttgacgtaggaggtgtcgggggtccgcatcagggcgatggccagggtcctgccctcgtcgtccacaaactcctggggagaggagaagtcaaagccgtggtcctcgagctcacccggcatggcagcgggcacccgcgggtcgtcgggcgcgggctccggctgcgggttcctctcgaccgaccagtggatgaggttgtggctcgagaagcgcacggggtgcgaggcggagccggcgagcgtctggtgggcgtcgaccacgtaactgccgtcccgttggcggaagccgtccacccggtcgagggtgcccgtgaccggcatgaggtggaacgcgtttctccagctgtcctgcgacatgtgatgcctccctcgcgccccggagggcgcctcgaattcactgccactacggtagcgcagcagggtggggcggtggtgcctcgttgcgcggcgggatgtgcgcgagggctggcattgcatcagggagtgaaccatgaatataagccgttcgcgattcgcacatgccgttcacggaggaacgggcatcgcttgcaaaagtttcgaacgtgtaaacgcttttctcttttatatttccaaaaggttacatgaaactgatatgggagagatgtggccatcttacaggttggccgctctctcccatgcatcgaagaggggagaaatccatgcagccaatcgaccgcctcctgcgttatgtcgcggtccgcacgcccagcgacgagaacaacgactcgtgctgcccaagctcaaaggtgcagtttgacctcgcaaacatgcttgcggacgagctccgtgggatgggggtgtccgacgtccgggtgagcgatgactgcttcgtctacgccaagctgcccgccaccgcggggtgcgagggccgcaagaagctcgggctcatcgcccacatggacacggtctcggcctactgcgaccacgagatcaagcccaggctggtccacgactacgacggcagggacctgcccctgggcgagagcggccgcacgctgagctcgcgcgagttccccgagctgccgtcgctcgcaggtcgcacgctcctggtgtccgacggcaccaccatcctgggcgtggacgacaaggcgggcatcgccgagatcatgtgcgctctcgagcgcatcatcaccgacggcacgccgcacggccccctgcgcatcgccttcacgcccgacgaggagatcggaacgggcgtctctcactttgacgtggagggctttgatgccgacgtcgcctacaccatggatggcgacgccgaggacgagatccagtaccagaacttcaacgcgtgcgacgcggagttcgaggtcacgggctttgtcgtccaccccggctccgccaagggcgtgatggtcaacgcgtccctgcttgcctgccagatcaacgggatgatcccccaggcggaggacccgcgtcacagcgaggggtacgagggcttctaccacctgtaccagatcagcggagacgaggcgagcgccaagctctcctacatcctccgcgactttgatgccgcctcgctcgaggcgcgcaagcagaccctccgccacatcgagaagaccatgaacgagcagtgggggagcggcaccgtgaccctcaccatcaaggacgagtaccgcaacatggccgaggtcatcgagtccaaccccttcgccatcgacttcgcgcgcgaggcgtacgaggctgccggcatcaagccgcgcgtgacgcccatccgtggcggcacagacggctgccagctctcgttccgcgggctcccgtgccccaacctcgggacgggcggctacggctaccacggcccctacgagcacgccacggtcgagggcatggaggcagccaccggcgcgctggtggagctcatcggcgtgtacgcgcacaagggctagtcccgctcggagcgccctcgcataggggcggtcgagaggttcgttctcattcgtacagtcaggcacgaccattggaggtatcgaggcatggcagaagctgaagccatcgacgcgcaggacgccgaggcggcgacgggcgcggagggcgccccgaagaagaagcacaagctccacttcccaacagcaatcacagtgctcttcatcgtgatgctcttcgcggcggcgctcacctacatcgtccccgcaggcgagtactcaaagctcctgtacgacagctcgcaggacgcgttcgtgatcaccaagccggacggcagccaggagaacatgccccccacgcaggagacgctggacaagctgggggtctcgggcagcctcgacagcttcctggacgggtccatcaccaagcccatcgcaatcccgggcacctaccagaaggttgaccagcagccccagggcgcgctggagtttctcctcgcccccatcaagggcgtgtacgacaccatcgacatcatcctgttcatcttcatcctgggcggctgcatcggcgtgctcaactacatgggcgcgctcaacgccgcggtcgcagcgctctcgcgcgtgaccaagggcaaggagtacatcctgatcatcgtgttgggcctgatcatggtcgcgggcggaaccacctttggcctggccgaggagaccatcgccctgtaccccatcctcatgcccgtgttcatcgcggcggggtacgatgcaatgacctgcatcgccgtgatcttcgtgggctcctccgtgggtaccatgtactccaccgtgaacccctttgccacgggcgttgctaccaaggcggcgggcatctccatggccgacggcatgagctggcgcttcatcgcacttgcaatcggcaccatcatctcgtttgcctacgtgctgcgctacgcccgcaaggtgcgcctggaccccagtaagtcggtctgctacgacttcaaggacaagatcgaggagcgctggggcgcccagggcgagactcccgagttcacgggcaagatgaagatctcccttgcggtgtttggcctctcgttcgtggtgctggtgtggggcatcgtgactgcccagtggtggtttgacagcatgaccgcggtgtttctcgcctgcgccatgatcctggcctttgtgtgcggcctccccgaggagaccttcatggaccagttcatcagcggtgccggtgacctcatgagcaccgcgctggtcgtgggcgttgctcgtgccgtcaacatcctcctggaggacggcctgatctccgacaccatcctgcacttcttctcgggcgtggtctctggcatgagcccgatcctgttcatcctcatgatgctcgtggtctacatcgtgctgggcttcttcatcaactcgtcctcgggcctcgccgtgctgtccatccccatcatggcgccgctgggcgatgcggtcggcgtctccaagtccgccatcatcgcggcgtacaactacggccagggcctcatctcctacatcacgcccacgggcctcatcctcgcgagtctcgcgatggtcgacgtgcccttcagccgttggctcaagttcatcaacccgctgctgatcatcaccatcctcctcaacgccctgctcctcatcggacaggtcgtcatctaaccctggttggcagcgagctcgatcgcgggcgggcgtcggtcattcggccggcgcccgtctcgtgcgttgggggggtggttgcgaggcaggcgcgcggcggattcgctcgcggacttgcggtcatggggacgcgctgccattgggttgcctggccgggacggttgcgggcacctctccccatgtgacgcacgcctgcgttgggctaccatcgtggtggctcaggacgcggggagaagggcgtgatgccggtgttcagcccctttcgcgacgggcgtggggctcccaaggccctcgccgatgtgacgtacgaggacctctcgcagctgcagaacctgcaggaggggtttgcgctcgagttcaagcagacctttggcgacacggtcaggcgcaaggtgcccaaggtcatcgcgtcgtttgccaactcgcgcggcggatggctgtgcattggcgtcgcggacgacggcaagctgtgcccggtcccgcgcgggacggctgactacagccaggtcataggcgagatgtgccgcagccacgtgtcgcccgcccccaggtacgaggtgcggtttgtggcggaccccgcggaccagggccgcggcgtcgtggttgtgcaggtgttcgagggcgacttcccgccctacgtcgccgacggcatcgtggagattcgggagggctcagcgtccggcccggcggcggggacctcgctcgtggacctgtacgaccgcgcgacccgtcgccgcgaggaggtccgccggttctgccatcgaacggtgtactaccccatggtcgacgggggactgcccgccggagcgacgggcagctgccgtggtgccgcgctcctctcgcccgtgacctctgcgacagtcccgctgtttgggctgtacctgttcaggctcgggcgcgcctggggcgaggctcccacgcgggcgcaggtcaacgagcgggcgcaggcgatgcaggcggtgttcgaccgccgcgagcggggctgccgagtccagcacgcgcacgacagcctggtgtttcgcgtcccctcgcgcgacgaggccacggtggcccactccgccatcgagctctttgccgacgactccatgaagctctcggtgcccgccgtggtgcttgggggagaggagcgtgcgcgagcgcttgcgaccctctcgcacgaggcgtactttccgcccgccccggacgcgcttctcatcgacgcccgggcgacgctgcacagggtcacgcgcatggcgaccatcctggacgactacgtgcgcgaccgggggatcggctggggctcgtatgccgtcgcgtacgagctggagggcatggcgggggtcacgctgtggtcggacgaccaggcctacctgcgctacgttgcgcggcacggagtgctcagctgcgccaccaccgactgcctgagtcgcgtgcgctacctggacgacggtgcgcacgacaacttccgcgcgcgccagtttgcggggagccacttcttcgaggcgtgcggcttgccgctgggctccccgtccgaggaggacaaccagctggtcgacgcccttctcatgggataggggagaggggcgagcgaccttgcccctggctcatcccgccggccccgcggggcacgctcctctcggctgaatgtggagcgtctccacatctggctgcccgagtttgacatcgtctgtcgtagcccctatattactttcttgcgcacaagcggcgcccagacattgcggggtggagcagtctggtagctcgccgggctcataacccggaggtcgttggttcaaatccagcccccgcgaccaacatttacgcaggtcagctagccaatacggcagctggcctgtttcgtattggtgggacatgtcccctcggcggtactttgaacgaatcctcgttccgggtctctgcgggccgtttctcctcctctgcctgctgtttcggagcagtgaggagggcaccgagcttctgggcgactttgtggccgttctcgggtatggcgtgcgcgtaccagccgagcgtgatactggggttggcgtggcagaggcgggtctggacggtcttcacgtccactcccgcgccgaggagcatgatggcatgggcgtgccggagctcgtggaacttgagcccgtctaagccgtgctccttgcgccgtctgctccaccggtgctcgaagttgtcgatgcagatagaaccatcaaacacaatggcgtctgaacgtcttcgaggtgtctggttgtgttcgcttgttcggggttccccatgagctggacgacggggcagaacgacgtgatcagcgagctggggcaccggggcgtggcagtggtgcacgacgcgctgttggaatgctgtggcgtggatcactcgctccacgccatcgaaatccaggcttcgcacattcatgtgagtctccgcgttcaggtggtgtgcccggagtgcgaggcagcgggcgatcgcatcaaacagcagacggggtgcggtgccatcttcgaggagcacacggccaaccgtatggggccggaggagaccgggcgcgtggtgctgaagaccctgacgtatgcggactcgcctggcgaggggccctactaccacgacgagctggtgtggtgcgatgacacacccgacgtcaaggtgcagatgagcttgtatcggcgcgatctggggattcgcgcgaggccggcgcgcaaggggcggatgcgcaagctctcctacgagggctggcgaacttgcaggagatcgtgatagaccccgagcactgcacgttcaccctcgccgagttcagcgagaaggagtacctgtgcgaccgtgacggcgcgtggctggacgagattcccgacggggacgaccactccatcgacgcggtgaggtacgcgatggcggagaacatgctgcgaggggcctaggcgggcacgggctccacgtcgagcttgtagccgagggccttcacgaccttctgcaccgtggcgaaagaggggtttcccgtgggcgagagggccttgtagagtccgtcgcgagtgattcccgtctccttggcgagctgggtcatgccgcgggcgcgggctatgtcgccgagggctgcggcaaagaggctggggtcgccgacttccagggctgcgttgaggtaggcgacgatgtcctcgtcggtctccaggaactcggccgcgtcgtagggggcggccttcttacgtgccctgctttccttttctgccatcgtcttcaccctcctcgttcttctcctcctcgaacttctggggaagggcgttggagaccgtggtgcgggcctttggcatgggcacgggggcgttcgcaatgtggatggacgtgggcaggcgtctggtgagggttcggcgccacgacgcgagggtggttgtccccctcagctgggacggcgagggcgtgagggagtgtgccttcgtcacgcgggcgttctcaaaaggtggggttttggaccagctgcagatgcgtctcgttggcgatgatggtctctatcgcatacgcacggcctgcttcgacaaggaagggcgcgtggtgagcgtgccgggggttgcggaggaagtgagcgcgggctcgtcttccctcaccttcggcatcgtgcggcgtgccatccccaacacccgcgtggacttctcgccctatgggcagtccgtgttcgcctatgcggcggatgcggttcagagcgttgacctcgcatacgacgtgctcatcaacgagattgatgcgggtaagatgcgggtgttcctctctgacgtcgtgttcgaccagcagaaggactcgagcggcaagcgtatacccatcccgttcggcaagggagattgcatcgtgttccgaaaggtcatgtcaaccgaggacacgattcaggagttcgcgccggccttgcgcactgaggcgcagggccaggcgttccggctggcgctccaggtgctggatgactgtgcgggctggggacgaactacttcaacctggacaacgtggggtatgtgaagacggccacggaggtctcctccgacaactcggcgctcatgcgcaacatccgctagaacgagaacgcgctcacgggggcactcgtggacgtgtcgcgggccgtcatgtcgtgctcgcggcatctgggcgtgcctctccccgacgagggcggcgtgtcggtgttcttcgacgactcgatcgtgcaggacacggcattggagaagcagcaggacatggccgaggtggcggcgggactgatgcttcccgacgagtaccgcgcgaagtggtacgggaagagcgcgccttctgcaaacgccaaaagctgatggccaagctaatgtaattcgatgtgccaaggcatgtgattgcattagtttgggtcggaatcacattggttggtgaggcgcttggggccttcggatgcccttgagccgtgcgataaaatgtctcccgttgaacgcatttaggagacgcccatgcagcagcccatcacccgaaacgaccctgagctcttttcgacagagaaggagaacctctacttcgaccgcaagagcgcacgcctcaacgccaaggagacggcgcggcacatatgcgccttcgccaacgcctcgggcggcaagctggtcatcggcatcgaggacgacggcgagataacgggcttcaagcgtgatggcgcgcgggacatcgaggacttcgagcaggcgccgattgtgggctgcgacccctcgcccgtggtgcacgcgacgagagtgcccgtgaagaacgccaagggtcaggacgaccagattctcgtgctggacgtcgccagctcgaccgggcgcgtcatcgccaggagaagcgacaaggccgtgttcctccggcaacgggacagcagcgtggagctcgaccgtgagcaggtgctggcgctcgagtacgacaagaaccagcggcgctacgaggacgagttggaggaacgctcgtcgattggtgacgtggaccccgaggtggtggggcgctacaaggcggagctgggtaccgaggcgagtgacgagcaggtgctgcgcagccgcgggttcctccgggacggccacctcaccaacgcgggcgtcctgctcttctccgagaacccgacgcgtttcatgccttgggcgcgggtgcgcgtgatccgcttcgacgggaacaagatgaagacggggcgcaggctcaacatagtgaaggacaggaccttcgacgggcccctgcccaaggccatcgagagggccaaggagttcatatcgagccagctgagggagttccagtacctgggggacgacggacggttcaagatcatccccgaataccccgagttcgcctggttcgagggcctggtgaacgccgtcacccaccgcgactacgccatgagcggcgaccacatccgcgtgatgatgtacgacgaccgactggagataacgagccccggcggtctgcccaacatggtgaccttggagaacatgaggtacaccaggtggtcgcgcaacccgatcatagcacggacgctcgtcgagttcggctgggtgcgcgagctcaacgagggcgtgcagcgcatctacgacgagatggcctccttcttcctgaacgagcccgcgtactcggagccccacggcatgtcggtgcgtctggtgctggagaacagcatcacctcgcgcgtgctgaggcaggccgactccgtggcggaaagcttgggcgagggcgtgtacagggatctcaacgagtacgagcttgctgccgtgcaatacacgtacgggaagggacgggtgacggtgagggggctcgccgaacatctggggcgcagtaacaaggtggcccgcgcgacgctcagatcgctcgccgacaagcacatcctcgattggcacggcaccagcgcgactgacccctcccagtactatgacctccacagggcagagtaggtaagggctcgggcatagcttgaaagggttctgcgggcagcaaaggcttccgagcccttcccatgagggcatagcaggtaagagtaggtgcgagtaaggttcgagtagcgggggcggtgggaaaagcccttctcttcttagggaaacaccgaataaatggggccctcataacccggaggtcgttggttcaaatccagcccccgcgaccaaaactaaggtcccgaccagcagagatgctggtcgggattttgctatgtagagacactccaaacagctcatggacggggtcgagcgagagggaggtgctcgcactcctgccggttcgtagcggctacgactgttgggcgagcttggacagaacggccttgatgattgatcgatcatctatgcgtgtgatggcgaagctcctcctgcctgcgtccttgagcgacgcgcctacgaggtggccctcggtttcgtccaggatcaggaaccggtcgtggaacgaggacgtgtggcgcaccgtcagcttggggtactgcacgttgaaggtttcgacgtccttggcggtgagcttcgttttggggtgggtccataccgtgacggtcacgccatcggccttcttcgccaggatgttgagcgtgcccgcgtccacgtagccgtcgatgaggacgacgctctccttcgcacgccgcacgagcgagaccagaagctcgaaggcatcgtagacctggccctcgaagaacaccatctgccggggttcctcatgcgctcccatgcagtcgaagacgcgctcgaagcgctcgtcggtggagcgctgcatctcgttgaggcggtggttggtctccgcctggtactcgatctgcctgcggctcacttcgcggatctgatcaaacatgtgagcgttgtccgcgatgaagtggcgcatctccacgaaggcgtccatgattttgacgctgacctcgatggcggtgtcgctgcgtagcaccgccgagaggctggacgcgccctgctggcggtcgtacgccagcttggactgaagcgtggtgacatgttcgacgtggtcgtgcatgatggtgtggtcatgatggtgcccgttgtcgtctatccaaaggctaaggcggaagagctcgaagcgctcgccgcatcggcacgtgagtcggcggcaacgggaaaagccgatgtctacgatgacgttgaggacctcattgcagacttgcacaaggcagtctagatggcttatcacctccagcttgagaggcaattcatcaggcgatattccaagttcgctccaaaggagcgagatatggttgacgcagagctgcgtatccttgcccgtgacccttggcatccatcgctgcgaccaagtcgcaatggcaggctggcgcccagtcggccctttcaaagctcaaggcagacggaatcgtcacctcgcagagtccgtcgcacgacaaggtcgacctgtttctctccctctttcgtggtcgtgctgacgtgcatgcccatggctatcgacagaaggtcggcggcattggctatgccccgcctgcaagaacgagtggcgacgcggcgtctgcccacgcgctgcgggcagcaaggtgagctgcacggattgttcggcgcgttccttcctcccactcgactacaagacgctcaccaaccacttcaggggtgcggacgagcgcctgattggggagaaggtgagtgaccttacgtacgacagacgcgcgggtgaggggagagacgaatggcggacgacgggttcttccagagggcatacgacatagtgagacaggtccccgagggacgcgtgaccacttacgggcaggtggcacgcatgatgggtgagccacgcaaggcgcgctacgtcgggttcgcgatgcactccagcccgggaatgaagggtggggtgccgtgccatagggtcgtcttcgcagacggaagccttgcgcccgggtttgccttcggagggcctgagaagcagcgccgcatgctcgaggcggagggggtcgggtttctcccgagcggcaaggtcgacatgagccgcttctcctgggaggcgtaagggaacaggcttgggaaagttcctgctgcgcgtcacggaagcgcgtcggtgatggctgaaggtgtcttcgagtcgctcctcgtggcgttacctgctggggaaatgcgacctgtggcaatcggaggcaggctatgggggccgtcgcggggaccccggcgatcacctgctcaggaaagtccgtaaattcccctcttgccacgtggagttgttgttccattgacctgctcccggcttagcttggcttttttgtcgtagaagtcccttatctaagcgttttcggggaagccattgccggtcgagcaccagcggacctctctcagcctgtcctcgggtgggttcatcatcacgagaagaggtcgagaccagcccggggaagctggcgcgtcgaaagcccgtgtggccgtccgaggaaagagctctgagcagaagcagaggcggtttgacttccacagacgggttctcctcgtcgggaagctcttgatcctcgctcgagtcatacgtccgctcacgagcccgagctcccgcaccacggcgtgtgcgagttctcctgtcgtggacagcaacgaggccgccgcggacaggtgcgggcagaggatacgccgccttggcgcgctgccgcgccggcttgcaacgaccccagaagcggtagaaccgccgaggtccgtgtctccccctcagtccgcggcgcttacgcagagcacggtttgtttctcgatgcctctgccctaactgcccgccagacagggtggtcccgtcggcagccgggtaccgggtacatcatcctctccggccgccgactggcaccgagagcaccacgggcgtctgatgcccgtcgagaacgcatgaacagcttgggacgacgtgctggctatgccggggtggggtgtgccggacctcggtccggcgccgcgcgatgccccgcgaggcatctcgaaggacatgatcgcgagaggaaaatcaccaaacacgcggtcacggggagaacattcctgcctacgaagatcgtccccgtccagtgtgtcgctaaggtggttgtagagcacgctgcgctgcacgccagcggcgcacgcccctgcggtcgtggccgtacatcgctcgcctccccggacgccgcacctcgggcacgagtccgcgctcgcatcgtttgaggaacgccgcgtcgacctcgcccccgagcctgtggaggacagccgtactgctccctctgccatcccatcaacgagcgcctggcgcggcgacgtcagggatgactcgtctggcaaccttccgcagggcgtgttggacgcctagggcgcgtgcatctcttcgtggcgtgggttgtggtattcctcgcgccagttagagcggccgacggcgccatgggactacccaatcacgagaggcgccgccgcccaccatcgcagcgctctcgtgtggatggtttgggccatccgccggctgcaattctaactttagatggaagacgggaacgaccccaaacgcaccacacaactcctgcaagagggatgttagtgtcgagtcgagtattggcaatccgggtcccgtttcagctgaggaaagccgagtattggcaatggattgccgggacgtggtccgtccgactgccaatactcgacattcctgagcagccaatgtctctcgattgccaatactcgactttcctcagcacccatgctcgaggggcaccgtcacgacgctgttttccgcatgcgagaagcccagattcccctacgccaaaccctccatccacgtgaggcacctctcgtacgcccggcgaccgtccggaccgctggtgtcgcggtcaaactcgtggtcgtccccatacgacgtgaacgtctgggcgtgcagcttccgagcgagcgacttggacgtggcataggggatctcgccatcgccggtggcggctgcgtagaacaccggagacattgcgtcgatctgtcgctcggtcagcgcgaacggatctcgggcgttctcatcaagcccgagcagacttgcccagcgacccgtctggcgtgcgtacatgtagagcgcgaagcgcctctccgccggcccgctcgtgacgggttcagactgcttgactcggtctaccaccctgctcccgatggtggggtatgcacggtacgtctcggacggggcggtgatcgaggggtcggtcgaattcccgtagccgtagaagtcgatgacgccagtgggcttgcgtgccccgtccgcctccgcaagcctgcccgccagagtgagcacaaggtatgcgcccgacgagcgaccaaacaggaagacggagtcgcaccccagcctgggggcgacgtcgccgctgacccaggaccacagggcgtcgacgaagccgtggatgatatcgagggacgattcaggggccagtgggtagtccgcctcgaccagcgtgcagcctcgcgagaggaacatggcctcgtacgtctcggggaggtccttgcggctccccaggagaagccccctccgtggaggtacagcactaggacatgggagagcggacgctcacgtgttcctgcctcatcgtccggctgcaggatggtcacgcccgccgtgattccgttccaggagaagcgctcctccgtctgcatggcacctacctctcgttgagttcgggctcccagtctggtcctaggagtgcgatgagcttgtccgcgagcagcacctgcatcatatcgtcggtggcatggacgtcgattccgtactcctcgcggattcttcccacacgataccgcacggtcttgaggtgtacacatgactggagcaatacggacgatcctcaacgtggactcggatgtgtactgcaccctcatggttgccgcgaactatgaggacgggatcaatcgggaggtcttcgaggcgaggaactagagcatcggggggtcaggggtctggtgtacctcacggtattcgctcgtcacattatcctaaacctgtaaaaaagaagttgacacgtttggtgtcaaaaagtatcttacaagttagggaaagagcgacggagggaatgccatggacgtgcaggactgcctcaacacgctgcgtaagatcaaggatgtgtcgtttgcgacggtggacgagaagggccacccccagattcgcatcatcgacgtgatgctcgtggacgagggtgcgctctggttctgtacctcgcgcggcaaggacttccatgcccagctcctgcgggacccgcacgtggcaatcgtggggatgacgcgtgactacaagatggtccgtctcgcaggcgaggcgcacctggcgagcgaggacgctcacgcgaccatcgaccgtatcttcgacgagaacccctccatgaacgacgtgtacccgggggactcccgctacgtgctcgacccattccgcatcgacagcggctgcgtggagctgtttgacctgggcgtctcgcccatctttaggcggactttctcgcttggcggctccgccacgcacgtgcagggcttccagattaccgacgcctgtattggctgcggcaagtgcgcgcgcaactgcccgcagcagtgcatcacccctggcaagccgttcgtgattgcgcaggagcactgcctccactgcgggctgtgctacgagaactgccccgtgtccgccatcgtgagaaggggctagcgcatggttgcagagacctggaacctgcttgccacgcgctgggacttctttgccgggttgcttctggagcacatccagatctcgcttctcgccatctttatcgcaatcgtggtcggtggcatcgcgggcatcctgataagcgagtggcagcgcgccgcaaggccaaccctggcggtgatcaacttcctgtacaccatcccgtcaatcagcatgctgggcttcctgattccgttcagcggggtgggggacgccaccgcggttattgcgctcaccatctatgcactgctccccatggtgcgcgccacctacacgggcatgtccaacgtggaccctgccatcctggaggcggcgactggcatgggcggcaccaggtggcagaccctcgtgcgcgtcaagcttccgctggcgttgccggtcatcatgagcggcatccgcaacatggtggtcatgaccatcgcgctcgccggcatcgcctcgttcattggcgcgggcggcctgggcgttgcaatctaccgcggcatcaccacgaacaatgccgccatgaccgtcgcgggaagcctgctgatagcccttctcgccctggtggtcgactttgtcctgggctttgttgagaggcgcgtgaagatgcgcagccgcgccgccaagaggaccaaccgcaggctggcggtgggcggactcgccgcgtgcggagtggcggtggcctgcgcccttctccccgggctcgttgcccccgcgcctgcaaccatccgcgttgccaccaagcccatgaccgagcagtacatcatgggcaacatgctcaaggacctcatcgagcaggacaccaacctcaaggtcgacatcacccagggcgtgggcggaggcacctccaacatcgagcccgccatggagtcgggcgactttgacctgtaccccgagtacacgggtaccggctgggccatggtgctgaaaaagggtggcacctactccgaggacgagttttaccagctccaggctggatacaaggagaagggcctgagctgggtcggcatgtacggctttggcaacacgtatggcatcgcggtgcgcaaggacgttgcggagaggtacggcctcaagacgtactccgacctcgccaaggttgccggcaagctgcgcctgggggcggaggcggacttcttcgagcgcgaggacggctacgacgccctgagcaaggcgtatggcatgaagtttggcagcaccatgcagatggacatcgggctcaagtacgacgcgctcgagcagggtcaggccgatgcaatcgtgatctttaccaccgacggaaagctcagcaaggccaacgcgaccgtcttggaggacgaccggcacttcttcccctcgtacgagtgtggaaacgtggtgcgcgacgaggttttgcaagagcaccccgagctacgtgacgtgctgaagaagcttgatgggaccatcaccgagaccgatatggcgcagatgaactacgaggtggaggaagagggcaaggatcccgaggatgttgcctccacgtacctgcgctcgaagggactgcttaaatgagcgaatccaaggacatcgcaatcgagtaccggcgcgtctgcaaggcgtatggcgagaaggtcgtcctcgacgacttcaacctgagtgtccccaggggcgagttcctcacgatcgtggggtcgtcgggctgcggcaagaccacggcgctcaagatggtgaacaggctcgttgagccgacctcgggagacgtgctcgtgaacggccgaaacgtccgcgacgtggacgcgatagtgctgcgtcggagcatcggctatgccatccaggggagtgtcctgttcccgcacatgaccgtggaggagaacatctcgtacgtgccccacctgctcaacaggcgcgaccgtgcccgcacggagcaggcggtgagcaagtggatggacatcgtggggctgtcgcaggacatgctcgagcgctacccggcggagctctcgggtggtcagcagcagcgcgtgggcattgcgcgtgcgctcgcggcatcgccggacatcctgctcatggacgagccgtttggcgccgtggacgagatcacgcgcgagcagctgcaaggcgagattgcgcgcatccatcgcgagtgtgggatcaccgtcatgttcgtgacacacgacatcggcgaggcactgcggttgggtacgcgagtgcttgtgctcgatgcgggcgctatccagcagtatgcttctccccaggaagtgctcgcgcggcccgcgaccgagttcgtctctcgcctggttgcgcgccagcgtcacgcgtgcgatttgggagacgaccggctgtgcgcgtgcgaacacagcggggcggcgcgtgccgaggcggcgatttcgatgcaagagggacctcatgcagataaccagtaagctgaccatggcggtgcacatggtgtgcgccatcgactactttggcgactcccagccagtgaccagcacgttcctggccaagagcgtcgggaccaacccggtcatgatcaggaacatcatgggagacctcaagcgggcgggcatcatctcgtccagcaagggcaagtctgggatctcgctctcgcggccgctgggcaagatcacgctgctggacctctggcgcgccgtggaccagagcgacgccgactcgctcttccgctttcacgagaacccctgcccgcagtgccccgtggggggcaacatccatggggcgctggatgggcacctcgccgacgcgcagcgggcgctggaggaccagctcgccgccgtcacattggaggacgtggaggcagacgtgcgccgtcgcgcggatggggatggggcggcagacgcctgatgccatgcggatggggtaggggagaggggcggtccctctcgcctgctgtcgaatgcctccgggtgatggggcgatatgccttgcgacccctccgatgtcccgcccgtttgcggcggacggctgtgccgtggcgccccataagaatcgacgcgtttacggtcccctaaacgcgtcaaatcttacggggtgaaagtagtgttgctcccgcggctccagacgtagggaggggcctctcggggcggtatggccctgcagtggttctgccgtcagcctcgttgcggcatgaggggcgagcatccatgttctgaagcttcgagaattgagatttgcttcccgtggcaacgcgaagggtaagagatggccttgcctggttcgttgctattccgctcgcgggctgggtgctgttgacgctgcaaaaaacactgctgggaggtcggacgtgtttcgtgccttcagtattaaccgcgcgctgcttgagcaatggtgagaggggcttcccctcttgcctactgtcgaacgtccctacaagatggggcgactgggtgagtgccctttcaatgtctcgtcccgttcgactggaagcgaacgccgtgtgccgccatgcatggatgggcgatgccggaattggtatataaatcagctgtagttatcttcctcttgagatgaagcgcaagtgggtgcgcacctctgtccctttgggggagacccgcccactgcgcttgggggacgttcggatggaatcgtatggcgagaagctgactgaggtactggcggagccgggcatcccaaaaaggcgagaggtcatcagcctcattctgcacctgggtctgcccgcagtgctcgcggaggtgagcacgaccgtgatgcagtacatcgatactgcaatggtcgggagcctgggcgccaatgcttccgccgcgattggtgtggtgcaaacgacaacctggcttctgtttggttgttgcgagtgcgccgccctgggcttttccatccaggtcgcacagttccttggcgccgggaaggaccgtgctgcacgtgacgtggcatgccaggggcttgtggtgtgcggcgcgttttctcttgtcatcgcatttgttggaatggccctctccaagtcggtgccaaggtggcttgggggtccggcgggcgtgctggacgatgcggcggggtacttcttcttcatgagcgcgttcatgcccgtggtgatgttgcagcggtatggtgccctcatgcttcagtgtaccggggacatggctaccccaagcatcatcaacgtggtgtcgtgcttcctggacgtggttttcaacttcctcctcatcatgccgggggctgtccattcccttggcggggtctcggtgtttttccctggtgcgggaatgggtgtgcgcggcgcggcagccgggacgggcgttgccaccgccgccgcggccttccccatgctctggttcgtattttggcgaagcggaaggctctctcttcggaggggagccagctggacgctggggaagccctgtctgagaagtgcgcttgtcctgagcgcacccctcttcctggaacgctttgtgatgaacggtgcctacatagctcagaccatcgtggtcgctccgttggggaccattgctgtcgctgccaactcgattgcgactaccgccgaaagcgtctgctacatgccggggtatggcctctcccaggcagccaccacgctggtgggacaggcctttggctcggggaggcgtgacatggcgaaggccttcggcaactattcggccctgcttggagtcctcctcatgggggcagccggcggcctgatgtggttgcttgccccccaggtgatgacaatcctctcgtcggatccggccgtttccgcccttgggtgcagcgtcctcaggattgaggcattcgcggagccactctatggtgccgcgatggtcatcccaggcgggctgaggggggcgggtgacaccgtcgccccgagcctcatcaaccttgggtcaatgtgggcgatcaggattcccctgatggtgcttctcgccccaaggctggggctcgtgggaatctggagcgcgatgtgcatcgagctgaatgcgcgtgggtgcctcatgcttgctcgcctgcttaggggaaggtggctgaacaggtcctccgtcaccgaggcgcgctaggggatggcgctcgcctctctgcccatcccggggatgcctctctgagacggacgcccctacagcccgaagatgctctcgagcgtgacgagtaccccagattcctggtttgaggggcatatggagttggcggcctcctttgtcctcgcggaggcgttctccatcgcgtagccccagcccacctccctgagcatctcgacgtcattctcgttgtccccgaatgcgatgcaatcggatgccgagaggccccaacgcctgcagaggagccgcagcgcgcttgccttggtacatccgggtaccatgaggtcgatcgagccgtttccagagacaacaggaacaagcgcgctcccaagggcatccgagagctccccggctacctccccctcgctcccgttttccaccgagagcgagaacttcaggggggtatcgtcgacgtcggcgaggtcgtcaacccactcgattcttgtgaagtacctggacatggtcctgaagaacctctcactggcggtaccgcgctgaacgtggcagcacctccgcccgcagagggcggcctccgcccttccgtcgtcctggatcacctgccacgcgcgtgcgagtatctccgcctccatagcgacgcacgaaacgacctctccgtttcgatggtgagggccccattctcggcaacgtatgtgagttcccagtcgtcctcgaagaagcttctgagctggtaatactggttgccgctcgcaatgacaaagcgacagcccgcctctcgcatcgttcggagtagcctcgcaaaccggaccctgtcgtagtcgccttggtcatcgagaaaggttccgtccatatcggtggcaaccagtcgggggagattggcattcggcacggagtgggacaggtctgatgagcctctggctctctcactgagcggttgcatcctgggctccttcggtgttctctggcgcgttggcatccttgggcgttcgcgtcagctcttggcggatttgttcttgaaagcagggactaaataagttaatacgaaatatataccattgcggtagtgtgtacgccaggaaacgcgaggcacctgcttcgccatgctagcgtgagaggagttctcatggaaggaatcaagggcaaggtggcaatcgtgactggtgccgcgagtggcatcggcaaggccaccgcaaagcgatttgcggacgagggcgccctcgtcgcgatgctcgacctccgcaaggaggcaatcgaggaggcggcaagggacctcggtcttgaggagggcaccttcgtcgccctgcctgttgacgtgacgaaggacgatcaagttcactcggcggtcgatgcggttgtggagaggttcggtcgcatcgacgtcctctgcaacattgcagggattggcggaaaggtcggccccgtcgaggaccagccggtgtcagacgcacggacggtcatcgaggtcaacctcctcgggacctactgcatgatcaatcacgtcctgccgataatgaagtcccagaacgagggcgtgatcctgaacacggcttccgttgacgggaccgcctgctatgcgtacgaggccccctatgcgatgagcaaggctgccgtcatccacctcacccagtgcctggcaaacgagaatggcaacacgatccgcgtcaactgcgtctctcctggttgggtaaagacgccgatgatggacgagacagcagacggctttggtgacatggactaccaaaacgagggcgacctcgtggattacggaccccttggccgtgcggaggagccttccgagatagctggcatcttcgcattccttgcctccgatgacgcgaagatactcaacggcgttgacatccatgccgacggggggaagtacctcgggaagcaatagcacgttcgcctgaatgggccggtcagggatttacccggactacgtgctcgcgttaatgacggtctggtcgtgtgggagatggcgaaaggaaggcatcgtaatgatcaagtatgacaagcagcacgagctcgacagcgtaaacggggcgcttgcgattcgcccaacggtcgagaaggtcgtggacgagatctgcgacaggggctacgacctcatctgcttcatggggattggcggtacctgggcgtcgtcccttcaggttgagtcccacatcaaggagttgagcgacctcccggtcctggtcgagaacgccggtcagttcaacgtcatggggaacaagcgcatcaccgacaagagcgtggtcgtgttctcgtccgtttctggcaacaccgccgagatggtcgtcgctatggagacgctcaaggcaaggggcgtgacgaccatcgggttcgtcgatgtcgcagacgcccctctcgccaaggacgcgacgtattgcatcacgtaccccgagaacgagcagctcaagttcttcatggtcgcggaccgcttcatgaagaatgccgggcagttcccgcagtacgacgagtactacgcgcagctcgattcccatcttgccgaggcgctggtgagtgttgccgaggcgtcggacgagtttgcatgccactttgcgcaggagcaccacgacgaccagatgcactacttcgtcggggcgggggagcagtacggctccacgtactcctacgccatgtgctactgggaggagcagcactggcttcgcacgaagtccatccatgcggcagagttcttccatggcatgcttgaggtcgttgacagggacacgaacgtcactgtgttcctcggcgaggatgcggagcgtcccctggcggagcgggttgcgcggttcctgcccagggtatgcgcccggtatacgctcatcgactcgaaggactatgagttgaaggggatttccccggagtatcgcggctatctcagccatcttgtgacgcatcaggtcaccaaccgcatcgacgtccacatcgagcgcatcaactgccacccgatggagattcgtcgctactatcgtcagctcaagtattagggaatgtggcggggccatcccacacggggcggccccgcgtccttctttaagaacggttcgattccttttgtcggaggttgatcgcatgtcgacgattaccatgcacgatgtctccgtgatggggacgtcctatgtgcactattccttcgagtacttcctcgactcaatggctcggcttgggattagtaacatcgacctctggggtgccgagcccttctactgcaggctggactatgcagatgactacgctgcgacccagcgcttgaggaagatacgcgccgaggccgaggcccggggccagcgcatcacgatctacaccccagagacccttgggtacccgtttaacttcagcgacccaaaccctgacatgaccctacgaaccatcgaatacttcaagtgggcattcgacgatgcccatacgttggggtgcaaccgcgtcttcatcaactcggggtctgggttgaggaacgcggaccgcgaggagtcgttcaagcgctgcgtagacacgttccgggttattctcgatctcgccgagcaggcggacatcctcgtccccctcgagcagcttcaaccctacgagtcaaatcttgtggtgagcttggaagacgctcggcgcatgctagaagaggttggctcccccaacctcagagtttgcgtcgacctgaccgcaatggaggtccagggagagcgcctggagcagtacttcgaggcgtttggagacaaggttgagtggattcactactccgacagccaccatgaggtcgttgggagtggcgaatacggcaaggagaagcttgcggggtatattcgcacactcgaggagcacgacttcaaaaacggcatcgacctcgaggtgaacgattccatctactgggaagatccccactccgctcatgctgagacgtgcaggtacctacgcgaggagcttggattgaaggggtagcaggtccctcttcgactgcagagggttgaggaatgtgggcggtgtgcggtcggtttcccggtcgcacaccgccccgattgctattccaccccgcatagcatgcggatagaacgctcgattgcctcgttccaaaagaggaagtcgtgccttcccggccagcttgagtagctgttttcaatccccaggctggtgagctcctcggcagtcgacctgacgtgaggggcaaacggatcgtcagcaccaaccatctggatgatacggggaatggctccagacccattctgctttaccgactgctttgccttggcgacaatcgagtctgccttggagggtccctgggatccgaataccaccgcttgttcggcagccccaaagaagagttcggagaagtcgctcgcgaggatcgtggggtcagtgacgggggagagcgccgctatccccccgtaggcccctgggttctcgagtccgatgcttaaagctccatagccacccatgctctcccctgcgatgaacgtgtgctctcggtcggagggcaggttaaaccaggtgtgaatgatcgcgggcagctcttgcgagacccattccagatagcgagggccagatggggcgttctgatagaagctgcggtttccatctggcatgacgacagcaaaatcgtagatcttggcataggcctcgatcatcgagaagcgtgtccattcgtctgcgttggcaccgagcccatggaggaggtatagtacgcggacctcgtcatctattctggtccagaaatcctcagacttatcgggaatgatgatgttcacatgctgcgtaatccgaagtgattcggagtagaggtcaccactcaaagtgctcatgaaaccctcctaacgggtggttggcgcatctagaaacgttggtgagagggtcccttactcacatgcgatggaaatcgaatcggatgtccatccggtgtgcagagagttctcaccggtccccctcagatactaatacgaagtcaagatagataactacaggcttgaatttgtaccacttaccgataaataaacaagttggaacgataaattgaccacttgtgcaatcctactccctaagcagtgccaggcgcgtttcaaggtgcacctggtttcgtgcaacgccagtgaagtagcgagaggagtgggcatgtctgacagtaaggaagttgtcaagggcggcgaagggatggaacgccatctcggcttgagtacggccatcgcgctcggcgtcggaaccaccatcgggtcgggtatcttcacgtcggtaggtgcggttgcgggtgcggcggggacgccgctcctgaccatcctcgccttcctcatcggtggcctgattatgattccgcagaacctcatctatgcggaatattcaacagcatactccgaggacggcgggcagttcgtctacttccgcgaggccggatggccatttatggccatgttcttcatctggtcttgctggtgggctagcgacccggttggcatcgcaatcatgggccttaccgtcgccaactacctcgccttctttaccgggtggtcgtcggtgaccgtctccgtcgttgcctgcctcctcatcatcttcttcacctggctgcacatgtgccacaagcacgcgggagccaagtggcagaacttcatcaccgccttcaaggtcgttccgttcctcctcctcgttcttgccggcctcttcttcattaacggcggtaacctcgaggccgcacccgtctccagttctgcagcggcacatggcgggcttctctctgccatgattgctggtattgcggcaactacgtggtcgtacgacggaatgcagacctgcgtcaccatgggcggcgaggtcaagaaccccaagaagaacatgcccatcgcactcatcggcacggtcttcgtcgtcacccttctctacgtcctgctctccgtctctgccgtcggcctggttaacatcgacacccttgccgcgtctgacgcacctgtcgcagaggccttctcgcacattcccggcatcggctcccaggcaggtaacattgccgcgattcttgcggtcatcgtcgtgactggttccctctcctcgctcatcatgttccaggctcgtggcgagatgaaggctgctcaggagggctactggtggcgctcctggggcaagattgaccccaagtacgattctcccgtcatctccatgctgtggcagtctggcttcgcgctcgtcctcgtttgggctaccagcatccaggacctcgtggcaatcttcaccttcatctgcctcctgcgtaacgcccttctcttctgcgcctggttccccctgcagaagaagaacaactaccaccccaccttcaaggctcctggtggtcccgtcatggcaatcctcgccatcgtcccctcgctgattctgatggttggcgagctgagcggcatcatctctggtgaggtgcccctgttcagcttcaacccgatcagcgcaggaattctggtcgtcatctccgccgtcccgttctacctgcactggaagaaggtcaacgcggacatcatcgaggctgccgaggcaaggcgcaacgccgagatcaaggaagaggtagccgaggaagctgcagtgcagcagtaagaccggttgcaaaagcacatacgtgactgagtaatgagcgccacccggtcgtctgacgatacgtcgggcgtcgggtggtctccttatacgagagggatttcgccatgctgatgaacaggcttacgagcgaggaaatcttcgaatggtgctccatcccctggcagagccttgagggatgcgagggcaagaagattaagctcgcagttcacaaaaatcgagcggagatgatggcggagattggaaacctcatggcagatgaggtgcgcgaccacaatgccaaggggcttccgacaaagtgggttctccccgccgggccgtgcgacgagtacgacacctttgtgaggagggtcaacgaggaggggattgactgcaaaaacctctgggtgtttcacatggacgagttccttgactggcaatgccgcccctatcccgttgcggacacctatgagagcctcgagggaaccatgctggcgtgcttctataacaggattgacggggggcttcgtccccccgaggatcacaggatctggcctaggattacgaacctcgactatccggacgagatgtgcgacaaacttggcgggatcgacaccgtctgggcggggattggggcaactggcctcgtcgccttcgacgaggagccgcgtgactactggtatcggccgacggtcgaggagtatgcagactccaagacgagaatcgtcgacatcaactccgacaccatggttgccatggcggagcgttcgtttggaacgtgcctcgaccgcatccccccgaagggcctcacgattgggttccacgtcatctgctcggcaaagcgcgcagtctacatggtcgcgacgggcgactggaagaagaccgtctgcaggatcatgctctttagcgagccaacgactgagtacccggtgacaattcttccaaagtacgtccctgacgttaccctgtacaccgacgagtacacgattgaccacccgatgtcccatgacacgagggggtggtaggcgatgacggcgagggatgccatcgtcctcaacagccacggtgtcggccaatacgcatactgcgaccacatgccgagctggggggagacgctttcggtaagcaagtggcacattgccgaggacgggggaaagggttcaaacgtcactgttgccctgggtcgccttggactcgatgtggcatatgtgggaaaggttgggaatgatgcctggggtgacctgggcgaaaaatggatgagcgacgcgggcgccgacacgaccttcctctatcgagacccttccgtctcgacgggaacgggacttgtgctcttagggccagacggaaaaaacgcgatcattgacggggacagctcgagctcggctctcacggtggatgaggtgacggccgccatcgaggggatgcgtggctctaagtatttcatcacgggctttgaggtacctgaggcaatagccctcgagggggcgaggagggcccatgcccttggcatgaagacggtgctcaacccctctccgctccccgccgggaagctcccgcccctcgacttcgtcgactacctttttgtgaacgaggtggaggcagcctccctggtcgggatggcgaaaagcgatttggagggcctcgcaaagggtgtgttgcaggcaacctcggcaaggaatgtcatcgttacccttgggtccgatggatcctgcgccctgacggaagaaggcgagtttctcacgatcgatccggtgaaggccgagaacgtggttaacacggcgggtgcgggagacggcttcatggctgcgacggtcgccaacctcgtatggggaaagactcttcgtgaggcgatggagtgggcaagctactactctgcgctggcggtcaccatcgatgggaccattcccgcctatcgacccctcggcgaagttaacgctttcattaaaggacaccagtgcgagaagtgcgaggagtgattttaaatggcaaggtatcttctgaggtcaaatgcaatcttcgactccaatgcgagcgtcacgttccctgggtacgtcgcggtcgagggggacaggatcctctcggttggtgagggcgacggaggagagctggtcgagggggacaccgagatcattgaccttggtgacaagctggttaccccgggactcgttgatgcccattgcttctttaacggctggcttctccagcattacggagcggatctctctggggcaacaacgatagaggacgcgatttcgattctgcgttcctcgcgtcacaccgacttccttgtgggccacgggctgtccggcaatcttgccggggtggaggaatcagtgattgacgccgcctttggtgaccttcccaccgtgctcgtatgcgttggggcggaggagatggtcatgaacaccgccgccgaggatcgctttggcttcacgccgagtgcatgctggtccgagaaggcgtacctcctgctcaagtcggtgatggaggattcggaggaggcgacccgcctctatcggcagtacatgcggatgatgaactcctacggagtcacctcgactaaggagattggctacgacgacacgtggttctttgatcaggcaaggaatctggaaaaggctggtgagctcacgctgagggtgagcgtcatgagccagccggtcggcagggacgctgacatcgagtatggcatcagggcgagggagtctctcgagggcgaccccatgctctcattctcgggctacaaccagatgactgatggctcgatcagtcagaacgagggtgaaatgaaggagccgtatctcgatctcgacggtacgtgctcgatggacatcgactgggaccaccacaaggacgaggtgcaccgtgccgaggaggcggggttcaggttctcgcttcacgcgcagggcgacggtgcggtggcacacgcccttgatatattcgaggggtgtgagagggacgaggaaggagcactgcgtctccgtcacgcgattaccgacctggaggatgcggaccccgccgatttcgagcggatggctcggctcggcgttgttgcggaggtgtacccgcttatacagtccattgcggaccgcgagagcaagctgtcgatgatcacggagaagatcggacaggtgcgggggagccactactggaaccgccgcgggctcatcgacgccggcgtgacccttgcgtgcgcgaccgatctgccaatgactgtcgacgaccttggagagggggtctactgcgcctgcggtggatacttccccgagggcggagagcccttcaacgcacagaacatgatctctcccgcggagctccttaccgcctggacgaggggaggggcgtacgacctcatgagagagggtgagctggggacgcttgagcctggcaagctcgcggacttggcggtgttcgacaccaacgtgctcaagaccgatccccgtgaggcaagggcctgcaagtgcgttctgacaatcgttgggggccgagtcgtgtatgacgagcgataagggttcgagtcagcgacattgatggcaatcacagtggggcaacgtccgatacatgcaggcgttgccccaccatctagtctatgggggccaaatggtgcagcctgatttctccgtagcgttctccgagatcctagagcagcccgatctccttgcccgacttagggacaccagggatgcttgggcaaggccattcgtggacctttgccgggaacacgacttcaagcgggtgctctttgtagggaacggttcgccatactatgtcggacgaaccttgcgctatgccacggagaggctcttgggggcaaacgtcgatcccgtcatggcaggagagttcgctttccatgggttgttcgactgcaccggagggctggatccgggagaggttttgctcgtctgccccgcggagactggacattcccgaggccaggtcgatgcagcgcgacgcgccaggcacaccggggttcccgtggtgtgcaccaccctcaaccctcatggggtgctcgcgagggaatgtgacgtcgtgctggcaaagcccggatcgtgcgaacgctccattgcggccaccaagaaccaaaccatggccttgtacatgctgctctcttgccttgtcgaagccgggcacgttctgggcagccttggggatggggagtatgcaagggcgctcctcgccttggactccgtgccggataacgtgcgagagaccatctcgatctcacgggactggtacctgaggaaccgagagaggctcctctccgcacccggattcttccttgttgggtatggtgcaaactatgggacctgcctcgaggggaccctcaagttcgtcgagtgtcacgagcggcccacccaggcggtccaacttgaggagaccctgcatgggccccttcgctcgctgcatcgggacgacgtgatgctgctcctctcgaccgaagcgggttgcgagagggaccggatgacgcttctttccaggcagctcccccggtactgcgacaacatcgtcatcatcgacagccttttccaaggggagatacctggcgtcccaatcgacaacacactctcgatttcgtcctctgactttcccgacgtctgctccatcgagtacctcgttccccttcaggtcatcgcggtgctgctcgcacaggacatcggaatcgacctgaccgtccccaaggttcccgagcttgatccagtcatgctccccgcctacgaggactaggggtgagttgccgtggccccttctattccaggcggtaggcgccttttcgcgtgcattgacatcggcgggtcaaagttcgtcgctggcatttgtgacgaggggggagatatcctctgctcgacgcgccatgagtggtcgggggtgagcgaaggacagattctggagcaggtagcgagtgcgatgggagaagagctcgccgagcacccaggactacgcaatcgggtggttgccggaggggttaccatcccggggtttgccgatcccaagcgcggcatctgggtcgactcggattaccttgacgtgcatgacctcccaatttgcgacttcctcgcgaatcggctgagactgccgttctttggcgataacgactgcaatgcatgcgcgctcgcggagcactactttgggaccgcgaagggtgctcgggacttcctgtacattaccgtgagctccgggatagggggtggcatcttcctgggggacaggctgttctatggtgacaggcagcttgcgggagagattggacttaccgtggtcgaggatcgtccgcgaccagagttctccaggttcccgcgtggcaggctggaggactactgctcgactcgtggcatgcgcacaacctatgtctctcttggggggacggcgcaatcgagcttcggggggagggagattgccgccgcggcacgggcggaagaccccgcggccttggagacgatgcggctcgagggcgtgtacctggccagggcgattgctcgcatggatgccggcgcggcgccgtcgcaggttgttgtcggagggggggatatcgctggcgttcccagactatggtccctccctcttctccgagctcagcaggacccgaccagagagcagccttcaggtgaagccgtcaattctgggataccagggggcacttcttggagcctgtgcttgcgcagtccgtggattgagcagtcccctcgacgaggcctcccttcccggaagtgggtccgagctgagaatcacgagctcccatgggaagaccgcctgcaggcttttgtgtggcggagaggaccttcttcccgccggggccggcgaccttgggtcatttctcgtcgcgtcgggagcttcggacgaggggattgagctcgacggtctattgggtggcgtctcactggggttcctggtaaggcgggcagagcaggggaatgccgacgacttgggagcagtggagaggttcggacgctctcttggcgcggcggtgtcgtattgcgccaccctgctcgatcccgccgcaatcgtatttgaggatgacctcgcggcggcagagggcctgtatcgcgaggaggtcctcggggcgattgaggatgacagctattggcaacgggagggcttgccgtacgtcatcgagtggtgcccccctcgtcctaagggacgatgaccataacgattcggcagccgatgcgactctcgctcttgcgatgtggcatcggccgccgacgtgagacctgagctggcattggacgggactataggacttccttgtccacgtagttctcgctcttgcccgacagtctgtcgtcgaatttcgcgacaagtgggtgcttgtgccacaggtgcttgtcctccgtaagccggaatgcaagcgtctgatagaacggcaggagcgccagtggagccagcaggctgggctccaggggatcgaccacaatgtccgccccctcgaagttagggtcgtctgtgaggacgaagacgtggtcggtgacaagtcgggtggcctccgttatctccctggcacgggcatgatcggacggacccacggcgttcacgaagaccgtgtaggcgggcgagagctgcaggtttgggccgtggaggtactcctccagctcaagggggatcgcgggaatctggatgcattcaccgaacttgagggcaccctcgcaacctattccatagtttgttcccgccccaagcagaaatgttctctccatggaggagagctccttgaagcggcgttccagaacgggctgtgtctgctcaaagacgctcgtgtagcgtgggagaagacccctcagcccgtcaagctcgcgctctcttccgctctcgtccaggcggccctcgcgataggcgacgtcgataccaaagaggacgaggaagatggagagcgccgtgacgcccttggtgacgtaaccgacctgctcctcacccactccgtaatcgaagaggtcgtcggcggcgtccttgaagtcggagctcacgtcacccgtcactccgatcgcctttcttccggaagacctgatgagggagagcgcggcgagcgcattcgtcgagtatccgctctgggaagtcacgaaggtgaattccgtggggggaagctcgtgctcataggcgcaaaacgtgtacggctccgtgatgattacctcgcggtcaagcatcctgcgaagatacggcctcgcgatggtcgcggcgttcttggaagacccgcaggcgacgatcctgactcggtcgtactttgattcgaggaagcaatctgccaggggggccgacacgtcttgtgcgacctgccgactcagaacttgcggagtctccagtacgtaatcaagcatggtttttcttgacatgagtcccccaatcgtcggaaaagaacagcgaggcagctccgatcacgcccgactcctcgttgagtgatgacaggcgtacctccgtgtgctgccccccaaagacctgcgaggtgattccggctcgtatcctgtcgacatatggcgagagccctcgtgccacgccgccgccaaggacaatcacgtccgggcaatagaggtagacgtactggttcaatgcccgcagaaggtaactgacgtaccaatcggcgacgttccttgccgcgcggtccccccgttccgccaactcgaacatctccttgacgctgatgccctcgccaagctcatgtcttacgtgacgcccgagggcggttccggagcaagtggactctgcgcagccctttattccgcaatagcagggaacatcatcgagccaggggtattccgttccctcgcggaccttgatatgtccggcaaggtgaaagaacggctccctccccaagggcttcgcgtcctcgcagatcccaatgccgattcccgtgccaagggtgatggtgaggacgcgagagaatcctcgcccgcttccagcgactgcctcggcaaggcagatgaggcgcgcgtcgttttccaccctgacggacttgcccaacgccttggaaagcctcgcagcgagcgggtagccatgtaccaggaagtggaccatggaagagaggccatcgatgctaccgtcgcagtacgtgtacgaccctatggagacccccgccgcgagggggtccccggccttctccgagagcctgtggaccgactttcttatgttgtccagaaacaactcctcggagcaacgctccgtgtcgaagacctccatcgaaagcaccgcggatggatttgccgcatcgactaggccaaccttagtgcgcgtgccaccgatgtcgattccgcagacgagcctgccgtcgccgtgggggcttgaggtgctcacttgaccacccacccgtcctcgaagaacattccgggctcgatgccattcgcaattgcggtctggtagctcaggagctggaagtacatggcctggaccagcatcatccagtgggcgggaaggccgagatcggggaagatgaagcgattggccgccctggcgtctggattcgtcccaaagtacactgtgtcctgggtggcgtcgttcacgtacccccatatcatcttggagcgtgagtcgggaagtgcatcgaggaggatggggaccgtcttcgacttcgcgatgccttgggctcggatgagctccatcggcccatgatagaaattgtcgaccgacatcacgttggcgggcaccttggcggtctcctcgagccagagcgaggtgctccgcatcatgttgagcccccatcctcgggaaatgaggtagaagctgtcggcctgggggaggaagccgatgccctctattgcctggagcagggactccttgttctcttccatccacgagaatgcgccttttagggagttgacgagcgcgcggtccggaacgtcgcggtccatcatcgagacgatgaacaggccgcagagtgccatcgagctatatgccttgatgcatacgatcttgtcgtagctggcaatgtcatgcagcgcataggtgcagttgaccgccatggtcgaatccggcgtcatcgtgacgcagacagacgtgtaattgtgctcgtgtacccagcgcgagaaatcagccacctcacggctctcgccggagcggctcatcatgaagtagagcgcgtttctggagaggcgctccggattatgaatgagctccgcagtctcaatgagcctcacgttacgcatgcctgcctcgagcattgcctcatacataggcatgagcgagtaaagcgcactgcccatggaggtgaggacgacctcgccggagaggtgtaccaccctgcagatgtcgagcacctgctcgagcttcggcccagtcaggtcgtcgagtacccttacgagctcctccggctgttcgtagatgttctgaagtatgggattgatgtccatgtctgtgccttcccccgagactgctgggagttccagagatgcggtgccgcctgaacgacgggtacgtggaaagcatataactaagcaagcgcaaattatgtaccaggatgaaaagggtgtcgacaggcgtagaaatccgcttcgcgagaacgacagtctgccagtggaacaaatctgcagagatagtaacggagatcgttcagcaggggatatcccccttccgccgacaccaagatggccagatgcggcaggatgctacatttcgaatgagtggtatagaactaaattaaagtcatctggtggaaaatcaggctaatggagggacggctgagaatgggacactacatcacaggcgtgcttaccgagatttgtaccccgttcaagaagaatggagagattgactacgaatatctccatgacatgatcgagtggcagatagactgcggcatcgagaacttcttcgtcaatggctatgccggcgagtccttcgagctctcctttgacgagaagcttgccgtcctcaagtgcgtatatgaggcgaaccagggtcgggccaagatcatgggttgctcctttgagaacgacattcgggcgaacaagaggctcctcgatgcctatgagaggacggggatgtgcgactgctattgcgtcaccgcccctcccttctacaagttttcccaggctgctctctatgattggaccgcagagctcatcgactacgcaaagcgtcccgtcttcatctacaactgtcgcgagcagggggtcatgtatgccccggagacgctgggaagactggccagcgagcacgagaaccttcgcggattcaaggacgcctccacgaacatcatcaacttccagaacgacctgctgcaggtcgacccggagaacttcgacctcgtcggtggctgcgacggctttgacggcgtcatgatcctgcttggaggggttgggtgcgtgtcgttcatggccgtcccctatccccgggagatgaaggagatcgtcgacaagggcctcgcgggggactggaagggctgcatcgaggcccagcagaaggtcctgcgtatccgcaacatcctcaagaagactccgttcaacgccgggtggaactgggcaatgcagtatggctttggccgcccgaccgtctctcgcatgggggagaagcaggactgggttccctatgaggtgaaggtcgagctcgatcggctcatggtcgaatacggataccagagcctgggcgacaagatcttccccacaaagctcgacgaggagatggcgggaaaggccgacttccgctagggggtcgtcgaatcgcgggtgacttcgaatcaccccagcggtgttcgagtttgccggagcaagggcgagcgtcctggaaggtgcggcgcgctcgcctgccttcaagagggttctcctcggggagagaggtgcggaattgtctttcacacgggttggcttcacccagtcattcttctcagaccggccaatcgagctcgtgagcgatggcgagctcaaggcgaccgcgtttcggtacgagacgggggtcgccgggctgcgcgtccagaactcccgctcgagcatggtcgtccttccgtacatggggatgcaggtctggttcgtcaccttcgacggcaggaacgtcacccagaagtccatgttcgacatgccgctggcgacgacgaagttcggcgacaactacggggcgttcctgtaccattgcggtctcaacaatgtgaacgggccggaggagggggaggatccctaccccatgcacgacgtcctgccatttgccgtctacgagaacacctacacgggcgttggcgtggacgaggagggtaggtacctcgccgttggtggcacctacgtgttccgcaacagtcaggagttgtattgggcctacgccccggagctcaggctctatgaggggaagacgatggtggagatgaaggcgacggtgcataatcgtcgaacccatccgcttgagtacctctggctatgtcatatgaactggctgggggtggaagggggccgattctactacagcgctccccaggatcctgatcacgtcctcgtcgcccccacggagcttgggaacgactcccctcgcgccgttgcgattcgcgagtgggggaggaagctggcctctgacccaacgctcgcagatgtgcttgactccagctcccaggtgtacgacccggagatgtgcatcaactatcggtacgagaccgacgaggatgggtgggcccactcgctcatggagcttcccggtgggggctcctactacgtggcgtgggatgccacgaaggccccgtatgccctgagatggctgtgcaggaccggtgacgaggatggcgtcgggattgcggtgcccagcacggggaccaacaggggttcgtcctaccagcgggagcacgggcacttcaacacgcttgagccaggagaaagtgacgtcctcaggtggcgttttggccttctggatgaacgcgaaaccagcgatgccaaggcgtgcatcgacgcgatccttggcaggtagttcccttgggcttcactcggcttgatggcgacagatgaaaggcgggacacatggcgatgagggtgtcgctcttctcgactgggtttgcgagctggccattggagaggaccttccaggcggctgctcgctgtggatacgatggggtggacgttgggggattccgtccccacgcatatccacccgacgtgcttgcgggggtcaacggaggagcctccgcgattctctcctatgtgcaaaagtaccaggtccccatcgtcagctatgttcccgagaacaccggatcaccccatagcttcgtgttcagggagcgggagctgaacgacatctccgtcgagtacttcaagcagtcagttgacgctgctaaggcgattgaggcacccatggtgatgtttgcgattaacatgccggggtttgggatcgaccgggagtacctcaagagacaggtggtcgaagacctcaaggtcatctccgaccatgccgcagcccttggggtgaccgtcatcctcgagcccgtgaccccatatgagggcaagctctgctgctcgtctgatgacgtgaagtacttcctggacgaggtcgacaacgatgtccttcaggttgtccttgacctcgcctgccctctcacgtgcggcgagccgatgagcgagtactgggaaaagatgcccggcgcggtgagggaaattcactttatcgacgcggagccagactgtgaggaccacctgattcccggcgacggctcgatggattggcctcgcatcgtcaactacctgcgaagcgttgactacgacggctaccttgcactcgaactgttcagcaggtatggcaacgagccggacttcgccgcggagaggggcatcgaggtaatcaggggcctgctgggtcggtagtcgctgccttgggaggaaacgtgcgtctcgccagtggggaggcgtctgacggaaagagggtgtttcgatgggcaagaacggtccgattgacgtaatcgttatgaactctcatggcgtcgggcaggtgtgcaacgtccacaggctcccgcgtcgaggagagacgatggaagcgtggaattggcatgtcgaggaggatgggggcaagggggctacggtctccgtcgcccttgggcgactcggggtatcgaccggctacatcgggaaggtcggctatgacccttggggggacatgggcgacaagtggatgagcgaatcgggcgtggataccacctacatgtatcgtgaccatagtgtctcgaccggcacgggcctgatcatgattgatgatgacggccttaacaccatcgtcgatggcgactctgcgtgtcgcgcccttacggttgacgagatccatgacgcgattgccgccatgagtgaggcaaaggttttcatcaccggctttggcatgcccttccagaaggcgcttgcgggggcgaggattgcgaaggaagagtacgggatgacaaccttctgcaacgcgtccccccttccctccgagccactcggtgaccttgggtttgttgaccacctcgtggtgaacgacgtcgaggggagggtcctctgcggtttgccggaggactcggagactccgttcggggagatctgccgccaggtcgtcgccacgtatcattgcaacggcgtgatcatgacctgcggggcagagggatccgcggtgcttgatggagacgactacttcttcgtccggggcaccaaggtcaaggcggtgtacacgattggtgcaggcgacgggtatcttgcggcgaccgcagccggtctcgtgtggggcaagaccctcagggaagcatgcgaatgggcgagcaagtacgccgcctataaggtcacccgcgagggcactatgacgagtaggccgggagagggttacccaccgctctccgatgtcgaggaatggatgaggtccctccaggagtaacgaatcagatgtaacgcttccccctcggcgctgtgtcccacggcgccgagtttcttttacggggggggtaaaacgggggtaaaggaaggcggcgcggcccatcgtgtggatgggccgcgccgcacctgagctttgtgggtcagcctgctgctaccaggcaccagaatactggagtgtcaccgaggagctccttgccccctcgcccatgcagcccgggatgtccttgttctcgaggacgcccttgatgaagccggcgatgaaggagtcacccgcgcccatcgtgtctgccacctcgacctcgatgatgccctgcttgtagaacctctcgccatcaaaggcgaggctgccatgctctcccagggtgacgatgaccaccttgggacccagggcctgcttctccttcatgaacgagcggacctgttcggtgtcatcggactcgagcccgaagaaggcgtagtcgacgttgcctattgactggtccacgaccggatcgttgggctggtcggagtagtcgaaggcgacgagggttcccgactcctttattcgcccgaggtcctcggccgtgtgaccccagatgccactgacgacgaggtcgtgggagcagacgaacgagaggtcctcctcgctcatcttgaagtctgccatcacgccctcgacatagtcgccgaagacgcggtttccgttgacaatctggacgtaggtgacggcagtcgacccctcgctcacgtggacgtgactggtgtcgaccccctttgccttaagcgaatcgacgaggaaccttccctgctcgtcggtccccacgacgcccgtgtaggaggcgtctatgcccatacgctcaagatagacggcgacgttcacggggttgccgccaggatactgcttcccctcctccttatagacatcaacgcagttgtcacccacagccgcaactttcatgtgcgtctcccttctcagcgccacgaggcgcatcatccgagcctgcttgcgaaggacagctcccatggtacttgaatttgacggaaggtataaaagagagacgtagaagtatagcaatttccgatagatggtaaatccacatttgagatggctaagacacagttgaacgtgatgaaaatacctgcagacggcagaagatgcggatgctgtaccgtaacagaaaaaatgaactaccatataagtaataggaaaaactataccttagcttgggaggtcaaatgagagcggcgtgtatcggcgacaactgcattgactactatcgaaacctcgagaggaagtatcccaccggaaatgcggtcgacacggcggtaaacatgaggaagctgggcgtgccgacctccatcatctcgacaaccgggtctgatgagtacggaaagtggatgatagagactctcaagcacgaggggctggatacgtcccatctcaaggttgccgagggcaagaccgccattacgtacatggacctcgagggtttggaccgcgtgcacggcacctacgaggagggcgtcctcgccgacatggtgtttgacgatgaggatgtgcgctttgcgattgagcatgacatcgtccatacggcgctgtggggcaatgcggagtcgaccctgcacagaatccacgaggccggaacaaaggtgagctttgattacgcggataagctcgatcacccattggttgaaagcacgcttggcgacgtcgactacgccttttactcctaccacaaggggaaggatgacttcatcaggtcgtttctgcaagacaaggtcaacaggggcgttaccgtggcgacggcgacgtttggggaggaaggcagtctctcctgggacggaacgaggttctacgacggaccggtgtatcccgccaagaacctcgtcaacacggtcggggcaggggactcgttcattgccggcttcctcgtcggggttctcaacgggaacgacatcgcgagatgcctcgataggggagcgcggattgcctccgaggtggtaagcgtttttgagccatgggtggcttccgagtgagcaaatgaccctcggcacaattgttggaaaaggcgagatgggagaagacaatgttcaaaatcgggatgttcacttcggggtatcagcgcaacaatctcgaagacatgttcgtggacgccgcgcgctttggctacgacttcatcgaactgtggggcggccgtccacatgcctatgcgccagaccttgccgctggcgatatcgatgagataatccgacttcgcgataagtacggcgttccaatcacggggtactgtcccgagcacaacgcctatccgtacaacttcatgattgggtcggagcgtcagcgtgaggatgccgttcgctatctcaaggtctgccttgatcaggcggcaaagctggggtcagacttcatgctcgtctcgcccgcccacgctggttatgacgcgacgtacacccagatgcgcgaccgactctacaggacaatggaggaccttgctgcgtatgcccgaaacgttggggtgaagttggtggtggagccgcttacccccgaggagtccaactgctttaacagcgcaaacgacctgttggagctcttcgagcacgttgacaacgagtatctgtacgggatgatggacatcgttcccccctatcttcagcaggagcagatgatgagctacttcacccttcttggcgacaagctgtatcacctgcacatccccgattccaatggggtggatgcgacgcacctcattcctggcgagggggtaatgccctacaaggaactcatgcaggagattcgcgaccttccctacgagcgtacggcaaccattgagctcgtgaccaactacatcaacgaaccgcgcctgtatgcaaagcgtgccatcaataacgtccgcgccatgcttggcgaggagtaggtcggagccatcccatgtttatcgacgtacacgtacaccctgcattctacgagccgatcaacgacgaccccatgcgcgagaacatgcgtcatgaggtgcttgacatccatctaaatggcatcgccaagctagagcacgtgagaaaccagatgaggcttgcgggtttggataagctctgcctcctcccccaggactaccttacggaggagggggaggttcccgtaaccaacgaggagattaagaagctcgttgacctgatgcccgatcagttcatcggctttgcgtctgttgatccgcatgaccccgaggctgccgaaaagctcgatcgcgcctttggcagccttgggctgagcgggctcaacctccatcccggcaggcagcgcttctatccgatggaggagtgcgtgcaacctctttatgacatatgcgagacatacaacaagccagtgatgttccatgctgggatgtcatgggagcctcatacgcttgccaagtacggaaggccgatcgagttcgaggagctggcggagacgaggccgggactgcgcttctgcctcggccactttgcctggccgtggctcgaggaggctgcgatgctcatggtgaagcacaagaacgtgtatgcggatactgccgccctgtactttgattgcgcgagggaattctactcgcgtctcttcactagggagctcgaggtgacctggattgacaggagcctgaggcaccaggtcatgtttgggagcgacaacccccggtttgagcagatcagaatggcgcatgccctcgaaggccttggcctgagggacagtaccgtcgagctcatcaaggggaagaacgcactcgaattcctcaatggtttggagtagtgggtgagatggtttacgaggagaagttcactctcttaacgagcgagtacaaccagtacatcgtggtgaccaagatggttgaacgcgctgttcgcgacagcggcgttcagaacgggatggtcacggtcatctctaagcacacgaccgctggcgttaccacgaacgagtccctggagtgcctcgagagcgatatcgatgtgttcctcaagcggcttgttccggaggattacccgtattcgcatgccaggatgttggccgactatggctccaccgcgggaaacccaacggggcatctcaaggccatgctggttgggaaccatgcgcacttcatgattcgtgacggggagatagaacgaggcggtgcccaggaggtctacttctgcgagtttgacggaccgtccgagaggaccttcatcgttcaggtcatgggagagtgatgggagtggccaattagaggagaaaagcaccttcggtcagaacagagtccatccaagtggtggatgataattgcataagctctctctgcccatgtcgcctgaatttctgaactatactggcgctatggaaccctgatttatgcccctcgaggggtctcacgataaggcattgaatttgggtgatctaaaggacacgatttcgagcggacagagtttcagatgagttcaagagagaagattgctgaacttatccaatctttcatcattgagaacaagctccagccaggggacaggcttccatcggagcgtgagctgtgtgaaatctggggcgtcaacaggatgacgctccgaaacgcaatcaaacgcctcgaggacctcggcgttctagagagcaaggttggacttggcacgttcgtcgccaagcctaggattgtccgaaacctacaggatacgctggggttctctgatgccgtccacgcagcgggcggagagctgacgcgagaggtggtcttctgcaagctcgttgaggccaacaagtttgcggttaagcaccttcacgtcatgcttgcctcgcccgttctcgccctgactcgcgtcgatagcgtcaacggtgagaaggcggcgatagagagcgttttggtcaatgcccgaaattgcaaggggatagaagggcatgactattcgaaggagtccctgtacggtgtgctcagggactcctacgggattatcgctgaccacgggtcggagaagatcgatgtcacttccctctccgaggatgaggcggacctgcttgggtatcccgtgggtactgccgcgttctttcaggaggggctgatgctcaaccaggagggaaaccccctggagtacttcatgaacgtgatactacccaagagaatcatcctcggctcagagatgaggccgtttgcgggtatgggggaatttgacaatgcatgagattgacgagaactcaccaatattcatgcagctgcgcgaggtggtgcgagagcgcatcacgacgggggagtatgctcccggagtcgcgattccctcggagaacgcgcttgcccagacgtatggaatcaatcgcctcaccgtgaggagcgccctggatgggcttgtgaaggaggggcttctcaagcggatccaggggaagggcgtctttgtcgttggtaagcgcatcgagcgaaacctcgactacctaaccggcttccacaaggccatcgaggggggcatgtcaaacccctatgtcaagattctcgagaaggagaggagacgcgcgggctatctctatgcccatgaacttggaatctcccccgatgacgacgtcttcttcatcaagaggctttgctatgccgacgggaagcccatttcgctcgagtccgtatatgtcccatgcgagctcttcccaaacctcatggacgtcgaccttgaggtgttctcgctccaagacgtgtacggcttctacgggtcgtctcctgatcgtgcgtggcagactctggatatcgtctctgccgaaccgaagatggcacgcatgctcgagcttggggagaacaggaacgtgctcctcttcacctgctatacctatcgggctgatggcaggacgatcgagtacatgcagtcctataacaggagtgactcctgcttctttacggtcaaggtgacgaatggctagggtcgggcagcccttctttgatggcgaggccggccacatgaataggtgacaagctctcactcgtcattcgtcgggcagaccatttctatccagggatttgccgtttgcagcctcgtttgatactccgcaggccgctagtctggctttgcctaccgctaacgtgcgaagcaaggctcatctcaatctagctggtataaaatataacagaagttatctaatccatcgctcatagagagagggtgcatgatggctggctgttattttatgggcatcgatacggggacattcgcaagcaagggcgtcattatcgatgccgatgccaacgtgattgccgagagctcggcggaacacggcatggagaacccaaagccgggttattacgagcatgacgccgaggcggtctggtggcatgacttctgccagataagcaacgacctcattgccaagagcgcaatagacccgaaggacataaagggggtcgcggcaagtgcgctgggcgccgactgcctgccggtggacgaggaatgcaggccactgcgcaaggcaatcctctacgggattgacgcgcgcgcacttgaccagtgtcacgagctgaccgagatgtatggggagagccaaatcaaggaatggtttggccgtcccctcggctcctctgacgtgatgccaaagatcctttggatcaaggagaacgaacctgaggtctatgccaagacccacaagttcctcactgggtccagctacatcaccgcaaagctgacgggggagtattacgtcgacaagttcctcggcctcgcaagcttcaaccccctttacagggaggacggtactcccgatccggacctctgcaagccgatctgccgtcccgaccagcttgcaaacgttggggagacgacagatatcgccggccacgtcaccccacaggcggcgcaggagaccggcctcgccgttggcactccagtgacagttggaacggatgactccggagccgagggcatctcgtgcggcatcggcaggcttggtgacctgatgctgcagtttggatcctcgatttatatgttcctggtcaccgaccaccttgtaaacgacgacaggatttggcgcgaacgattcatcattcctgggacgtttgatgtctcggccggtacaaacactgccggtacactgacccgctggctgcgtgacaacgtctttgccgacctgaagaaggttggcgagaacgggggcgagaatgcctatgctgccatggcagaagaggcgagcgacgtacccttgggaagtgatggcctgatatgtcttccgtacttcgccggggagcgtacgcctatcaacgatccatatgcgagtggggtctactttgggcttaggacttcacacacccgcgcgcacctctatcgggcgggactcgagggggttgccttctccatcaatcagcacttcaagattttcgaggaggatggcgcccccatctctcgcgtcatggcagccggtggtggaaccaagaacccgctatggatgcagatcgtagccgatgtcaccggcaaggagatctcggttccctcgattgggattggggccagttacggtgatgcgatgatggctgccgttgggactggcgcatggggcgggtttggcgagcttgcgagcaaggttcggccgggagtcacctacaagccggatatggagaaccacgagaggtacgagaagtaccagagggtctttgatgcgctgtatcccgcgacaaaggaactgatgcatgagctcaattgctaggcaggttcggatgtcttgcgagcgaaccagcggcgagatgatgaccaaggaggtttgtcgtgtggattaatgagatgtttggaaccaagaagccgatcattgccatgcttcacttggatccgcttccaggggaccctaggtttgggcatgacgggggcggactttccgatgccgtcgagcatgcaaagagggacctcgacgcactccaggaggggggcgttgacggcatcatcgtctcaaacgagttctctctcccatatcagcgccatatggactttgtcacgcctgcttccatggcatacattgttggccagctgaagtcacagctctctgtcccatttggcgtggacgcgatatcggacggcctcgcctgcattgaacttgctgctgcctgtgaggctgactttgtccgcgggacgttttcgggggtctacgtgggcgatggcggactctacaacaatgacttctccatgctgatgcggaggaaggctgcgctgcacctcgataacctgaagatgctctatttcatcaatcccgagtcagacaggaatctcgatacgagggatctttccgagattgcctcgtcaacgatctttaaggttcacccggacgggctctgcgtgtctgctaccgccgcggggtccgacgtaagcacggggctgattgcttcggtcaagaagaagaatcccgaggtcgccgtcctcgtgaatacgggatgtcgtccagacaccattcgcgagaagctctccgtctgtgacgcggcggtcgttgggacatatttcaaggaggggggccgcctagaggacgagaacttcaataacgtccgcgtggacgttgaccgagtcagggagttcatgaaggtggtcagtgaagttcgtagcgaaatatagcgggaggcacgattggttctttgggagtggccgctggatcgaagatggtccagcggcccccatttctgctaatagcatgcatataccaaaaccagtctccttcgtagtgtgatttgccaaataaagatttgacgcgtttacgggggcctaaccgcgtcaagtcttacggaacttcgagtcccgtaataatcgacgcgtttatggtcccctaaacgcgtcaaatcttacggggctgggttcgttcggcctcgcgggcggttcacttgcctactgaaggagatggggggagctgcttgaggcgggtgattcgggagttcgcagactaacgggagaccaagagagaaagccgagacttagcatgcaaaaaggccacgggcaaacagtacccgtgacctgcgctttttcatggagccagctatcagactcgaactgatgacccccgctttacgagagcggtgctctaccaactgagctaagctggcctcctatgtggctgcatcgctgcagcagatagtactatacgggaaccgtcgcggttttcaagcggcaatcttgtcaatcacggcattgacgttacgcgagggccatgttctatgcttctaatgcagaaaaccgcatcatgggaggggagagactcaacatgaaagtcctgatgctcaacggaagcccgcgtcccaagggcaacaccgcgttcgcgctcgcccagatggaggaggtctttgcgcaggagggagtgcagaccgagaccatcctggtcggcaacaaggacatccgcggctgcatcgcatgcgaccgctgcgccacgctcgggcgttgcgtgttcgccgacctggtgaacgaggtcgccctcaagctgaaggatgcggacggcctggtcgtggcgtcacccgtctactacgccagcgccaacggcacgctgatcgcgcttctcgaccgcctgttctacagcgcccacttcgacatgcgcatgaaggtcggcgcaagcgtggtgtgcgcccgtcgcgggggtaccacggcgacgtttgacgagctcaacaagtacttcaccattagcggcatgcccatcgcatccagccggtactggaataacatccacggcatggaggccggcgaggcaacccaggacggcgagggcatcgccaccatgcgcgagctcgcgcgcaacatgaccttcctcatgcgctccatcgccctgggtcgcgagaggtacggcctccccgagcgcgagtccgcagacgtctacaccaacttcgtgaggtagggtcggacgtcgcatcgtccctctcttccgccgccccggtcgtttccgcgtccggggcggcggcttgtttgtgagccgcagcccatcacccaggggagaagcgcgtttaccgttgggctgccacccgtcacccaggggagtggcgcgtctcccgtggggccgccagtcgtcccatgggcgagagacccgtcctacgcgcggtccaggatcagcgcgtggagggcgtgcgccacgccgtcgtggtcgttgtcgtcggtcaccatgcccgcgtctctccgtatgtccgccggcgcattgcccatcaccacggagaggcccgcggcctcgagcatcctgaggtcgttgtagttgtcgccaaaggcgatggtgtctgcgacgtcgattccgcgcgcctcgcacagctcgcgcaccgcgacgcccttgttcaccccgcgggcgttgacctccaccaggatgtccgacgacctggtcaccgccagctggggaaacgtcgcccgcaggtcgcgctcgatggtgggggagtcccctggctcgctcatcaacagcagcttgcacaccacgtcgccgggatccaggtcctccggcagcccgttgcgtgcggtggtgcgcaccaggtcctcctcgcgccgcacgcgcgggtccgccacgtcgcgcacgatccattcgtccgccgtgtacacgttccacgtgacgtcgtagccgccgcgctccaggaagccgaccacgtcgcaggcggtctggggcgagaagccatgtcgcgccaggacccgtcgcccctcgtccagcagcagcccgccgccaaacgcgctgatgcagcagcgcaggccgttgtcgcgcaccagcggctcgatgccctgcgggctccgcgacgacgagagggtcacgagcacgccccgctccgcgcacgcccgcagcgcctcggccgtcgcgggtgacatcctcttgtccgacccaatgagcgtcccgtcgatgtcgctgaagactgcccgccatgcgcgctcgctgccagccatggggcctccgtccctctcgcctgccacttccacgatgatacggccgtgtggcacgcgaggtcacgatcatcgccgcaggggccttcgcggcgggggagaggtaccgcccccctgcggctgtgaccgcccacctatggcgcgcgcgaaactctcccctgtctcgggtaacgtgggcggtatctgcagactcacgcgaggaggtcgttcatgtcgggaattcagaaggtcgtggtcgccggaggcggcgtgcttggctcccagatcgcgttccagagcgcctacaccggtcacgacgtcaccatctggctgcgctcggagggctccatcggccgctgccgccccaagctggacatgcttaagggtgcctatcacgaggcgatcgaggggatgcgcggggccaagagcgaggacgatcctgcctggtgcgcgggcatcagcgacttcgagggctttgacgcggacgcgtgcgaccgcagggttgaccaggcctacgactcgctggtgctggagctcgacctcgccaaggcggtgagggacgccgacctggtggtggagtgcatggccgaggtggccgaccagaagtccgcgttcttctccaagctcgcgccgctcatgccacagaagaccatcgtggtcaccaactcgtcgtcgcttctcccctcgcagttcaccaaggccgtcggacgtcccgaccgctacctggcgctgcactttgccaactccatctggaagcacaacgtggccgaggtcatggtccaggaccagaccagccaggactcgtttgcggcggtcaccgagtttgcgcgctccatccgcatgatccccctgccggtcaagaaggagaaggccggctacctgctcaactcgcagctgatcccctggttgctgagcgggctcgacctgtacgccaacggtatcagcgacccccgcagcatcgacatcgcctggaccatgggcacgggcgcccccaaggggccgttccaggtgtttgacaccgtggggctgaccaccgcgtacaacatcgtggagcagtaccagcgcgttcccggcatcgccacgccgctgctgcgcaagatgatgctgccctacaacttcaagggcatggagaaggtgctcaaggagtacatcgacgccggcaagctggggcgcagcggcggcgagggcttctacaagtacgacaagaacggcaacgtggtggagtagcgtcgcaggcgggggagaggtgccgcccacgtggcaggcgcccctcccgccggccgcccgtcgcgcgtgccccgggcggggtgcgtcgcccggatggggtgccggcacaaggcggcccccggcccgtggatttgggctgggggccgcattccgtcgcgtctctcccctagtccttgagctgggactccatgtcgcggacctcggcctccacctgggcgagcgcctccttgcggtcgtccaggcgctcctgcatctcttccacgtggtcggtggcgtaggcgtggttgaggcggtcctgcaggcggtcgatctgctcctggaggttggcgatgcgctgcttgcggcggtcgatggcgtcgcgcgtgcgctgcacccactcctcgtggcgctggtcgttgtgggcgcgccgcttgtcccagaactcctccttggcggtggtgaactccttccacaggcggtcgcccagctccttgccggcaaagcccgtggccttccagtcgcggtccagctgcttggcgcgctcggttgcctcgcggccaaagtcgttgccctgggcgagctcccttgcctggtcgatcaggcgctgcttggcctccgcggcggtcttgcgcgcggcgtcgagcgcctcgtagtgggcgtgctgtgcgtcgaagaacggctggcgggccgcctggaactcctcccacaggcggtcgttgtcggccttgggcgcgacgcccgccgccttccactggtccatgagctcgcgcatgcgcgcggacgccttggcccactggtcgcccgtccagtctgcggaggttgcggctgcgagcgtcgcctcgtgcaccaggcgctcctttgcggccttggccttggcgcgctgctcgtcgagctgcgcaaagtgctcgctcctgcggtcgaagaagcccctgcgcgcggcgttgaagcgctcccacaggcggtcgtcctcctcgcggtccccggtgcggccggccgccttccagtcgtccatcagcgtgcgcatgcgctcggcggtcgcgttccactggtccgacttcgccaggcgctcggcctcggcgacgagcttctcctttgcggccttggcctgctcgtgggctgcgtcgcgtgcctggtagtaggcctcgcgtgcggtcttgaagcggccccacaggacatcctcgcgcgggtcgtgccagcggcggatgtcgttccactgctcctgcagccgacggaggtcgccggagccatggcgccagtccctctcctccgcgacctgctccgcctggcggcacagctcctcgcggcggtcgaggtccttctgcagctcctcctccgcctgggtgggtgccgcctgctggggcgcgttctgctctggggtgtcgttgggatcggtctgaggctgagtggtcatggggtctcccgatggtggggtgcgtggatgcgtgcgacccccattctattgttagctcgcggtcatgtcgccccgcgacgcggggaacggcgccagggagggcgcgcggtcgcgctcgcgtctggctgggacgtggtgtggggtctcgaaggctgggggagaaggcgggcacgtctcccaagacgccttccaacgcgtgcgtggctggtgagaggaactgcgccctggcgatggcgggcagtcccactggcaattcgtttgccaacggccagggtatccctgggcttctgcggattctcggtgttgtgcgcctaactatggcggcaagctcccgatatgagtgctcatatcagcccccagctgccacaggtgacccaggggacggggtttgccaagttgagggtccctcaactgggtcaacgttggcagcccccgggctctgatggcagccgcttcccgatgtgagcactcacatcaggcttctgctgccatttgacccctggggatggttcaaatggcagcaagctcccgaaatgagtgcacaaaccgggagtttgctgccacccctcagctcctggaatctcaagcggccaaatcacctgcgcgagctcagttcctgcccaacgattgggcgaagattctccgacgaaagtgctcacagcgagttccctctgccatggttcgaatccttatgcgaaaccgatgccgccccaagacccggggaggggaggagcgcagctcaaggggaacgattgacgagaggtacgcccgcccccctcggactaacgggagtcccgtcccgctccgaggcggaggacgcggttcgtccggcttgcggacatccacagatgagctgatagaaggggatcgggcgtagcggagtacccgggcatcgactgccatgtgacggtggccgccccgcgtgagggcgtcgggacggtcctgccgccccgcctctccgcagctcgatcgcccgtcgtgccagccagtgtctggaatcgcgtctcgcgtgtacacacgggggagactttctggcatcggcccagcaaagatgccatgccaacagggaaaacgctctggtgggactgtcccttgtcggaaacgacgtctcgcgtgtacacacgggggagactttctggcatcggcccgcctgcgggggctgctctgtctaaaacctcgcttcgcgtgtacacatgggacgtactttctggcaagggtaaggcattgatgccccaccaacaggggaaaggcgcttgcggcgagtgccttgtgtctggaatcgcgtcccgtgtgtacacacgggacatgctttctggcagagagcggccattcgcatctgtgcgaaaagtgccctggctggggatggggaagggccctcctcgagtgccactcatcccgcagggtgaccagcccctcccttccttgacttctgaaggctcttcggttggagccaacgctgcggcaaccaactttagtagggtgagcgatctataagagctagggcgaacctggcccctgggtttgagaccggggccaggatggcatgcctcccacgcgcccctagaccgacttcaggctcgcccggaagcgctccaggtccctctcgtccaggccgtcgatggcgcgatcgaggtgggggagcatctcggtcgcctggtcggggagcttgccctgcaggcgcagcacgttggtggagtgctgtcccatcaggaaggtccgcttggggtaggtcgccacgaactcgcgcacctcccgcaggacctcaagctcccccgcgggctcgaaggtcccgttgcggacgtcgtcccacagcggcgtgccctccaggggcgtgagcgtctggagcatcacgatctgcgggttgacctgcgagaaggttgcaactgtcgccttcgcggcctcgacgcagcgccccctgcccgccatgccggcgacgtaaaacagcgcgtacgtgatgcccgcctcgtccaggcgagagcactgctccacgacgtctgccgccgtgaagcccttccccatgaatgccagcgcggggtcgtagccggtctccgcaccgatggagacgagcgacatccccaggcgcgccagctcgcccagctcctcgtcggtcttggcggcgacgctcctcacgccggcgaagcaccccatgctctcgacggagggcagcagctcccggatgcggcgcagggtccactccaggtcgccctgcggcagcgccatcgcgtcggcgccggcgaggaagatgcgcgtgggcctggcgcccgaggcagcgagctccctgatgtccgcgtccacctcctcgcggggcgaggaaaggtacccgtcgccatacatgttgcagaagcggcaccgctcatacgggcagcccacctgcacctgcagcagctccatgttcgtctcgaaaagggggcgccagaacgccccgtccgcgtagtgcatgtctctccctcgctctggggaagggcccgccctcccaacgacgcatagtcaacggctcctagggtaggccagcgcggaggtggggcatgcccatgctggcctcccaatcggcgggtggggtctgggaggaaactgctgcctcgcggacgacggtgggcccaggggggaggaatcgccactgtgggccgagcgcacgacggcggcgaacgccagcctttccacgggggagaggcgcgaggcccctcgaccccgccccatcccgctggccgcgcggtcgacgtgctccctacatgaagaggccgcaggcgcggtggaccgaggcggcgaagtccccgatcgacgtgctcgcccgtccctcccgcctgaactcggggaagcccagggcgaggtaggcggccgcccatgcctcggactcgatgtcgggaaggggcttgccggtcctctccacatacatgttgagctgggcgaggacgatcttcctgatctcgtcgaacacgtccacgtcgttcgaggagacccagcgcagcgtcgccaggtcctccaggcagctctcgggcgcgtccaccatgggggcgatgctgtcgctcagcggccgcaagtcggggtcctcctgctcaaagaccgagagcgccatctggtgaaagtcctccagccgccggcgcttcacctggtccgcgaggtcgaacttgtccttatagtggtgatagaaggtgcccttgttcaccatcgcctcgttcgcgatcatctgtaccgtgagcttgctgaacgtgtgggttcgcagcagcctgaggaacgccgcctcgatgcaggcgcgcgtcctggtcaccctgaggtcctcgtgctgattggtctgctccatctcggcctccagataatagactcagtgtatggataactatactccttggataaatctgctcattgccctaccatctggcaagggtcacaattgaccatgcttcaaaaatggttcgatggaagtggcgtccatttgccctgttatgaataggtaagcggacgcgaaggttcgaaaggacgagcaatgcagtcaaagatcgcgcacgcagcggagcgcaaggcgttcagcgtcgcagtcgacaagatcctcaaggcggcttcgggcgaggaccgcgagaagacggtcgagagcctcatctcgatggccagcaagctgctgaaggacaccaaccccggcgccatcgacagcatgcatgccgccctgtatcccggatccaagtgggagaagtggctcttcgacgtcatcgacaacaccgaccccaacgtcctcaagagcgccgtgctcaacggcggctacgagggcgccttccgcgggttccgcaccgccatggccaacgctggcaagctcgactgcaacgtgccctggatcgtgctgtttgaccccacgagcgcctgcaacaagcactgcgtgggctgctgggcggctgactacggcaacaggctcaacctcacctacgaggagatggacaagctcatcaccgagtccaaggccctgggcacccacctcttcatgctcaccggcggcgagccgctcgtgcgcaaggccgacctgctccgcctcgccgagaagcacgacgactgcctgttcaacgtcttcaccaacgccagcctggtggacgagaagttctgccaggacgtccagcgcgtgggcaacatcgtgttctccgtctcgctcgagtcctacgagccctcggtcaacgaccagcgccgcggcgacggctccttcgaggaggtcatgcgcgccttcgacctgatgcgcgagcacggcctgctctttggcacctccacctgctacacgcgcctcaacaccgagcgcgtcaccagcgaccagttctttgacctcctggtcaagaagggctgccgctgggcctggtacttccactacatgcccgtgggcgagggcgccaacgccgacctcatgccctccgtcgagcagcgcgagtacatgctgcaccgcatccgcgaggtccgcgcgttcgagggcggctggcccatctttgccatggacttccagaacgacggcgagtacgtgcgcggctgcatcgctggtggcaggctctactgccacgtcaacgcccgcggcgacgtggagccctgcgtgttcatccactactccaacgccaacatcaaggagaagagctggctggagtgcctgcagcagcctatcttccaggagtaccgcaagcgctatccctggaacgacaacatgctgcagccctgccccatgctcgagaacccgggcatcctgccgcagatggtgaaggaggccgacgccaagtgcacccagtacgtggctgaggagacccccgaggacatcatgaagcgcaccctgccctatgccaaggagtggggccccgaggcgcggaagctctggctcgaggagcacccctcgggcaagaaggaggaccgtatcggctcagtggagcgcgagatgagcctgaaggacgaggccacggtctccgactagcggcgcgtctcagcaagcaagcgtcaacaggcgagagggacggggccaacgtggctcccgtccctctcctcttgtctatgcgcgcgtcgcagccgagaggcgcgacggccctgcccgtcggggcgtggcgaggggcgggcgagcccctcgttgcgcgtgcggcgacctgcgcccgcccgtgcaccgcgggctgcatcccggtggctagccccgtgcccgcgccttggagggacggctctccaccacgtagatgcccacgctgatcagcgcgagtgccaccgcggtgtgcggtcccacgctggtgccctcggggccgaggatggcgagcgacagcagcacgccgaacacggggatcaggaactcgaacaccgcgacctgcgacacgtcgtgactgcgcagcaggtgcgaccacacgccgtaggcaactgccgagaccatcaccagccaggcgaggatgcccgccccgccggcaccggcgggggtgagcgaccctcccagcgccaggcccaccgccaggagcgcggctccgcccatcatgaactgccagccgcacaccaggacggggtcgacctcgctcgcgtggcggcgcaggatggaggacgcggcggaggcggagacggtcgagagcaggagcagcccctcgccgtccaggtggaagccggcgccgcccacggcccgctcgcccataccggcgaccatgatgcccgcaaagccgatggcacagcctaggagcttgcgccccgtgagtctctccagcctaaagacgagcgcggacatgacgagcgccgcgaacacgccgaagccctgcatcagggagccgttgacccccgttgcgcgcgagagccccatgtaatagagcaggtactgcccaaaggtctggaacaacgccacgctcgccatcacgcgcagctcgccccggcgggggagacgcgccgagcggttgatggcgcaccacgccagggtgacgcaggcgcccgcgagcacaaagcgcaggccggcgaacagcatctgcgaccccgtgtcgccagggcctatcccaaacgcgcgatagcccagccgcaccatggggacggcgctgccccacagcacgcaggagagggacgcgagggacaccaggctgcccgtcccgccgcgggtggcgcttcgggcggcgtcgtcccgtgctgccggtgggttgtccgccccgcccgaggggcctgcccctctcgccatcagccacgcctccgcgaggcggcaaactccaggagctggtccacgtccccctgccgcgtggcccacgagcacacaaagcggatcacgcgctcgcccgagggcagcacggcaaaggtctcgcagcccaccgcctgggcaaaggccgcctcgtccgcgggtgacaccacaaagaactgctggttggtggacgagggaagatacgcgcggtaccccaggcccagcatcccgtcgcgcaggcgcagcgcgcactcgttggcgtggcgcgccaggcgccagtagggtgcctcgccgtccgccccgggcgtgaaggccgcctcgaactgcacgcccaacaggcggcccttggccatgaggccgccacgctccttcaccaggtaggggaacgactcgcgcagctcggggtcggcgatgaccatggcctcgccaaacagcaggccgttcttggtcccgccaaggtagaacgcgctcgctcgccgcgcgatgtgctcgagcaagaggtcgttctggggagacgtgagggcgctcgccaggcgggccccgtccacgaacaccttgaggtcgtggccctgcgcccagtcgcagatggcgtcaaacctggcgcggtcccacacgccgccaaactccgtcgcattggtgatgtagaccaccttgggccgcgtcatgtgccggcccgtggacacgtgctccgcgtacacccgctccgcctcgtcgggcgagaggaagccgtccgcgtcgcgcgtgggcaggatggtgcggccgcaggcggcgatggcacccgtctcgtggacgttgatgtgcgcgtcctgcgtgcagatcacgccctcccagtcgcgcagcatgccggtgacgccgaccaggttggcggacgtgccgccaatgcagaactccacgtccacgtcgtcgcgccccactgcctggcgaatgagctcgcgcgcgtggtcgcagtgctcgtctccctcctcggtgtagccgggccactgttggtcgttggtcttgaccagggcctggagcacctcgggggccgcgccctccgagtagtcgttcctgaacatgcgcatgcgggcctctcccttccgcgccggcgggactcgcgcgacgcctcggtctcaccgtgccattatgcgcccgcggtggggtggcgtgcgatggcgggggagagggacgcgcccccgtggtagcgacccgccgcgccggcagcccgctcctctcgcccgtgaccgggcgactggcccccgcaccccgtcaccaagtgacaagacacctgacttgtcacggtacaagacacgtgccatactgcccacccagtttgccacgcaggcgaggagaggggacaccttggaaggttacgtccgcacaccgctggaggagtccagctatcacacggcgctcgaggggtaccgtcgcgaggggggagccgtccccgccgactttggccctgacttcgagcgtctctccgcgcgcgtggaggagctcaagcgccagcgcgaggccgtggtcctggcgcactactacgtgcccgccgccacgcaggcgctcgccgaccacgtgggcgactcgttctacctggcccgcctggcccgcaccctggactgcaagacgatcgtgctggcgggcgtgtcgttcatggccgaggccgtgaagatgctcaacccgtcgcgcacggtcctcaaccccgagccccgcgccaactgccccatggcgcacatggtgcgcaaggccgacgtggacgcggtgcgcgagcgctacgacgacctggccgtggtgtgctacgtcaactccaccgcccagataaagagctggtcagacgtctgcgtgacctcgtccaacgccgtgaaggtggtcggcgagctgccgcagcgcaacatcctcttcatccccgacatgaacctgggtcgctacgtgcgcgagcagctgccccagaagaacgtgatcctcaaccgggggtactgccccacgcaccagcgcatcatcccgcaggaggtggagcagcttgagctggagcaccccgacgccgaggtgtgcgcccacccggagtgcagcgaggaggtgctgcgcgaggcggacttcgtggggtcgaccaagcagatcatcgagcacatagccaacggcgacgggcgcgagtacatcgtgctcaccgtggtgggcgtggccgcggagatcgcccgcctgaccaaggggcaggacaagcgcgtctacttcccggcgacccctcccatctgccccaacatggcgatggtgggacccgagagggtgcttcgcgcgctccagaccggcgagggcgaggtcgagctgcccgactgtgcggacagggccgccgccccactcgagcgcatgctcgagctcgcggcacgatagggggagaagatggcagacgagagggaccgtgccaccggggctccggagggtgccgcgctggcaggtggggaggcgccgagccgcctcgactgcgacgtggtgatcgtgggttgcggcgtgagcgggctctatgcggcgtacaacctgccgcgcgccctcaggatcgtgatgctctcgaaggaggacgtgacgacctgcgactccatgctggcgcagggcggcatctgcgtgatgcgcgaccgtgacgactacgactcgtggttcgaggacaccatgcgggcggggcactacgagaaccgcgcccagagcgtggacaccatgatctggaactcgcgcgacgtgatcttcgagctcatgaggctgggcgtcgactttgaccgcaccccgcagggcgggctcgactacacccgcgagggggcgcactcgcgtccgcgcatcgtgcaccacgaggacgtgaccggacgcgagatcaccacgcaccttctcgcccaggtccgccagctgcccaacgtcaccatattggagaacacggtgatggacgacctgctggtggagaatggcgtgtgcgccggcgtgcatgcggtgcgcccggatggcacgcccctctcgcttgcctcgcgcgacaccatcctgtgcacgggcggcattgggggaacgtacgagcacagcaccaactaccgctgcctcacgggcgacggctgccgcatcgccgcggcgcatggggttgagctggagcacatggactacgtgcagatccaccccaccacgctgtacaccaccaagccggggcgctcgtttctcatgagcgagtcgtgccgcggcgagggggcgatcctgctggacaactcggggcaccgcttctgcgacgagctgcagccgcgcgacgtcgtgagccagaacatcctggccaagatgcgcgaggagggctcctcccacgtgtggctgagctttgagaacgtcccccgcgacgtggtgaccgggcacttccaccacatctacgagacctgcctgcaggaggggtatgacatcctgagggagcccgcccccgtggtccccgcccagcactacctgatgggcggcatccacgtggaccaggactccaagaccaccatggaccacctatacgcggcgggcgagacgagctgcaacggggtccacggcaagaaccgcctggcgtcgaactcgctgctcgagagcatggtgttcgcccgcctggcggcacgcgacatcgtacgggggaggcatgcgcaatggatccagtcacgctgaggctcaaggcagagccgctcatcctcatggcgctcaacgaggacatcacgagcgaggacgtgtccacggcgtcggtcgtggacgcggacgagtgggggcaggtgagtctcatcgccaaggaggacggcgtggtgtgcgggctcgacgtgttcgagcggacgttccagctgcttgaccccaaggcgcatgcggagctctgcgtgggcgagggcgacgaggtgacgtcgggccaggtgctggggaccgtctatggccacgtggcggcgctcctcgccggcgagcgggtggccctcaactacctgcagcgcatgagcggggtcgccacgctcacgcgcaggatgtgccgcgtgctcaagggcacggacacccggctggcggatacgcgcaagaccacgcccaacatgcgcgtgttcgagaaggaggccgtgcgcgtgggtggcggcaccaaccaccgctacaacctgagcgacgccgtgatgctcaaggacaaccacatcgacgcggcgggtggcatcggccccgcggtggcggcggcgcgggcgcacgccagcttcgtcgcgaaggtcgaggtcgagaccgagacgctcgatcaggtggccgaggcgctcgaggcgggcgccgacatcatcatgctggacaacatggaccacgagaccatgcgcaaggcggtggcgatgatcgacggccgtgccgtgaccgaggcgtccggcaacgtggggccacagaacctcgccgccctggccgacctgggcgtggacatcgtgagctccggggccctgacccactcggcgccgattttggacctgagcctgaagcacctccgtgtgacggggagggcctagcgtggccggcgacggggagcgccgccgccggcgcctggtctccgccctcgcgagcgcgagggggccggtaccgggcaagcggctggcgcaggcgctgggcgtgagccgccaggtgatcgtgcaggacgtggccctgctgcgctcgtccggcaccaacgtggcatcgaccaaccgcggctacgtgctggtggaggcccaggggcacagccgcacgttcaaggtgcgccacaccgccgaccagatagaggacgagctcaacctcttcgtggacctgggcggcacggtggaggacgtggtggtgaaccaccgcacctacggcaggctcaaggcaaggctcggcatcgcgagccgccgtgacgtgcggcgctacctggacgacatccgctccagcaagtccacgcccctctccaccatcacctccgggtaccacttccatcacgtgagcgcccccagcgaggacgttctggacgacatcgaggacgccctgagggagcgtgggttcctggtcgaacgcctgccctatgagctggggcaggacctggactaggggttgggttcgggggcggccctcgccgcatggcgccgccgggggcgcgggccctggcggcacgtgaggggcgagggtgtcgcgcgtatccaataccttatgggtgccgcaaggtgcctgcacattagtttctgtacattttgggggtcgcgtgatgacttgtttcagaacagtgacctcttaggggcctgattggagcgggtagtacactgtgcgtcactgcacacggcaggtgtcaaagggtaagtttcgcgtcatccaggaggagcattccaatggagaagaaggacatcgattggggtagtctcgggtttgcgtaccagcacaccgactacagctacgtctccaactacaaggatgggaagtgggacgagggcacccttacccccgaccacacggtcacgctgtccgagtgcgccggccttctccactactgccaggaggtcttcgagggcctcaaggcctacaccaccaagagcggcgacgtggtgtgcttccgccccgaccagaacgccgagcgcatgtacaactcggcccagcgcctctgcatgcccccgttccccaaggaccgctttgtgaaggcggtcgaggaggtcgtgaaggccaacgccgcgtgggtgccgccctttggctccggcgcaacgctgtacatccgcccgttcatgttcgccacgggagacgtgatcggcgtcaagcccgcgaccgagtaccagttccgcatcctggtcaccccggtgggcccgtactacaagggtggcgtgcaccccgtcaagctgcaggtctccaagtacgaccgcgccgcgccccacggcaccggcaacatcaaggccggcctcaactacgccatgagcctgtatcccagcgtcgaggcccacagcaagggctacgccgacaacatgttcctggatccccagacccgcacctacgtggaggagtccggcggcgccaacatcctgtttgtgaaggaggacggtacgctcgtggtgcccaagtcgttcaccgactccatcctgccctccgtcacccgtcgctcgctggtggacgtggcaaccaagatgctcggcatgaaggttgagcagcgcccggtcaagttccaggagatcctggacaacgagttcgtggaggctggcatgtgcggcaccgccgcggtcatctcgccggtgggcgaggtcgacaccgacgacgtgcactacgtcttcaagagcggcatggagaacgttggtcccgtcatgaagaagctgcgcgagaccctcaccggcatccagtccggcgagctcgaggacaagtttggctgggtccacaagatcgacgtggagtagccagcacgaccaagagtcaccagatggaggggcgtctgccatggggcgggcgcccctctcgccttgtcgcggggcatggtgcggggtgggggagaggagcgccgttaagcttcctcgaagcgtcgtgccatggtgatgggctccggtgacgggaggaaagggccccctccactcggggagacttcccgcaacgggatggcatgggccatcccccgaagggagtttctctcatgcagaacgaagacgcgacacaggggttccgggacgatccgctcgcccagccggtgcgttggtggcgcaggtctcccgcaagcacatccacgctctcaaaggccgtctgcgtcatggcggcaagctttgcgctcacggcagtcctgggcggcacctatcccacgcacgcgctggccgtggacgagacgggtggccaggcggctgtggccgtggcgacctcggacggtgccgactcggcgtcggtggcgcgcgaccccgcggacggcggctcgtcggacgagggcgccgccgccggcctggcacgcgagacgaccacgaccgagggctcctccacgacatccgacggtgagggcgcgggttcccgggacgtgacgtcctcatccgccgatcagcgccgccagaccatgggcgcgacggtatccgaggcggtcgagacccgggttgaggcgccgcgcgagcaggtcgagggcggctcccccgcgtcgctctcggtcgctgcagcctacgtctcggaggagagggacggggactccgacgatgcgaccgcccccaaggggcaggacgacgggaccgactcaaacggcacggtcggctccgagggcgcgaggcagattgccgacaccgtgataacgtcgaccatgggcaagagtcccgcggtcgaggtgagtggtggcacgagcctggcggcggaacgctcgacggtggtctcggtcgcccccgtcgacggggcggacgtggtggcggtcgccgcggacggggcctcgtccgtctcgcttggggagggctccacggcctcggcgcgcggcgccaggagcgtggcggtgagcgcgtcgggctcggggaccaccgcgaccctgagcgatgcttccgcgtacgcgtctggcagcggctgcgcggcgctccaggcggcggacggcgcgagcgtgaccatgaccggtggctcgctcgaggcgacgggcggcactgccctgcgcgcggagggggcgggctcgagcgtccgcgtgagcggggcgcaggtgctctcgcgcgcgagcctggcggagcttgccggagacgtgaccgtcgagctcaatggcgtcgagagcaccagcgagcacgcgcccgccgtctacgtcgccgccggggttcccacgctccggctgaccaacgggacggtcgtgcacgggtccgtcgtgctggccggtgacgcggacatcgacatccagaccgacgcgacctcgcggctggacgggtccgtcgtgagggttgcgtagccgcggcaggcttcgtggccaggggagaggggcgcggctgccgggccgtcgcccctctccacgtctgtggaggccctgctcgatatatggggggtcgtggggtccctctcccgttgcgggggcggtagggcggtgtccggctgggatcgaaagggcactgagagtcaaggaggggagaggtgccgctccctatccggcgggcgtggtcttgccggcgggagccttgcttgcgcacaaggcccgattcccccgtcgatgcggggcgtcccagggcctcaccgcatcccgagacccgtccggcaccgtgccgcgccgcgccgcgcaaggcgggcgtcggtgtctaagaatgggggacgtcgcctctccggcaggcaggttggcggcaaactcccgaagtgagcgctcatgtcgggctcccgccgccagggcagtcgcctcgcccgaccgtcatcccagttggccctcaatcaaaccctgaaccatggcggcaaactccagatgtgagcactcacatcgggagtctcttgccattggggccctgttccgggtccccgatggcagcaaactcccgtcgtgagtgctcataagtggagtctgccgccagcgtcgggacgcccagggccagcccggccctcccacctgcgccgatgtggggtggcacctctccccccgccagatgggtgggccgcgaaagtgctcacatcgggctcccgccgccatggttgcgaaaccgatgtgtcaggcgtcgccttcggagggtagattgcctagccctccccggccccgcacgggtcctcgtccccaggcccgtgcggggggcagtgggattaggcatccggcagcgaaatccgtgcgggggccagtgggattaagcggcggggtcgcgaaatacgtgcggggccggcgccgccgagcggggacggaatcgtgcaccgtagagccgggatgcctctcgtcggcaccccctctccgactctcttgagcgacccgctcgcggacaacccgagaggtggggaatgggctgaagccccgaaactctggagcatgggactctccccaagccgaacccctcgcaggcccgcaactcagggggagcccccaccaggtgagaatggctagcggtctgccctcgcgggcccctagctcagggtgcgggcgagcatgtccgcttcgtcctgcgggctctcgaaggtgcgcgggtcgccgctcagccggcgggcgtcgtcgtggagcgccgagatcgcgtccatctcggcatccgtgagctcgaagccaaagaggtcgaggttctccctcatgcgctccgggtgcacggacttggggatcaccacgcggcccgactgcacgtgccagcgcagcaccacctgcgcgcaggtgacgccgtgtgcctccgccgccccgcggacgggagcggactcgatgtcgcgaccgcgaccgagcggctggtaggcctccaccaccacgccgtgctccctgcaccaggcgctgacctcgggctgccagaagcgcggatgcgactcgatctggtcgactgcggggaccacgcccgtctcgagcaccagccgctggaggtgtcccaccaggaagttggacacgcctatctcgcgtaccgcaccctcgtcgcgaagctccgccagggcgcgccaggtctctacgtagaggtcgcgtgccgggcaaggccagtggatgaggtagaggtcgaccacgtccaccccgagcctctcccttgactcctcgaacgcacgaagcgcctggtcatgaccctggtcgcagttgcggagcttggtggtcacgaacaccttgcccgtcatgccggtggccctgagggcggcgccaacctccctctcgttgaggtacgcggcagcgccgtcgatgtggcggtagcccagctccaacgcctgctccaccgcctcctgcgtcttttcgcgaggaatcttgaaggtgccaaaccccacctggggaatcatcgtgccgcctgacagcctgaggctctccatggtcgctcccctctccctgggtcgtcctgggcccaagctaccacgtccgttgagacatgggatgattccgtgcctcttggtaacgtgccggaacccgttcccttacgaagcggtggcaaagatgtccggcacgtgtcaggaggggagagacccgctttccaagttgcaaactcccaggcaaacgaagcccctccccgcgcttggatgctagcatcggcgtcagttggtccccgtttgacctgcggataccgggacgacgcacgtggtggcccgtccctgcgcaaaggaggcactgatggcaaagcgactcaggctcaccgtggacggaacggagctgtacgcggacctcctgaccaaggaggcgcccctcgcctgcatcgagatggagcgtgccgggcgctttaggacggtgctctttgccgcaaacgtgtgctatggggagatgaccttcaacacgcccgtcgccgactactggggcgagcagaacgtgcaggccgagaccgagcccggagacgtgaccttctacaacgactggagctcggtgtgcgtgttcacgcgcaggatggagcagtttggtccgggggcgaagttcgcgcaggtgagaggggaggacctcccggcgttccagcgactcgccgagcgcgcgtggcacgagcagcccatcacggtggaggtcgaggtcgtgagcgactctgccggcgaggagccgtgcgtgctgccggcgccggagcgtctgttcccgctgcctgcgcccaagacgctgaaggtcagggtgctcgaggacgagctcgaggccatctggctgcggcggcccgatgagatcgaccgcatggtggagcgcaatgcccagacggggcgcgagtttggcgtgtgggcgtacgcctggggcgaggccgtcacgctcgcggacttcctgcgcgtgctgctgggtatggcctacgagcgggaggggagcgtgcgcacgctgcgggcggtcgctgcccgggagctgcggttcttctctcccatcttcagggactctgcgcacatggctcacgtgtcggagcttcttgaggaggctgcgggggcatacggcgaggtcgtgtcgtttgccgagttctatgcgctcacgcgcgcggttcagcgctacctggtgcagctgagcttctggctcgacatggagctgccgtgggacggcgtgagtgcgctcgtgcaccgtgcctggaaccccgggatgccggatcccaaccttcccggcggcgcggacggggacgccgagcgtgacggcaaggggaacaagggcggtggccacaagggcaagaaggggaagggcaagtcgaagggtggcggcaagggcaagggccacaagaatggcaaggggcacaagggcaagttgagggaccacggcaagggaaaggtggagtagggggtcgaaaggcgcctcgcaggttgccggacggtcccttccgcgaggggtgctgaggaaatgcgacctgtggcaatctaaagccgtctcgactggagaaagtcgggctttggccatgagtgctacccctaatcgctgccacggttccgtttttctcagcagatatggcttgccaggcctcaccgattgccacaactcgagattcctcagcaccccatgcgctcggtcccgccccgagacctccgcggctcgcatttcctcggcgagaccccctggttgaacgatggacttggcagcgactcgcttacgtgcggctcttccgccagccgaggtctaagaagggagcggggtggaggggataacgaacgcgcgagtatccgtgccgtggtagcgtctgatgtcacgtacgccctgtcggacaacgtttggcggcaagggccatcatcagcaatcgaaccatggcggcagactcccgaagtgagtgccttccgcgtttcccacccgtcgatgatcctgcgtctcaccagctgtctgacggagatggccccagcaatggcaacaaactcctgatgtgagtgctcatatcgggagtcccttgccatttgggccagaagtggggtggggatggcggcaaactcccgacgtgagcactcacaacgggcttccgttgccatggaagggagtcaactgcggatggaggtctgcgctacctgggcaaacgcgcggacttcacggggttcgtcgacggccgtcctccccaggccgctcacatcgggcatctgccgccactgagattgcgcccctcggtaaggtggcgggctgccggcaaaggatccctctggcatccccctgcgagtccttttcctcaactgcctggcgagagtggtcgcttgcgaattggatagatgccggagggggcgttcgaggggctcccgcacttagaaggcctcggctgcgggcgatcaggaacaagggtgctgaggaaagtggagtattggcaatcggggaggcgtttgagctgaggaatgtcgagtattggcagcgaatggactcctccaattgccaatactcgacattcctcagcggcaagtcgccggggattgccaacgctcgcatttcctcagcaccctaacccgcggggagtcccgaatccattcatggagccaccgcggcaccgcatgcgccgccccgacgggcgcgacgccaggcgtatactgcccagcgatggccgtggaaggcgccgcgcgacgcgctccgctcgtggccgcggccaagggacgcgctgaaggcgcgggaaagcgagacagagcatggcacagaagatccagggaaccgaggacctgtttggcggctacatgcgtgcgtggcagcgcatgcaggacgtggcacgcgacctgtttggcgcgtacggcttcgacatgatcgagacgcccgccatcgagcaggtggacaccttcgtgcatggcatcggcgagtccaccgacgtcgttcgcaaggagatgttccgcgtgttctccggcacccttatggaccgcctcctcgaggccggcaccgagagcggcctcaaggccaagcagcgcatggcgatgcgccccgagggaaccgcgggcgtggtccgcgccgcggtcgagaacaacttcgtcccccagggtggtgcgccggtcaagctgtggtacgcggaggccatgttccgcggcgagcgcccgcagaagggtcgcttgcgccagttccaccaggtgggcgtggagtggctgggcgcacccgacccggcggcggacgccgagtgcatcatcatgctcatggagttctacaagcgcatgggcttccccgctgacaagctgacgctccgcatcaactcgatgggcgacgccgcctgccgtcccgcctaccgcgagaaggtccgcgacttcatcctggcccaccgcgacgagatgtgcgaggactgcctggagcgtgccgagatcaacccgctgcgctccttcgactgcaagaacgaccactgccgcgaggtcatggccgacgccccgcttgccaaggacaacctgtgcgacgagtgcgccgcccactacgccaaggtcaaggcctacctggacgaggcgggcgtctcctacgtggaggaccccaccctcgtgcgcgggctcgactactacacccgcacggtcttcgaggtcgaggtcgccgacgcgggcgtgggcgccatcggcggcggcggtcgctacgacggcctgatggagctcgagggcggcaagcccaccccgggcattggctttgccgtcggcttcgagcgtatgtacctggccctcaagagcctgggcgtcgacctggacggcgaggagccgggttgcgtgtacgtggcctgcacctctgcggcggagagggacgcggcgttctcggccacgctcgcccttcgccaggcgggtgttcgcaccgaggccgactaccagggccgctcgctcaagagccagttcaagcaggccgaccgccacaaggcgcgcctgtgcgtggtcctgggttccgaggagatcgcgtccggcgtggcgaccctgcgcgacatgcagacgcacgagcaggagcaggtccccatggacggcctggtggatgccgtgaggtctcgcctggcctaggcggctgcaggggagagggacgtggcccacgtggtcgcgtccccctccgtcggcatcgagtccttctcacccccacgcaataacgaggcccggccctcccatcggagaggccgggcctcgtgcatgacgtgactcgccttgaggttacttgcgtcgtgcgctacgccgccgggcggagcgggaggctgctggtgtggtcggggcgaaagcgacggacgtcgtccctggcgtccagccccatggcgcgggcgaaggcggtgtctacgaactcggggtggcggtgctcccaggcggagagcgccagcgtccacagagggatgagccagcacaggaacgtgaagagcacgctcagggtgggcaggccgaggaacgcgatgatcccgatgcacgaggtggaccaggggatgagcgccgggatgatggcagcgctgttctccaggtcgagggcgagggcgctgccgtcgcgctcggtctggtcgcacagctgcgaggtcagcatgagggccacgacctggtcgcaggcgatggtgcaggtggcgatgctggtggcgagcacgctcacgaacggggtgtagttgcgggcgaccttgttgacgtagtcgcgcagccccagcaggaggccggtcccctcgaagatgcccgagtaggtggaggcgacgcccacgatgaggacgatgtcgagcatcgagacgatgccgcctccgttgaccatgcgggcgatggcctcgttgtgggtgtggaagccaaagaccagcatgtaggggatctgcgccagggggatgtgctgcacggtgacgcacaggaccagggcgcaggcgaggctggcgagcatggtcttcttgacgctgaccttgaggagcgagagcaccagcacgatcacgatggggaggaacacgtaccacgagaggtcgaaggtgtgggcgaacagcgactcgaagtcaggaagcgcggcggagctggcctgcgagacgcccaagacggcgtacagcaccacgcacagcgcgacggggatgacggcgctgcggagcatgcgcttgacgttgtcgagcacctgggtgcgggtgagggttgccacgagtgcggcggcgctggagagcggggagcagcggtcgccaaagaagcagccgctcatgaccgcgccacccaggagggcggggctcacgtgcatggcggtgccgatggtcacgcagatgacgccggtggtcgccgctgcggcgaacgagctgccggtgatgaacgacatcatggcgcagaggaggaacgagagcagcacgagcgttggtgggctcacgagcttggtgctccagcaggtgatggcagggatggtcccggcggcgcgccacgaggcggtgagcatgccgatgatcacgaacagcatgagcaccgagccgatggtgcgaagtccctctcccgccatggacaggacggagcgcacggagttgccgcggtacaggccgtagcccgcaaagaggaagaagcccccgatcaggatcgcgagcagcgggatgcccgccacgatgccaatcaccaatgccgtcgcgaaggtgacgagcaccaacgtctctaccatgaatccccagctccttccgcacgcccgtgcgtcgtcttcccacctggcggcgcgggcgcgcccgcgcgcgtacctccttttgcagacagaagactatccccctcaaaaccgtgagtccaactgttatattcggtatgcgaaacagtttgaatttgtgcggaaacaatcggccctgtacgcgaaacggccatgtctggggtctggtgtcggggcgcgtgatgaccgccaagcggggaggggatgccatgaacttcaccaccatggactactttgtggcggtggcggaggagaggagcttcaccaaggcggccgaacggctttcggtgacgcagcagaccctctcggcccacatcgccggggtggagcgggagctgggcgtgcgcctggtcaaccgcaaggttcctctcacgctcacctacgcgggcaacgtgttcctgggctacgcgcgcagcttccaggcgcaggagcgctccatgcgccaggagttccaggacatcgcgggagacgagcgcggccttctgggcgtgggcgtggccagcacacgcgggcacatgattatgccgcgcgccatcgccgagttccaggcggcccaccccgggatcaacgtcctcctgcgcgagggcgagaaccgcgagctcgtgaccgacctcaaggagggccgcatcgacatcgccatcgcgacggtggcggaggacgagcccggcctggtggtccaccgcctgtacaccgacagggtggtcctgctcctctccaacgagctcctggcaaggctgtacggcgaccgcgccgaggaggtcgtggcgtcggtggcccgcgaggggtcgctcgccccactcgcctcgtgcccgttcatgatgctggggcagggggacgagcccggcgacctggcccgccggctgctggagcacggcggcgtcaagccctgggagcgggtgcagtcctccaactccgagaccctggtcgacctcgccatccgtggtgtgggcgcctgcttcgtgccgcttgacctcgcccaggcggcggcgcgcgaggaggggggacagaccctgcgttgcatcgacctgggcccccagggctccattcccatctgcgccgcctggcgcgactccaagcacgtgtggagcgtggtcgaggcgttctaccggctcctcctctctcagctggcccgcagcgaggaggggccggccccctggggcgagagggtcggatccccctcttctgtggccagcgagcaggggagacgggcgtgagcgcggtgagggtcgcctaccgcgaccgctgggtgctggcggccgacaagccgcaagggctcctggtccatggtgacgggaccggtgcgcccacactcacggaccagatcgccgacctcctgagggaggagggggacgcaaccacgcgcccccaggcgctccagcggctggacgtcgacacctcgggactcgtgctcctctcgctcgacccctccatgcagcccgccttcgacgcgctggtggcggggcaccagatgggcaagcgctacctcgccgtggtggaggggaggctcccccggggcacgcgcaccatctcgctcccgctgggccgcgaccgccacgatgcccggctcatgcgcgtctcccgcacgggtaagccgtcgcagacggtggtgacgccgctcgcggaggcgggcggccgcacgctcgtgcgcgtggagcttctcaccggccgtcgccaccagatcagggtccacctggcgcacctgggtttccccatcgtgggggaccggctgtacggcaggcgcgcgctcaggggagggcgcggccagaccctcatgctccacgccctggaggaggagttcgaccaccccgtgacgggtcggcacctgctcgtgcgcacggagttcccccagaggttcctggacgcgttcccgaactgccgggacctgtgggagggaggggccacgtagggcctcgcaaggctcatactgtggggtgggtcggccgtcggccgatggagaggataggggaagcgcgatatgtctgacaccatgcgtggcgtgtacaccaacctgaccaagatccgccgagacgtcttcagggaggtcgcgaaggtctgctattcgatgggagacgaccccacccagaccgacgccgacctggacaagcagtttgacgagctcccgttcaagatcctcccgggtgacgtcgccacctaccgcgagagcgtgttcctcgagagggccatcatcgccgagaggatccgccttgccatggggctgcccctccagggggtcgacgggcccacgcgcatctcggagggattcacccagacgggtgacctctcgtattacgagccgccgctggtcaacgtgatcaagttcgcatgcaacgcctgcaaggacaacgtgtacgaggtcaccaacacctgccagggctgcctggcccacccgtgccgcgagatctgccccaagagggccatcaccttcgtgggcaagcacgcccacattgaccaggacctgtgcatccactgcggcatgtgcgcgaagacctgcccctaccaggccatccatcaccacgtgcgcccctgcgcggcggcatgcggcatgcacgccatcggctccgacgagcacgggcgagcgcagatcgactacgagaagtgcgtgagctgtggccagtgcctggtcaactgcccgtttggcgccatcgcagacaagagccagattgcccaggtcatctggtccatcctggcgggcgaggaggtcatcgccgcggttgcgcccgcgttcgtgggccagtttggcggcaagggcaacgtgggcaagctccgcgaggcgttcaaggagctgggattctccggcgtggaggaggtcgccctgggtgcggacctgtgcacggtgcaggaggcggaggacttcctggaggaggtgcccgacaagctgccgttcatggggacctcgtgctgcccggcctggtcggtcatggccaagaaggagttccccaagtacgcggactgcatcagcatggcgctcacccccatgacgctcactgcccgcatgatccgcacgcagcatcccaaggccaagatcgtgttcgtggggccctgcgccgcaaagaagctcgaggccatgcgccgcagcgtgcgcagcgaggtcgacttcgtcctgaccttcgaggagatggcgggcatgatggaggcccgcggcatcgactacctcagcctggcggacgacaacaagagcgacttcgacgtggcgagcgccgacggcaggggcttcgccgtggcgggcggcgtcgccaacgcggtggtcaacgccatacaccggcgctaccccgaccgcgaggtcaacgtggtcaacgcagagggactcgaggactgccgcaagatgatgcgcgacgccaccaaggggaagtaccctggctacctgctcgagggcatggcgtgcccgggcggatgcgtcgccggcgcgggcaccctcgtggccataaagaagtccgccgcggcggtcaagcgctacgccaagcgctccccgcgcaacaacgccaccgaggactcgtatcgcatgctcatccccatgctgtcgcagggctttggcaagggcgacctggaccacgaggtcgaggagaccatcgaggcctcggtccccacggagcagccgaaggagtagcgccggggggagaggcgcgggccattcgggcggcggcccgcgccacgccggcgggaggggccgcggggaggtggccccgcccctctcgcccgagacggtaagacgggccgggattgctcccgacccgtcccgagtcgtctgccatgcgatgggatgcgtcctacggctccttgacgcccttcatcgagggatagaacgtcgcgtggtcaaacacgtccttgatggtctggccgttgacaaaggggagcgcgaggaactcgtccacggtgctcacgaggtcgctgcaatccacgaagtggttctttgagttgcgccgactggtgtcctgggcgcgccaggcctcaaagttcacgtcggtcaggtagtagacgtcattgtcgaccttcatgtagaccgagtggttcttgtgcaggtagtcggccaactcgtcgtagtttatctcgagtgcctcggccgctttctttcccatgtcgcgtcctttctcgaagggcttgccttccttgccgctcaacgggaatcttaccgccgtctaacccgccacatacaatcgcggcgtcccgtttaggcaagcgtagcgaactcccatgtgggtgggggagtgcgcgccatttgccgaaacgtgtgaaaccgagcggcccaaagcgggaacagaagcgccaacgttctgggcatcgcggtccctaggggagggaatcgtgtctccctggcgcgagaccgtagcgcgtcgcgtcgagatgtgccgctcgccgggggacctgctgagaaaagtggagttgtggcaatccggggcccgcacgacaagggacctgctgagaaaacttgagttgtggcaatcggaagcgagctgttgggctgccggggcaagaatccgctgagaaaaagagacctgtggcaatggtggaggggtcccgattgccacaggtcgacttttctcagcagccttgttgttcaagcctgtctggttgcctgccacggccgcgattccctggcaggtcacgaggcgttggcgagaacgggtttctcatccggcatgcgggctttcgcgcccaattgcgcgggcggcgcctcgcctagcgctggccgtccgtgccgagaatggcgtccaggagctgcgcgggggtgtcgacgatgcggttggccccgtgctcgcggaggaacgggacgtcgcggaagccccagctcacgatcacgcagtcggtgccggcgttggctgccgtctgcacgtccacctcggagtcgcccacgtacaccacgtcggcgggcgagagggacagacccctcatcaccgcctggagcgagtcgggcgcgggcttgcggcgaacgtcctcgcgctgtcccacgacggcgtcgaagaggcctgggaagtaggaggcgacaagtgcctgcacgtcggcgtcgggcttgttggacacgacggctcgggggaccgacgcgtcgcgcagggcctcgacaacatccaagatgccggggtagggcgcggtggcatcggcgtggtgggcgttatagcgcgtggtgaaggtctggaaggcgcgcagctcggtcttctcgtccgtgccctccgggacggagaggtgcatgaggaccctggtgccgttgcccaggaaggagcggacctccgccttgctccgtcgcggcatgcccatctggccgagggcgtagttgaccgccgccgcaaggtcgtcgagcgtgttcaggagcgtcccgtccaggtcgaagaccgccgccctatatgccatgcaactctcccctccatccgctcccggccatcggccgggcagctcccgagcctagcaccttggcacctctcgcccgctcgtgtcgggaaggtttcctcactctgcatatctcgtacgctggcccccgacggttccagcgctgctattatgtgaacccgcgcgcgcctccgccgtctacgctggcgtgccgtcatctgcaggtccgcccgtcacggcacggggcggaggagacgagaggaatcacatggcgttcagcatgcacacgcacacctgcggcgagctccgcgaggccaacattggcgaggaggtcacgctcaccggctgggtctggcacaggcgcgaccacggcggcctgatctttgtggacctgcgcgaccgcgagggcgtcacccagctggagtttgaccccgaggtctgcgacgaggacacgttccacgaggccgagaccatccgctccgagtggccgatcatggtgagcggcaccgtgcgcgagcgccccgagggccaggacaacgagaagctcgccaccggcgccatcgaggtgtacgtgaccaagatcgtggtgctcaacacctccaagacgccccccttccagatcgaggaccacgtcgacaccgccgaggacgtccgtctccgctaccgctacctcgacctgcggcgcccgacgatgacgtccaacctcaagctgcgctccgacttcaccttcgcgctgcgcgaggccttccacaacagcgagttcatggaggtcgagaccccgtcgctcttcaagagcacgcccgagggcgctcgcgacttcctggttcccagccgcatgcaaccgggccacttctacgcgctgccgcagtccccgcagctcctgaaggagctcctcatggtcggcggcgtggagcgctactaccaggttgccaagtgcttccgcgacgaggacctgcgcaaggaccgccagcccgagttcacgcaggtggacgtcgagatgagctttgtgagccaggacgacctcatgggtcagctggagcacgtgctggccgacgcctttggcaagatgggcgtgaagatggagctcccgctccgccgcatccagtactgggacgccatggacacctacggcgtggacaagcccgacacgcgctatggcatggagctccacgacgtcacgtcgatcttctccaactccaagttcaagctcttctccagcgccgccaacaccgagggccagtacgtcaaggccatcaacgccaagggtgcgggcaagtggccgcgcgccaagatagaccgcctggccgacgtcgccgccacgtttggcgccaagggcctggcctacatcgccttccgcgaggacgggtcggtgaccagccccatcgtcaagttcttctccgacgacgagatgtccgcgctccgctccgagatggacgttgagccgggcgacctggtcatgttcgccgtggccgatcgcctgcacgcggacgagatcctgggcggcatgcgctgccacatggcggacgctctggacgtgccgcgcgagggccacgacttcctgtgggtcgtcaacttcccgctgttccactgggacgaggaccgcaagtgcctggattccgagcaccagccgttcacccagcccaacgaggaccagctcgacctgcttgacagcgaccccctggccatgggctcgcacaccatggactttgtgatggacggctacgaggccggcggtggcggcatgcgcatccacaacgccgagctgcaggagaaaatcctggagaagctgggcttcacgcccgagcgcgcgaaggcgcagtttgggttcctcatgaacgcactggagtttggcgcgccccccatgggcggcttcgcgctcggcctcgaccgcgtgtgcatgctcctcgccggcgcggacaacatccgcgaggtcatggcgttccccaagaccagctctggctcggacctgatgagcgacgccccgagcgaggtctcgggcaagcagctcaaggaggtctcgctcaggctgctgtaggcaggggagagaggcgcgatctgcgaggaggggagccgtcccacggggtggctcccttctttttgtcgtggtggggcgcgtccgaagacggttgcttgcgggtgcgcgttcggtgggggagaggtgctgagcgagctagccctcgcgtggatttggatgcgcgatgtttagcacccccgacctcgtatggatttccgccgccaaactcccacgaggcctagggagattaagcacctcatcccaaaatccgcacgaggactacctacctgtatgccttgcttctgtggacgacgtcgaggacgagaacgaccaggacgtcctcctcaatgtcacagatgattcgatagtcgccaaccctgtagcgccaaaggccagagaggtttccaacgagtgccttgccggtgcttctcggatcatcgagctgggaaatctcgcgcaacttggacgttatccttctggcgacctccctgtccagcttcttcatggctcgctggacgtccttatcgatctcgattcgccaggtcaaggctctcctccagctcatcgagcgtcacggtctcaagcctgccggcgcggaagtcctcgacctttttgagaatcccgtactcgtactcgagccgatcgatggactcggcgagggcttcgttgacgtaatggctcctcgtcctaccggtggctttggcgagccgagtgtatctgtcggctatctccttggggaccctcgttggcatggaaacggttgccatcgtttttctcccttccttcatgacgtaatcactgtatcacgtgtattctctgtattacaacttgatgtctgccaaaaggaagctggcgctgcggagtgaaggtggacgcaaacacgtcttgccgacgcaccggggacgggcatccacaatcgccgcgagtgacgcctaggacgtttgtgcttcaattggttggctagtggcatcccaagatggcagcggttacgctctcgaagtcgtcggcgaccttatgcctgagcccgctctcaacgatgccggctacggattaggcgtgaaggtatgggggagtggcgaaggccgcatgcacggggcgtttgaggagatgcggggggtgtatgttgagcatctacgctgaggttgataagaaatataatgaaatctacagcggggacgatgaccgcaacgtcatcgccgagatagttggcgagctgcctcttgacatgcaactcctttggaaaagggaaacgcagtttgccctcgagcttcgctgtaagcacaagggagacggcaacttcgaccaatcctgcgagcgcgagatcatgaggaagttcgccaaggaggaggctgctcgctccatttagggcttttcgccaacccgatagaatggctgaaagttgccgactcgtagttcaaaagagtccttcctcagcttcccaactgcgggggagcccgacactgacgtgttggcttctgccgaggagtcccggcagccaaagaaggggagaggggcgggcaaatcacctccgcgcccaatccgccggcagcggagggttccgtgcgagtcggccgggcggccccggttgggagcgggcccgggctccgtgcctccttccgccagcggccactccgaagtcaaggaagggggcaagtgcgactccggtcgcgggtgggcctgggtcccgcgccgccttcggccggcggccaacccgaagtcagggaaggggtgcgtgtcccagcgggtggaccccgcaggggaaggcgccccaggctggggcttccggcgcaacatccctctcggaacggaccgcgcggccatggcgggggcgtcccgtaaaggttgacgcgtttatctcctgctaaacgcgtcttttcatattggattggcgattccgtaagaattggcgcggttagggccctgctaaacgcgccaatctttacgggatgagttggacaggcgccccccgcccctcatttacctggcgtccgcgagcatccgccctagctcctcgggcgagaagagatagtcggcgccacagaagtggcagtgcacgctggcgggctcgcccttctcgatcatgtcacgcatctcgtgctccccgagcgcggtcacgcagcgggcggcccggtcgcggtcgcacccgcagtggaactctgcgggcatggcgtcgagctcctggtagtccagcccccgcaggaggtagcccagcatcccggagggagtcatcccgtcctcgagcagctgggtgacggaccttacccccgcgaggttctcctccagctcgtcgaggacgtagtcctcgcaccccggcatcgcctggatgatgaagccaccggcctgccgcacggagtggtccgggttcaggaggacgcccacgccgagcgacgtcgggacctgctcgcttgcggcgaagtaataggtgaggtcgtcgccgatctcgcccgagacgaggccgacggtgctggagtagggctccatgtgcgggatgtcgtgcaccacggtgagcgtgccggggccgaggatgccgcccacgtccaggtgcctgtccgcgcgcagcggcagccaggcgttggggtggttggcaaaccccttgacctggccctggttgttcgcggtcacggtgaggccgccaacggggccgtccccgcgcacctccagggtgacgagctctccgtccaccttggacatcgcgccgatcatctgtcccgccatcatcaggcggccgagggcggccgtgacgacgttgctgctgtggtggcggtcgcttgcggcctgaacggtctcgcggccattgaccgcgaacgcgcgcaactgcccgtccgccgccgtgccgcgcacgatgtggtcgtgtgcgcggaccctcgcgtcctcgaggtcgatgaggtctcctgccatggggtcccctttccgtctgggttctggctcatgttcaacggctaggttgataccccaaggtgccgacctcctgccacgcgcccgctagttctcgccccgccagccaatctgctgaagcgcgtagatgctcttgtccatgttgaacaggtaggcgaccacgcatgccacgaagaagagggggagatacgagtagccaaacacctcggtgccaatcaggatgggcgcaaagagcgtgttggtcgcggcgccaaagaccgctgcgtaccccaacgccgccacgagggggacggggaggccggcgagacccgcaagggcgacgcccagcgaggacccgatggcgaagaggggcgtcacctctccaccctggaagccggccgcaagcgtgaggatggtgagcgcgaacttgagggcccagtcccaggggaggatcgtctggcccgagaagctcgccgagatgaggttggtccccaacccgcagtagcgcccctgccacagcaggaggaagaggcagctcagccccacgcccatgaccgcgatgcgcttgacggggttctcgaggtgcgcctgcgcgatggccttggcccacttgaggcaccaggcgaagaggccgcccaccaccccgaagacaacgccgagcagggcgaccctccccagcgtggcggcatcgagcgagacggggcacgagagcgcgacctcgaacttctccaggccgagcgcgcgggaggtccagcttgcggcaagcgacgccgtgagcgcggggaacagcgcccggtactcaaggcgcccggcgaccagcacctcgatcgcaaagagcgttgcggcgagcggcgtgccaaacagcccggcgaagcccgccgccatgcccacgatcaggaaggtgttgcccgggttcttgaacggaagcttccgtccgatccagtgggagagggtcgcgccgatctgcacggcgacgccctcgcgaccggcgctcccgccaaacaggtgggtgagccaggtgccgcccatgatgagggggatcagccgcagggggatgacgttctccctccccaggcccacgtcgaacaccaggctcatgccacgcccggtgttctttcccaggcgcaggtacgcccatgcgatgagcgtgcccgccagggccaggaacggcaccagctggaacacgtgggcgtcgcggaacgcggtgatcgcgatgaggacgcggccaaacaccgcgtcgatggcgccgaccgccaccccgatggggatgcccaccgcccccagcagcaggatgccgccgtagcttcccaggacgcgccgtgtcctctcgtgcatgctctctccctcccgccggcggtgccgccggcgcacaaaaaaagactcctgccgcagagtgcgacagaagtcatcagccacagggcggtttggggcacgtggcccggcggggaacctcatcccgcatggccgggagggacgggcccgtccgcggcgcacggggagagatgatacgcgaacccggggcgaggcgggccgactttctgggatcgggccgcatcggatggcgtcccgcccgcgcggctgcacccaacgccccggccatcagccgaagcggcagggcgacggggccgcatcgtgtcgcgtctcctccgacggcgtgtccggaggccgccccgcccctgtcgcccgccctagtacgtccggacgggatggaggcggatgttgacgtactggatcaccatcaggaccatgaggaccgccatgaccgccaggtagccgtacacggcgccgtcaaagccgaccgtgcgcaccatcgtgaagctcacggccgagaccacgaccaggccaaccaggtacaccttggtcaccgcctcctggcggcgcagcaccgtgatgatctggtacaggaagtcgaccacggcggacatgccgcccgcgacgatcatcaggtactgctgcgtgcggtagggctcgaagtccaggccgtacagccagcccgtgacgcggatgccgatgatcgcggcgatggccaggaacaccacggtcaccagggcggcggcgcctatgacggcgatgacgatgaggtcgaagcgcttgcggccgtcggggtcggcccagatcttggccaggcgcacgagctgcggcttgtacatgaagcccacggccatgaggatcgcctgcgccgggaagtagatggcgttgaagtagagctggtcgtcgtaggggagagggccctccatcgcgaacttggggatcgcctcgatgagcgcgaacaggaactgggccgcgaaggcggggaagcactccacgaacacctcgcgcacctcgacggccgcccacctgcgcgagcgcggggtctcgaagtaggcgagggggatggcgagcaggaggagcgaggcgaatcccgccacggccatggcgatgctcgcgacggtgatgctgcgggtgaggaacagcgccaccgtgaagagggcgatcgccccggcgcagcggaccccctgtgacacgcccgcgagccacagcttgtcaaactgctgcaggcgcccctcgtacacgtcggcgagggagtctgccaggcggaacagcagcgtggcgtagcacaccgagagcatctcgcccgagtagcccctcagcgcgaagtagagccagcccgccgcgaccatgaccagacaggcgagcgtgcgctggatctggtaggcgccgaaggagtccatctcgtcgatgtcggacacctggaaggtgcgcacgccgtacaggcccacgaactgcagcaggttggcgatcacgaacgccatcgagaacatgcccgcctgctcagtccccaccaggtgggtgcagatcatggtgaggatggggaagaggcctccccacagcgcaagcccggcggtgttgtacatgtagtcgcgggtctggtcgtggccggcgtactgggcggtctggtcggcgagggatcccgagacgaccgacgagatcaggcggtcccaccatgcgttggcaaggcgcgccagcgccgggggctgctttgccgtgcccctctccctcgtctgtgccgacgaccttgcagtctgcttcctgtggggtatcttcatgggcccgtatcgctcccaagcatgtctggacggcaatttcgtacaatcgattgtatccctgcgagttgggcgagaggcactctcccaaatgttgcaagagaccgtgaacattgggtttcaggcagatggaagagggtacacgtgcgcattcgcagagtatggtaaacaccgcgaatgcttccaaatcccatgtatccgcatgtgggcggtatgcaacaaaggaggaaggttgtctcaggcaatcaagaacgactccacctctggcctgtccgcggaggagatggagagggtccttgcgctcaaggcgctccaggacgtcaacgtgccggacgagctcaaggacaacctggcgttgttccttcgcctggtccgcaaggtcatcaaggagcatgacccctccatccgcgatgcgttcgaccggctgctcgaggattccatcgtcgtcaacaacaccgaggaccccaacgccgacaacgtcaacgacgcgttcaaggacgccgtcgacctcctcgacggcatgggcgtggaggacgtcacggtcctcatgcgtgcgttcaccgtgtacttccacctcgccaacatctgcgaggagaactaccgcgtggagtcgctgcgcaagcgcgagcaggagatcccggtggactcccccgaggaccccatcaacgacatcacggtggcctaccaccagctggtcgacgagtgcgggcgcggcaaggccatctcgcttctcaaccgcctggagttccaccccgtcttcacggcgcaccccaccgaggcccgtcgcaaggcggtcgagggcaagatccgccgcatctcggtgctgcttgaggagcgcccgcgccttggtggcgtctcgctcgccgagaacgagcgccgcatgacgcaggagatcgacgcgctgttccgcacgtcccccatcgccatcaagaagccgacccccgtggaggaggccgacacggtcatcaacatcttcgacagcacgctgttcgagatggtgcccgaggtgtaccgccgcttcgacgactgggagctgggtgacaaggcgggcaccgtgccccccatgtgccccgcgttcttccatcccggcagctggatcggctccgaccgcgacggcaaccccaacgtcaccgccaaggtcagccgtctggtgagcgagaagtaccgcgtccacatcctcgagacgctcgccgcccgcaccaactacgtgggtcgcaacctcaccatggacaccgacatcaccagaccctccaaggaactcatgaacctgtggagccaccaggtggagatgagcgaggtcctcaccaaccgcgcccaggccatctcggcatccgagatgcaccgcgccgtgaccatggtcatcgccgagcgcctcaaggccacgatcgcccgcacggccgacatcatgtacaacaacgccgacgactacatcgccgacctcaaggtggtgcagcgctccctcgcagcgggcggggccgtgcgcgaggcgtacgggccgctgcagaacctcatctggcaggcggagacctttggcttccacctcgtggagatggagttccgtcagcactccctggtccacagccgcgcgctcgaggacatccgcgagcacggccgctggggcgagcgcggcaagctgcagcccatgaccgtcgaggtcctggacaccttccgcgccatcggcaccatccagcgcaggaacggcgtcaaggccgcccgccgctacatcatcagcttcaccaagagcgcccagaacgtcgccgacgtgtacgagctcgcccgcctggcgttcgcgcacgagcgcgacgtgcccaccctcgacgtcatccccctgttcgagcaggtcgaggacctggagaacgcggtcaacacgctcaacgacatcatcaagcttcccgaggtccagaagcgcctgcaggagaccgaccgcaagatggaggtcatgctgggctactccgactcctccaaggacgccggccccacctctgccacgctcgttctccacgccgcccaggcaaacatcgccaagtgggcggacgagaacaacatcgacctcgtgctgatgcacggccgcggtggtgccgtgggacgcggcggcggcccggccaaccgcgcggtcctctcgcagcccaagggctccgtcaactgctgcttcaagctcaccgagcagggcgagatcatcttcgcccgctacggggaccccacgctggcccgccgtcacgtggagtccgtcgccggggcgaccctgctccagagtgccccctccatcgaggtcatcaacaccgagaccacggagaagtacgcggacgtctccgaggcgctcgaccgcgagtcgcgcaagcgcttcctcgacctcctgcacaccgagggctttgccgagtggttcagcacggtgaccccgctcaccgagatcggcctcatgcccatcggctcgcgccccgccaagcgtggcctgggcgccaagtcgctcgacgacctgcgcaccatcccctggatcttctcctggtcgcaggcacgcaccaacctcgccgcctggtacggcctgggcacggcatgcgagaagttcggcgacctcaagaggctgcaggacgcctacgccgagtggccgctcttcaccacgttcatcgacaacatcgagatgtcgctctccaagaccgacgaccgcctggcgcagatgtacctcgacctgggcgaccgccccgacctcaacaagaaggtcatggacgagatgcacctcacgcgcaagtgggtgctcgcgatcaccggcaacgagtggccgctgcagcaccgccacgtgctggggcccctcatccgcatgcgcctgcccttcgtgaacgtgctctccctcgcccaggtgcgcgcactcgacgcgctccgcaacaagggggacaagctcacgcccgaggagcgcgagcgcttcatctacctcatcctctgcaccgtctccggcgtctccgccggcctgcagaacaccgggtgatccacctcgtcccagggcgagaggctacgtgacgggaccccgcgggctgcgtgtccgcggggtcccttttgtgtgccgagggccgcccgccgtctcttacgaactccgtccagcaacctgacaagtgcctgattttggcctcctaaccttgaaacgcactgaaacgagacccaaggacacgcgaaaggggtacttgcatgagaaggcaccattctgacgcgaccggtgagagggacaacctgaagattgcggggaggggtgcggctgccgtcgccctggcggcgctcctgacgcttcccgtgccggcagtcgcgcttgcgggaaccgggctctcccaggacgcgcaggctgatgccgcgactgcctctgctgaccacgtcctcatcggcaaggtgggcatcgaggactacgccaacttcgacgacgacggcaacgccgatcccaacaaggtcatctactcctacgacgtccacagcgacgacgagggcgtcacggccaacagctggggcggctacaccatcaacatccagaagctcaaggactacgtctcggcccatggttacaggttccaggccggcctcgtgggcaacgtgagcgtgtccaagtacgacatcggaaagctcaaccgcatctacgcggtggtgaaggaccccaacgccgcccctgccgcccccaccgccaccgacgtggcgcaggcaaaggtcaccgtgcggagcgtctccgacgccaccaagtccaaggactactccctcaccgagggcacctaccagattgggaacgtgatcaagaccgcctcgggctacacctgcgtggtcacccttcccacggacaagcagcagtcctacgttgaccagtttgccaaggacgagggcgccgactttgcgtcgcagggcttctcccggatccagttctacttctcgtaccgggacggtgcctggaccaacaccaccaccgaccagtacatctacgtccgcgacgccgtccacaccgtgaccgtcgaccttggctatgacgcagacggggacggcaacgaggacgtgctgaccctctcagccaaggacaacaaggccatctcgggcaccgagctctacaagctcgacaaggccacgaagggcgggtgctccctcaaggctctgacctttgacgccgacggcaagtacgcgttcgacaccacgcagaagatcaccaaggacaccacgcttcacgcccagtggcagcagaacaagcacaagctggtcggcacctttggcctggccacctacaaggacggcaagcccgacaagaccgtcttctcgttcgaggcgtacgcggacgatcccgacgtcaagcagtttggcgggcagtattgggtgagcaccaagcgcatccacgagtggctcgaccagaacggcgactacgcgaccaccacggtgatccccagcaccggcagcagcggctatcccgtctccaccaccgagagcgccgcgaagaccgtcctcttcgaggtcaccttcaacggcacccagaaggccgagacggtcgagatgttccgcctgtacaaccccaactccggcgagcacttctacaccgccagctcctacgaggcgggctcgctggtcaaggttggctggaggtacgagggcatcggctggtacgcgcccaagacgtccaacacccccgtgtaccgcgagtacaaccccaacgccgcctccggcgcgcacaacttcacgaccaacaaggcagaggacgagatgctcgccaacgccggctggaaccaggagggcatcgcctggtacggcgtgaagtagcaggttccgtcacacgcacgaccccttccaggcaccccgtccgcccatggctgcggggtgcctccccgtttgggcgcgtctctccccgcgattgcactggcgagggagggacgcgcccacgcctccttgcgggatgcaggggggtgtctcggcagcccgtgggtgcggtaaatgctataagaaaagtagcaaacaaatccgtccgaacgggttagcctaccgatgactacctgcgcaaatggtgtttaccacagaaaacttggctgtttggggtcccgcatagaaagtaaaccctatactacttttacgagttaggtgagagtaacttctcccgtcggcagaagtcggcgggccaatgggggtgagagggatggatggcacggttatgggagacgttcgatccgacagcaccgcacaggtccatgtgacgggtgcgcagcttccgcttgccatggtccacgagggcaagaccgtgaccgtcgcgaaggttcgcggtggccaggaccttcgacagcacctcgcggagctcggctttgtgccgggcggcacggtcaaggtcgtctcgcgcgtgaacggggacgtgatcgtgggcgtgaagggcgccacctttggcatcgggcgcgacatggcgatgaggatcgtcacctgctagcgcagctctcgacgttaggtttcaatgggccggcgactgccggcatgcttgtggaaggggaagttgcatggcaacgcttcgagacgtgaaggtgggcgaggcctgtacggtcgcccgcctgaccggcaccggtgcggtcaagcgccgcatcatggacatgggcctcaccaagggcgccaaggtgttcgttcgcaaggtcgccccgctgggcgaccccatcgagtgcaccgtgcgcggctacgagctgtcgcttcgcaaggacgaggcgcaggacgtggaggtcaccgacatcgccaaggcgtagccccctttttgccctttaagttagctgagtctaacaaatgtggcctgcggggtggcaatagtaagacgcggaaaacaatccgactgcccaaccgacgcgtcagacggtaggaaagaaaggcgagtaatggcagagaagtacaacatagccctggctggtaacccaaactgcggcaagacgacgctgttcaacgagctcaccggctccaacggctacgtgggcaactggccgggcgtcacggtcgagaagaagatggcaacctggaagaaggaccacgacgtcacgtttgtggacctgcctggcatctactccctctccccgtactcccctgaggaggtcgtctcccgcgactacgtggtgaacgagcgccccgacgccgtgatcgacctgctcgacgtcaccaacatcgagcgcaacctgtacctcaccacccagctgctcgaggcaggccgtcccgtggtcgtgggcctcaacatgtgcgacctgctcaagcagcacggcgagaccatcgacgtcaaggagctctcgcgcatactcggcgttcccgtggtcgaggtctccgcgctccgcaaccacaacatcgacaagctcgtgagggaggccgagagggcagccaaggaggggactcccgccaagcccctggagtgcttctcgcccgaggtcgaggagactctcgccaagatcgcgaggggcatcgaggggcagtgcaagcccgagctcgtccgttggtacgccatcaaggtctttgagcgcgacgccgacgccatcaagcccctgggcctcacggcggaggaggtcaaggccttcgagcccacaatcgaggcggtggagaaggaccgcgacgacgacgccgagtccatcatcaccggcgatcgctacgacttcatcgccaaggtcatggaccgcgcggtgaggaagtccgtgggcacgctctcgacctcggagaagatcgaccgcgtggtaaccaaccgcatcctgggccttcccatcttcatcgcggtcatgtgcctggtgtactacatcgccatcggcaccgtgggcaccgcggcgaccgactgggtcaacgacaacctgttcagcgacggcttcttcgtgagctccgcctcgcagcagcagtacgaggcggacgaggaggcgtggtccgacgccaactacgacgacatgatctcgggctacatcgccgccgccgccgacaagggcgtggacatcgacggcgtccgggacgccatcgatgtcgacgagcagacctccgagacccaggcgaccatcgagaagtttgaggccgcagccaagaaggccggcgtcgtcgcgaccgacgtcccggtgaccgacggtgacggcaactacgtggacaccgagggcaacgtcatcaccaagctggactccgacggcaacccggtgctcgcctcgggtcagaagctcgagaccatctccagcgtcagcgaggccgacttcgaggatgccatcgcgcaccccgagcccgaccagcacgactacggcaacttcgtcgactccatccccaccgtcgcgaccaacgcgctcaccgccgcgggcgcctctgacgtcgtgatcagcctcgtcgtcgacggcatcatcggtggcgtgggctccgtcctgggcttcatcccccagatcttcgtcctcttcatcctgctctgcttcctcgaggactgcggctacatgagccgcgtggccttcgtgatggaccgcgtgttccgccgcttcggcctctccggcaagtcgttcatccccatgatcgtctcgtccggctgcggcgtgcctggcgtcctctccaccaagaccatcgagaacgagtgtgaccgccgcatgaccgccatgctcaccaccatgatcccgtgctccgccaagctgccgatcatcgccctggtcatgggcgtgctggttggctccgacaacggcgcctggtgggttgcccccatgttctacttcatgggcgtcgtcgccatcatcgtctcggccgtcatgctcaagaagaccaagcccttccagggcgagcccgtcccgttcgtgatggagctgcccgactaccacctgccctccgtcaagagctggatgctgcacgtgtgggagcgcgtctccgcctacgtaaagaaggccggcacgatcatcttcgccgcggccgtgggcatctgggtcctctccaacttcggcatcgcgggttgggacggcggaaacggctcgttcgggttcctgcagtcgatggacggcgcgcccgacacctacatggactactccatcctcgccggcgtgggcggcgccctgagcttcctcttcgcacccctcgggtttggtaactggcaggccaccgcgtccaccatctcggccctcatcgccaaggagaacctggtgtccacgttcggcgtcctctacggtctgggcagcgcgaccgagaactcggtgagcatgtggcagggcttcgccaacatgttcacgatcggcggggtgctccacgttggtgccatgtgcggcttcgttgccttcaacatgctctgcgccccctgcttcgccgccatgggcaccatccgcaagcagatggacgaccccaagtggttctggttcgccatcggctacgagtgcggcttcggctgggtcgtgggcctgctcatcaaccagttctacgagctcgcggtgtttggcacctttgggttctggaccattgtggcgttcgtgcttctcgccctcatgctgttccagctcttgcgccccatgcccaagtgggacaagagggacgacaagatcctggacagcctctcggaggaagccgcgtagcgagcgggacatgttcggctggcgcccggtgcgccaggtcaggggcgcgtcgccggcaggccgtcggcggcgtgccccccgttggaggggaggggcgcaacatggacgagctcatcgcggcggcacttgccgcgagcgtctcgcttggctccgtgctgctgagggatgcctgcctcaggtgggctttgggggaggctcgatgagtcggacggacgctgtctgccatgcacgaagggcgatggcttgcccctgcggcggtcccgcctcgtcctgcgccgaggtcctcgacggggtgtggctcctgctggttggcagggcgccgcactctcgcgtgacgcttccgcagggaccccgtcccctccacatggtggcggtcagccactgcaggcggggcatctgcctggcatggcacggtgaggtcaacgaggtcatctgccccggcgagtcgtttgcgctccgcctggcggggcaggggagggtcgacctcgagacggacttcgagggggccatcgtcctcgtcaaccccgaccgcctcgcgggtgcctcccgctcgtcgctcgaggagttcgacgtggaccttgaggggctcgggtcggtgctgcggggcggcgggtccggcttccgccgcctcgagggagtgccgcgcgtcgcccacgtgctcgtcgagctcatggactcctcggcgggggagcgaggcggataccgccgcctcaaggtcatcgagctgctgcgcgagctgtcggtggtcggccgcgctaacgccggatcggaggagccgcggtcggttggccgcgccaaccacgagcgcgtggcgtatcgcgcccaggccatcatgaccggcaacctcgagacgcccgtgacgatccccgcgctcgcccgtgcctgcgagacgtcgcccacggtgctcaagcaggccttccacgaggtgatcggcgtgccggtgtacacgtggtaccgctcctatcgcatccacgaggcggcccgcctcctggaggaccgcgagcggagcatcgccgacgtcgccgcggaggtggggtactccaacccctccaagttcacgaaggcgttcgccgcctgcatgggaaagacgcccagccagtggagggcctcgctgtagcggggccctcgtccctctcgcctagtaaatggatcgaggcggccaaggcttgggaatcggctgccctctgccgtccgccgttgggttgccctcagatgtatgcgggggtgatgacgattggcttctgccgtgccgcatgggtccgccgtggtccatcctctttcaggatgaagaaaggggaccgcatggagaagaaggcgtttgcctcccgctacctctgccttgcgttcgtgctcgcggcgcttgccgaggtcgccgtggtgggaagccttgtgctggggtcgtacctgggcatcgtcgtggtgctcgttgccacgggggtgctcgtggtggtcacgctcgtgcgtgccgtgctggcgtggcggcggctcgcaaaagctcgcaaggcggggaccgacgacgacgcgtcgccgtttgccgaggaccgcatggtcctgcccacggtcgagatgggcagggaggagtacgaccgcctggttgaggtctacgagtcgcacatggatgccgccgcggcgctggagcgcaccacccaggtcacgcggcgcgtcatggggtcccagaagctgcgcgggcgcttcaggcacctgctgctgaagcggttcctcaaggaggaggaccgtctcgcgcgccggtcgatggaccttgcggtggagcttgcgggcgccatcaacgagtcgcccctcgcggacggggacgagaccgaccccgatgccgacctggaggagcgcctgtagaccctgccgggtggtttggcgcgaagggtgctgagaaaagtcgagttgtggcaatcggaggccagcttgagctgaggaaagtcgagtagtggcagcgaacggggacagaacgggggcgtcacgctgccaaaggtcgcgattccaaagcagattcgggcctcggattgccacaactcgagattcctcagcggctcacacgcgggcgcgccgcgcggattgccacagctcgcatttcctcagcaccccactccgcgaggcgtccccaagccaatcaatggggcgcctcgccgtcagcccagcaggccaataacgtcgatgaccgtgacggtgacgccgatggcgaccagcgcgaccttggtcgccgtcgagttccgccacctgcccatcacgcgctcggacgacgtgaggtacacctgcagaaacaccgtgatgggaagctgcagggagaggagcgcctggctcaccaccagaccctggaacgcgttgggcaccagcaggcacgccagtgcggcggtagccatgcacgcgaccacgcccacggaggagtggcggtcgtggatgtcgtattcctccccaaacatgcccgcgctgatcgtccccgcggccatggcggcggtgatggacgacgagagccccgccagcaggagtgccagcgcaaaggtgacggtcgccgcctgacccaggatgggtgagagggtctgcgcagccaccgcgaggtcgtccaccacgatgccgcgcgcaaagaacgtcgtggcggccaggatgaccatcgccgagttgatggcccaacccacgcccatggagaacagcgtgtccacgaactcgttcctcaggcgctcgcgaaccacgtcgtcaccccgcgcctcgaagtgctggctctggattacctcggagtgcaggaacaggttgtggggcatcaccacggcacccaggacgctcatcacgatggcgagcgagcccgacgggagggcgggcgtgacccacgagaccgccgcctcgccccagctcacgtccacgagcgcgagctcggccaaaaacgagatcccgatgagggacacgaaggcgatgatccagcgctccacccgcttgtaggagctgctcatgaggagggagagggacgccgcggcgacgaggacgctccccacgggcagggggaggcggaacagcatctgcagtgcgatggcgccgcccaggacctcggcgagggcggtcgccacggtggcgaggtaggcgcttgccaggatcaggcgcgaggcaggccgcggaaggtgcgcggtcgtggcctcggccaggcactggccggtggcgatgcccaggtgcgcggcgttgtgctgcagcacgatgagcatgatggtcgagagggtcaccacccagagcagcgagtagccaaactgcgagcctgccgccatgttcgacgcccagttgcccgggtcgatgaagcccaccgtcaccagcaggccggggccgatgctcctcaggatctcgaggccgccgtgcccgcccgtcctcatgccgccaaaccgacgtcgcaggcgctgtggcagcgtgtccctcgtctgctctgagccggcggtcccgttgctgatactggtcatggtcatgtcccttcacgattggccctattgtctcgtaggttcaataagttagtcttagttaacaataagggtacccaggggatggcgcttcatacgggggcttccccgtcacaatgggggaagaggggccggggcaatgggcctgccacccacgtccgtcgggtgcccggtcgcctcgccggcagcgaaaaacgctcgccatcccgcggcggacgcgcttccggaggcgccgacctcgcgccacgtcgcggaccgcgcgccgtggcttgccccgcccccggaggcaccgggatcgcgacgcgcctgcgacccgcctccgtgacctgcagaaatctggcagccgctggcccaaacggacgcaggcgagaaaacccgcccgtctccccttgcacaagttagtcatggtgtactctatgtgccaaggagttagccaagttaaacacttacagcaagcgttatctccttcctgacgcaggcggaccctctccccgcaacgcgctcaggttttcccaggcgtcgccggcatcccccccttcctatgccggcgacgcattttgaactaggcgaacccgcgccgtccccgggcggcgcgacacggaggctctgatgtgcggaacgggtgccatgtcggtgagggcggattccggcagccttgtgggctgcgactccctggagagcagggtctgccacggctttgcctgcacgttcgtgcgggccgcgggtgcggtgatcgagggcgagaagcccgcggcgatcttctccgtgcgcatcgagcccgctggcatcccgcgcgggtcacggacgcgcaacgccctgagggacgccgtccgcacctacgaggtcgagctcactctccgcggaatcaccctcaccacgcttggcgagcgctccgacaggatccagctccttgcgtaccggccaaacctggttgcggaggtcctgggcgacccggagacccgctccttcctcaaggggcttgggtatcccgttgacaacgtggcggagctcatgggcaccctccgcaggcgcctcgcggcacacctgcgcggcgagggagcccccttcccgcacgaggccggcgtggtccttggctatccgctggaggacgtcctgggctacatgcgcggggcaagcgagacataccgcggcccctggaggtcctacggggacgcccgggctgccgagctccgcttcatgcgcatcgcgtgcagcgagtgggcgtgccgggagcgctttgcctcggggctgacgctggaccgcctgctcgcgtgaccaggggacgggcgacgcaccggctgccgtccccggattcccggcgccgcccgcgccctcgtcacacggacgaaagacatccaaggaggaaccatgaagaacgtggcggtcgtgtactggacgcagtcgggaagcaccgaggcgatggcaaacgcgctggcagagggcgcttcgacggaggcgacggaggtctcgtccttctcgcccgccagcgtggcggactacgacgccctggcgtttggctgccccgccatgggctcggaggagctcgaccccgacttcgaggaggtatggaacgagtgcgtccccaacctgggggagaggcccgtcgcgctctttggcagctacgactggggcacgggtgagtggatggatacctggcgccaggcggccgaggacgcgggcgtcaacgtggtggatgcggtcatcgccaacctcgagccagacgacgaggcgctcgcccgcctgagggagcttgggtctcggctggcgtcctagcgacgacggtgacggtgacgcccgaaaacccggtttctgcttgggctgcgggtggtgcttaagagactcggggcttgcatgggtcacgagtggggagtgcttagagaactcggtgctcggcaggattctggggtgcacggctcgtgcacgcaccggggaaagtaagcattacacgccgaaatccgtccgagccccgacggggttaagcgtcggggtcgcttctcccgcccgagccccgacggggctaagcgttctgatcccgaagtcgtacgggcgcctatgggctgagcgacggaagggcgagccgggcagcgaggcgaagctgtgcccccacgttggattgggcgggtgccccgtttgcgacgtccttctcgcctgcaatacgacgaggtggggcgcgatgggcggggctggagagatgggtagcttcttcgccacgtccgcgagatgtccctcttgcctgccaggcggttgcgtgacgctcgacgctggcacccgagattgtcggcatcttcccctgtgagtgaaatcgcgccgctcgtctgggtaagaaaccaaatgacagagtgtaactaacatattgggaggtccgatatggcagagattatcgacgtgtacggtcgcgaggtcctggactcccgcggcaatcccaccgtcgaggtggaggtcacgctcgcggacggctcgcatggcagggcgatcgtcccctcgggcgcctcgacgggcgagttcgaggcctgcgagctgcgcgatggcgacgccgcccgctaccagggcaagggcgtttctcaggccgtcgcccacgtgaacgacgagctggcggaggcgattatcggcctcgacgccgaggaccagcgcgctgtcgacgcggccatgctcgcggcggacggcacccccaacaagtccaagctcggcgccaacgccatcctgggctgctcgctcgccgtcgcccgtgccgcggccgagtccaccggccagccgctctacgcgtacctgggcggcgtcaacgcccacacgctccccacgcccatgatgaacgtgctcaacggcggcgtccacgcggacaacaacgtggacttccaggagttcatgatcatgcccgtgggcgcgcccacctttgccgaggcgcttcgctggtgcaccgaggtctaccacacgctcaaggccgtgctcaaggagtccggccactccaccggcgtgggtgacgagggcggcttcgcgcccgacctcaagaccaacgcggagccgctggagtacctgcagcgcgccgtcgaacgtgccggcttcaagcccggcgaggacttcatgttcgccatggaccccgccacgagcgagctctacaacaaggagaccgggctctacgagctgaagggagagggacgcagcctcacgagcgaccagatggtcgactactgggagcagctcgttgacacgtatcccatcatctccatcgaggacggtctggccgaggaggactgggacggctgggtcaagctcacccagcgcctgggcaagcgcgtccagcttgtgggcgacgacctgttcgtgaccaacaccgcccgcctcaagaagggcatcgagcttggtgccgccaacgcgatcctcatcaaggtgaaccagatcggcacgctcaccgagacgctcgaggccatgcaggccgcccagcgcgccggttacgcctgcatcgtctcgcaccgctccggcgagaccgaggacaccacgattgccgacctcgccgtcgcgaccaacgccggccagatcaagagcggcgcaccctgccgcagcgaccgcgttgccaagtacaaccagctcctccgcatcgaggacgtcctgggcgatgccgccgacttcgccggtcgcgacgccttctacaacatccgctagcgacagcccttggagaagggcgggtcagacggggcggggatgcatgccgacgggtgtgcgtccccgccttcgtgtgtattcggccgtgcgatgcttaaagatcctagtcctcgtgttgattcggcgatggtgtgcttagcgctcctagggcccgcgtcgttttcgcacgttccaacccccaccagagctagtgcgactaagcattccatgtcagaatcaacacgagggctaggtttgctaagcatcggtccgcgaaatccgcacgagggccagtgcggctaagcattccacccctgaatcaacacgagggctagcaaggctaagcctcttccatgttcccgccgtccgctcgcgcgctgggctggctcgccactggacgcacgacctcctaatcactgtgatgggcaggttctctcgcgaggtggcatcgggcacatccacgtcatgcgcttcagtggcatcgctggtccatcccctctacgccgttcttctacgcaccggcggggacgctgacaacaactctcgcgcgtgaagattgcatgcaatacagttgtgcacaaccgaatacgcggcagggggaggacaatggccgcgaacgccacgaccaaggagggtcccgcatgaacgactacttcgacttcagcgtcaccgcgcaggacgggagcagcactcccctcgacgcgtaccgcggcaaggtcctgctcatcgtcaacaccgccaccgggtgcggcttcaccccgcagtacgaggacctcgagcgcatctacgctgcccatcacgaccaggggctcgagatcctggacttcccatgcaaccagtttgccggccaggcgcccgggaccgacgacgagatcaaccagttctgctcgctcaagtttgacaccaagttcccgcgcttcaagaagatcgacgtcaacggcgacgccgccgacccgctctttgtcgcgcttgccaccgaggccccgttccaggggtttggcaagggggccaaggcggcggccctctcgcgctttgccaagtccaacgccaagaagtttggcgacaaggcgtacgtgatgtggaacttcaccaagttcctggtgggcagggacggccgcctggtcgcccgcttcgagcccacggacgacatggcagacgtcgagcgcgccatcgaggggcagctgtgacgtccccccaggcccaggcgggggagaggggcgtcgcccccgtcgcagcggccgcgccatcctgcggcacgggcggcaccgaccaggcgcccgcccccatccggctgcaggaccagctgtgctttccgctctacgcctgctcaaaggaggtcgtgcgccgctatgcgcccctgctcgacccgctcggcctcacctacacccagtacatctgcatgatggtgctgtgggaggagggcgaggcaacggtcagccacctgggcgagcgcgtgctcctggactcaggcaccctcaccccgctgcttcgcaagctggaggagaagggctacgtcacgcgcgagcggggcacccgcgacgcgcgccagctcatcgttcggctgacgcccgagggaagggagctggagcgccgggccgcctcggtgccgcgcggcatgctccagtgcgtcgacctgactgcggaggaggccaccgagctcaagcgcctgctgctgaaggtgctggggcagctgcgacaagaccagcgctagccggaggagagacaagggcgacatgaccgcgcccccaccacgtggcgcagcggttcggcatgccccgtgcatgccatgcgacagagggagatgggctggaatggccgatgacaatcaggaagcgacgatgacggggacggacccggagggcgtgagcgcgagccgcgagggggcgcttccccccacgggacgcgaggcggcgatcgtgcgggcgagcgtgacgggaattgtcgccaacgtcctgctggcgggcttcaaggcggtggtggggaccctctcgcactccatcgccatcacgctcgacgcggtgaacaacctctcggacgcgctctcgtcggtcatcacgatcgtgggtaccaagctcgcggggcgtgcgcccgaccgcaagcaccccatgggctacgggcgcgtcgagtatctcagcgcggcggtcatctcggtcatcgtgctgtacgccggcgtcacgtcggtcgtggagtgcgtgcgcaagatcgtctcgcccgagacccccgactacacgccggtcgcgctcctggtggtcgccgcgggcgtggtggccaaggtcgtcctggggcgccacgtgaggtcggtggggcagcgcttctcgtccgactcgctggtcgcctcggggacggacgcgctctcagacgccgtgctctcggcctccaccctcgccgccgccctggtctacctggcgtttggcgtctcgctcgaggcgtgggtgggcctcgtgatctcggcgttcatcgtgaaggcgggcgttgacatgctctcgcagacgctggggcagatccttggggagcgcgtgtcgcccgaggtggccgagacggtcaagggcatcgtggccaaggaccccgacgtcctgggggtctacgacctcatcctgcacagctacggccccgagcgcctggtgggatcgctccacgtcgaggtgcgcgacaccatggacgccaatgccatcgacgagatggaccgtcgcatccaggagtcggtgtacgcgagcacccagggcaaggtcatcgtcgtcgccgtggggatctactcgcgcaacacgagctcgtgcgtcactgcggtgagaaacgacgtcacgcgccgggtcatggcccacgaccacgtgatccagatgcacggcttccacctggacgaggagcgggggctcatggcgttcgacgtgatcatctcgttcgacgcccccgaccgcatgggggagtaccgccagatcgtgagcgaggtgcagggggcctacccgcagtaccgcgtggacgtgacgctggacaccgacgtgagcgactgacggccgacggggcgggccggcgggcggcctgtcccgtccctctcccctttgccatgcgaggcaagagaacgccccggagcggtacgtgccgttccggggcgtcgttgtgacaacgtgggcgagaggtgctacttcttggccttgccctggttggcgacggccttgatctttttctcgatggtctcgggatcgccgatgtagtgcttgtccaggatgttccagtccttgtcgaaggtgtaggagtaggggacgccggtggggatgttgaccttcaggatctcgtcgggcgtgaggtgctcgagctgcatcaccagggcgcgcaggctgttgccgtgggcggcgatgagcacgcgcttgccggcctccatctggggcttgatctcttcctcgaagtacggccacgcacgcgcgatggtgtccttcaggcactcggtgtaggggaggtcctcctgggggacgtcacggaactgcgcctggacgtgcgggtcgcgctcgtcgcccggcttgagcgcgggaggctggacgtcgaaggagcggcgccagatgagcacctgctcctcgccgtgctcctcggccgccttggccttgttcaggccctggagggcaccgtagtggcgctcgttgaggcgccaggtcttgtgcacgggcagccaggcgcggtcaagctcgtccagcacgatgttgagggtgtggatggcacgcttgagcagcgaggtgtagcacacgtcgaagtcgtagccctgctccctgagggccttgccgcccgcagcggcctcctcgcgcccggtgtcggtgaggtcgacgtcggtccagccggtgaagaggttgagcttgttccactcgctctcgccgtggcggatgataacaaggtgcatgttctcgtcttctgccattgccattctccattcttgattggaactgctgccaacgggcatgacgaggtcattttatctcacttgtctggtgcctatatcgatgggtatagttgacctagactaacttataggttggccacggatcgccgtccaaccttctgatatctggaggtgccgcgatgatcgccaacatcctcatagtcgccgccgttggcgttgcgttcgctctgtgcatccgctcgctcgcgaggggtgggggcgagtgctccgactgctcgagcgcctccacctgcgccgtccacgccacgggcaagggcaagtgccccgtggcggaggacatggtgcgcaaggcggacgccgcccttgggagcgggagccaccgctcctgagtcgctgcccgacctcggacgggggcatgcctggctgccggcgggaggggtcccgacccgcgtggctcgcccctctcccgccgagccgtgccatcgccccgcccacgacctcggaaacagaagcgtaacgtcggtatgtcagctttagtatgatgggtcgtgctgcattgaaggagtgtcgaccgcgcgttgcgccctcgacaggaggaggtcatctgtgagcgatagaaacgtggacttcgtcctcaggacggtcgagaagcgtgggattcgcttcgtcaggctgtggttcaccgacgtcctgggcaacctcaagtcgttcgcgatctcgtcagaggacctcgaggaggcgtttgaggagggcatcggcttcgacggttcgtccgtggagggcttcgtgccccagcaggagtcggacatgctggccttccccgaccccaccaccttccagatccttccctggcgccccgagaccaagggcgtcgcccgcgtgttctgcgacattaagaccccgtcgcgcgagcccttcgagggcgacccgcgctcgtgcctcgaccgcctggtgcgcgaggtcgacgccaagggctacgtcatgaacgtggggcccaagatcgagtacttctacttcgagaacgaccacgaccccatcccggtggacaacgccggctactttgacctcacctccacggacgtctcgaccgacctcaggcgcgagaccaccctcatgctggagaagatgtccatccccgtggcgtactcgtaccacaccagcgcgccgtcgcagaatgccgtcgagcttcgctacaccgaggcccgcagctgcgcggacaacatcatgaccgcccgcctggtgatcaggcaggaggcctttgccaacgacatgttcgcctcgttcatgcccaagccgctcaaccactgcgcgggctccggcatgttcctgtaccagtcgctgttcgaccacgagggcaacaacctgttctgggcccccaagacccagaacgacgcgcacctctccgagctcgcgcagcactacgtggcggggctgctcaagtacgcgcccgagttcatgctggtcaccaaccccacggtcaactcgtacaagcgcctcatctccaacgacgtggtgcccgtgtacgccacctggggccgcaagaaccgcaccgccctggtgcgcatccccacgcacaagcctggcaagcaccagtccacgcgcgttgagctgcgctgtcccgaccccaccgccaacccgtaccttgccatcgccgtgtgcctggcggcgggcatccgcggcatcgaggaggagctgcccctgcccaaggagtcgcccgaggacatcgatcgcatgagcgaggcggagctggagcgcgcgggcttcaagcggctcccgcgcaacctcagcgacgcgatcaaggagttcgactccagcgagctcatgcgcgagacgctgggggaccacatctgcgactacctcatcgagcagaagtgggcggagtgggacgagtatgccgccaccgtcacggagtgggagcgcaggcactactacgcgggatactaggggagaggggcgagagcccctgtgccaaagggtcttgacggcggggtcgctggcgtctgtgtcggcggccccgcccttctcgtgcccggattgcccaaggtcgggtctcccggcagtcgctcgtgtccgcgggcgctggatgcgtgccgggaatatgcccgcgacgggggagcggacgagtccgccattcgctgtcggatgcacccaagttgggttgctggccttagcctgtggaagggcccgtccttttcgagcgtgttgcgagtgacgaacgtgttggcaacgatgggctccgaccgatttcggcacattaaagtatgaaaatacacgggcgcgggagccgcgttcgcgtctatcaagccttgaacctaggactagcagggcttgatatagtgtccgccagcctaggaggaaaacattatgcaagaacttgcatcaaggaagcctcacccaggaggactggtcgcaggggcgctcgcgcttgccctcgcgctcgtgctcggtggctgcggctccgccacctcaagctcctcgacgaggcttgactcttccggcatcacgaccgccgcggatgcgggcgaggtcgtggtcaagagcgcgaccgcccgtcccaacgaggacggcggcagcagcgtctttggcggccaggagacgcgcctgacctgggagggcaccgtcaacgttgactccggcatcaccgaggtgacgctcgcgctccccgacgacgcgacctttgacggctccaccacccgcgtgaccgtgctcgacggcctcaagcgcgtcaacatcgactccacgacctccacgaacggcaacaccatcaccatcaagttcgccgaggccattccctccgggtcgctcctgcgcctcgaggtcaccaacatgaagttccccaccaagggtgggtcgtactccgtcaccggcacctatgtgaccggcacgggcgagaaggcggagcttgacgcatcgcccaagatcacgatcaccgagctcaccacaacgcaggcgatcgtcaactggcttgacggccaggcctgggttgccgcctggaactccgtgcccttcctcaacatgttcttcaagccgcagttgctcgtgacctcgttcccgtcgctgttctccggctggatcctgtgcctcatcatcatcctggtcgcgttcccgtttggcatcctgctcggcctggtcttcgcgttcatgcgcatctccaagcatcgctgggtgcgtgcgatcgctgccatctacgtcaacctgctccgcggcacgccgctcttcctgcagatctacatcgcgttcttcggcctgcccatggtcggcatcaacatggacaacaacatcctgggcatcatcgtggtggccatcaacagctccgcgtaccaggccgagatctatcgcgccggcatccagtcgatccccaagggccagtacgaggcggcgacgtcgcttggcatgacctaccgccagaccatgaccagcatcatcctcccgcagaccgtccgccgcgtgctgcccaccgtcacgagcgacttcatcacgtcctacaaggacacctcgctcctctcctccgtcggcgtcatggagctcatgatgttctccaagaacctcaccacggtctcgggcaacatcacgccatacatcgccgccgcaatctactacctgatcgtcacgctgccgctgatcaaggtcgtgggcatcatcgagcatcgcctctccgcagacgagaacggcgagggcccacgccccaaggacgacgacatggagaccgaggacgagttcgaggctcccgccgccgacgagaaggcaaagccctccgcgttccaggcgctgaccgccccgttccgtgcccacaccctttccgacggaggtgtcgaggatgccatctaagtcaaagaagacgccgaagatcgaggtcccggtggtccctcccgcgatggacgccgtggaggcggcaaaggaggccgcggcgcacgaccgcgagctcaccaaccaccacttcaaggagggcgagcaccccatcgtccgcatcgagcacctcaacaagacgttcaccgacacgccggtgctgcgcgacgtcaacctggacgtctggaacggcgagatcgtggtcgtgctcggaccctccggctccggcaagtccaccatgctcaggtgcatcaacctgctcgagacccccacggccggccacatcctcatcgacgacgaggagatcaccggatccaagaagaccgacgtcgtgaagctgcgccgcaacctcggcatggtgtttcagcagttcaacctgttcccgcacctcacggcgctggagaacgtcatgatcggccagaccaaggtcctcaagaaggacaaggaggaggcaagggccgaggccctgaagcagctcgaccgcgtcggcctggcggaccgtgcggacttcaagccgccccagctctccggcggccagcagcagcgcgtggcaatcgcgcgagcggtagccatgcacccgcagatcctgctgttcgacgagcccacgtcggcactggaccccgagctcgtccgtggcgtcctcaacgtcatgcgcgacctcgccctcaacagcggcatgaccatgatcgtggtgacgcacgagatgggcttcgcgcgcgacgtggccgaccgcgtggtgttcatggaggacggcgtcgttgtggagcagggacgcccgggcgacgtgttcgaccatccccaacacgagcgcacgcgcgagttcctgggctccatctcgtaggcttgctgcctgcttgtgtcccgtcccgaagggggcggggtgctgcggggagtcgcttgcgactggaaaattatcggctgctcccgagagggtgcagccgattatggtatacatggaacaggtgtaaggtacgaccgtctattccgccagaggaattctcggcctcctaaatgcgggggagcttggaatgcaccacaagaatatcctgctcatatccaacggctcgcgctacctcgaacggatgcgtgagctcaagcatgcgctcgacgtctccatcctccccaccacctcggacacgttctcccaggcggtctcttcggggcacgactttgacctcgtgatcctggacatgcaggggctgagcaaggagacgctcgcgagcgtggactcgtacgtctcggacaacggcttcatccccaccctcgtcatccaggaggagagcgcgctcagcagcctccacctccccgcgcaggggcgcaacgacttcatcctctcgaacgctggcgaggcggagttcgaggtccgctgcgcgctgctgctgtggccgggggaggagagcgccccgtcggacatcgtgaccgtggacaacatgaccatcaacctggccacgtaccaggtctacatcgacgagcagccggtcgacctcaccctcatggagtactcgctcctctcgttcctcgccacgcacccctcccgcgcctactctcgcgagaccctgttgcaccgcgtatggggcttcgagtactgcggcggcacccgcaccgtcgacgtccacatccgtcgcgtccgctccaaggtgggaccgcagatcgcctcgcatatcgtcacagtccgtggcgtggggtacctgttcaagctgtagcctccatccttacgtcgccttgcgcgtgcccgtccccgtcaggcgtgggggcgggcacttttgtgcaatgagattcagaaaaccaaaagcgttgttctccaacaatgttgtgtggggcgccccgcctcttgagctgggaggttgggtagagactgtgtggcgacagacacatccaatgcgacgcgttcgcataagaggagggaactgccatgagcagcaacgaggatgggcgtccaccagttcctggcatggacggggtgggctccagctccgaagagaccatgaaggcgactcccgtctccccggctcccgacgcaacctgtcaggccggtgagggcggaagcgccgcgcagggtcccgagggcgagaagaacaagggcaagaggcacgggcgccacaagatgaagcctggtgccaagaccgccctgatcggtgcgtgctcgggcgtcgtgggcgccgcggcgatcgtcctcgcgctcaacgcgacaggagtgatcggcaaccagacggtgacaaccaagagcggctctggccagaccattaacatcacggccaactctgaggacgcgacggtcgccaaggcggcggctgccaaggcgcttccgtcggtcgtctcggtcaacgtgaccacgagcaatggctcgggcatcggctcgggcgtcatcctggacaccgacggcgacattatcaccaactaccacgtggtggacggtgccaccgcggtgagcgtgaccatcgacggcaagagctacgacgccaagatcgtggggtccgacgcgtcgagcgacatcgccgtcatcaaggtcgacctcaacggcgcgtcggtgacccccatcgaggtcggtgactccgacagcctggaggtcggcgattgggtcatgtccgtgggcagcccgttcggcctcgaccagtccgtctcggcgggcatcgtgagcgcgctcacgcgcaaccagctcatggagtcgtcctcgggcgagacgctctacaccaacctcatccagaccgacgccgccatcaaccccggcaactcgggtggcgcgctggtgaacgacgagggcaagctcgtgggcatctgcacgctgtactcgtcgagcacggaatcctccgcgagcgtgggctttgcgattcccggcaactacgccgtcaagatcgccaaggagatcatctccggccagacagtgacgcacccctacatcggcctcacgatgaccaccgtcaactcccagaccgcctaccagaacaacctcagcgtgagccagggcgccctggtggtcgcggtcaccgacggcagccccgccgccgaggccggcatccagaagggtgacgtgatcaccgccgtggacgacgaggagatcacgtctgcagacggcatgatcctcaacgtccgctcgcacgagatcggcgacaaggtcaaggtcaccttcgtgcgcgacggcaaggagcagacggtcgaggtgaccctgggttccgacgaggcgcttcagcaggagcagcagagccagacccagacgcaggggaccaccaccgggaacaccgattccaacaccaactccaacaccaacggcaacggcacgggcaccaacagcgaacagcagtacctggaggagctctacaactacctctacaacaacgatcgcggcggctcgtacgacaccaacggcaccacgacgaccacgaccacggattcgaccagcgggactgccacggcgtagccgggcaaggcaagcttatccaagcaaggggagaggcccgggggcacgttccctcgggcctctccccttgtgtttgacaggtacccctatggggtatatccttcaggcgtagaaaataccctcagggggtaatgagagaagagggagccacgatgggtgaggtggagtcgaacgccaggggtgccaatgcgacgccagcgggatgctgctgcggggatgccacgggaacggggcagggtgccgtcccgcgcatgaagagcatgccccgctcccccgaggtcaagcgaaagctcgacgcgcgcatcaaccgcgtgaccgggcagctcaacggcatccgcaccatgatcgacgacgaccgctactgcggcgacgtcctagtccagctggcggcggtcgagagcgcggtgaagtcaatctcacgcgaggtcatgcgcgaccacctggagacctgcgtcaccgagcgcatacgtcagggggacgacgaggtcgtggacgaggtcatgcagctgttcaagaagttcatgtgaggcatcggtaccaaccgtgacggattcgcgcggtggtgccgccgcgaggggaggcatgcgtctgatgagacagacgttcgacatagagggaatgacctgcgctgcctgcgcgtcgcgggtgcagaaggcggcgggtggcgtgcccggcgtggccgaggccaacgtcaacctgctcaagaactcgatggagctggactacgatggcgaggccaagacgcgcgacgccgtggtggacgccatccagaaggcgggctacggggcgagcccccgcgggggctccgaggcaaagggctccaaggcaagcgagttcgttgacccccaggtcgcggcgcgcaaggcgacgcaggcgaaggggcgccagctggcatggtccctggcgtttggggtgccgctgttctacctggccatgggtcccatgctgggttggcccgaggtcccgggcctcgccgggatgccggggatgatggcgtcggcggtcacgcagctcctgctcgcgacctgcgtgctctttgtcaaccgtgcctactttgtcaacggcttccgcacgctcgcgcacctctcgcccaacatggactcgctcatcgcgataggctccgccgccagctacgcctacagcctggtgggggtgtaccagatggcgctcgcgctgggggccatggacatggaggctgcccactatgcgatgatgcactccctgtactttgaatccgcggggacgatcctggtcctgatcacgctgggcaagtacttcgagagccgcgccaagggcaagaccaccagcgcgatctcggccctcatggacctggcgcccaagaccgccaccgtggtgcgggatgggcgcgaggaggtcgttcccaccgaggaggtgcgcgtgggcgactgcgtggtcgttcgcgcgggcgaggcgatcccggtggacggcgtggtggtggacggcacggcgtccgtggacgagtccgccatcaccggcgagtccgtgccggtggagaagtccgcgggcgaccgggtgaccggtgccacggtgagctcgcgcggctggatcacggtcgaggccaccgccgtgggtgacgacaccgcgctcgcgtccatcatccgcctggtggacgaggccaccagttcaaaggctcccatcgagcgccaggcggaccgcatcgctggcgtcttcgtcccggtggtcatgggcatcgccgcggtcaccttcctcgcgtggatcgcgctgttcgcccccggcgacttcgccgtcgccttcaaccacgccgtgtcggtgctcgtgatctcgtgcccgtgcgccctgggcctggcgacgcccacggccatcatggtgggcaccgagcgcggcgccaaggtgggcatcctcatcaagagcgccgaggccctggagggcgcctgcgacctggacgaggtcgtgctcgacaagaccggcaccgtcaccgagggcaagcccagcgtgaccgacgtgctgccggcggagggcgtctctgccgaggagctggcccgtctcgccggcgcgctcgagcgcaggagcgagcatccccttgccgaggccatctgccactgggcggaccagacgctgggccaggggtccgtggacgatgaggtcagcgggttcgagcaggttgccggtggcggcgtcgtcgcacgcgtgggcggctccagcgtgtgtgccggaaacgcccgcctgatgggggagaggggcgtggacgtctcgtccgtctccgatgccgccgatgcattcgcagaccaggcaaagaccccactgtacgtggcgcgcgacgggaggctcgtcgggttgctggccgttgccgacgtcgtgaagccgtcgtccgcgcaggcgatcgcccgcctgaggtccatgggcatccgcaccatgctgctgaccggcgaccaggagcgcaccgcccaggtgattgccagccaggtgggcgtggaccaggtggttgcgggcgtgctgcccgaccagaaggagcgcatggtccgcaggctgcagcaggagggtcgcaaggtcgcgatggtgggcgacggcatcaacgacgctcccgcgctggcacgcgccgacatcggcatcgccattggcgccgggaccgacgtcgcgatcagctcggcggacatcgtgctcatgcggtccgaccccgccgacgtcgccaccgccatcgagctctcgcacgccacgatgcgcgacatcaggcagaacctgttctgggcgctgttctacaacgccatctgcatcccggtggcgatgggcgtgctgagcccgctcggcatcacgctcaaccccatgatcggggcggcggccatgggcttctcgtccgtgttcgtggtcagcaacgcgctcaggctgtttgcctggaagcccgggaagactcgtggtatgaggtcggacggggcagcgggagcgggcagggcggagctcacctcgctcgaggacgagggtccgcaggaatcggtttccaaggttggtctccccaagcagggcgaccaggagggagagggtcagatgagtcagaagaggctgaaggtcgagggcatgatgtgcgagcactgcgtggcgcacgtgacccaggcgctcgagggcgtgaagggcgtccgcaacgtccaggtgtcgctggacaagggcgaggccacgctcgacgccggtccgctcgtgaggaacggagtgctggtcaaggccgtcgaggaggctggctacaaggcgacggtggagtagccaggggagaggagcgcggccaacgcggtcgcaatccatcccacagggggaccgggcaacgtgcctggtccccctctctcttcatggctttagcctgtgtcgcgccacgcgcgacacagagaaccacccgatcagcgggtggatggcactgacgctatgcaacgaaactccctcccctctaggatggcggttgttcaggtcgccggccgcgagaggaaggagaacaccatggcgcagaaggcgaacagcctcgcgcacaccaagtggatgtgcaagtaccacatcgtgttttgcccaaagtataggagaagggccatctacaaccaataccgcgaggacctcgggcagatcctcaggcagctatgccagtggaagggggtcgagatcatcgaggggcacctcatgcccgaccacgtgcacatgctggtgagcatcccgcccaagatcagcgtgtcgagcttcatgggatacctgaagggaaagagctcgctcctcatgttcgacaggcacgcgaacctcaagtacaagttcgggaacaggaagttctgggcggagggctactacgtgtccaccgtcggcctgaacgaggccacgatcgcgaagtacatccgggagcaggagcgggcggacatcgccctggaccggctgagcgtcaaggagtatgaggatccgttcaagaggtagcctggcacagcccgtttgacgggcacgccacgagtcaagcggccatcgggcctgaacgaagtgaaggccagggacttgagtccctggccggcttttctgggttataccctaagagcaaaccacccgctatgcgggtggtgatgattacctgtgagggggtcgctgtggtcgcggccatatctgagagaccagtccgggggaagagctcagagagggatggagctggggacgttgccgtcgcagtgatgccttaccgggtggcgaccgattcaggaagggccctaagaagaggtcggactgagggtgttgtcgttgccgttgggtccaatcgaatggcagtccgcgccgagaagaactcaaagaaggatcgagctgaggccgtccccgtcctcgtggggctcagtcgggttgcatccccattctcgagtagtgctcaaagaagggggctgggatgacgacagagtcgcagacagcggtcccgacggccccgacagcccgtctgctcccctcggagacttgatgatgggcgcgccatccgaaagcatcaaagtttgcagcatgacgggagaacgcccgggtgagcaccttcccgggagatcattcccttctcgcgaaggaaggacctacgttcccgcaggtaatactgtcaacggtaacgagcggcgtaatctcctagcagcaaactcctgatgtgagtactcactacgggagtttgctgccaaaagggtccctctccagggttggatggcaacggaagcccgaaatgagtactcatatcgggaagttgctgccaacgcatgtaggttggccaactgccagctgcgggaatgcggggcgggtggcactacaagcccgacatgagcactcatttcgggacgtggctgccatagtgagaaaattgatgatgtgaatcggcccgcaaggacgacgggatgtcctccggctatggaagcggcacctacgggcacatggggaggcgtgaacgtcgatgatccgtggcccattgggcagatgttctgccacgggggcgaactgcggagccatccctctaccggttgctcttcgagcctcgacaaccgccggtgcccaccccctcttagagttcttttgaaacggccttggacgagggggcctgtcgcggcgttgcttggggccgggggcgacagacttccgcatgcctcccagccacgactttctactttcgctcggcccgtccccgagcccacagcacgagcgcgatcgcagccacgaccacgaggcttgcgagcgtcgcctggaccccttcaaagcgcagcatgggtatccccatgaacagcccgatgaggtacgggaccagccagaccagccacacgacggtgctcagccggtggaaggtccgcgcggccccgtcgtcgtgccgcacgaagacgaccgtggcccacacggcatggaagagcatcagcacgatggcgagcgcgccggtgaccccgtggatcgcgggggcacccgtgccacctgagtgcgcaatcatggtcatgagcgtggtcccggtggtgtcgcacgcgaggccgcaccagaacagggcgagctgccttccgccaaggcgcccggcgcgcctctcggagaagacgccgatcgtgtacaggacaagggccagcgtgatggcaaggctcgcgggcatgacgagggacctcatggcaacctccaaagcgacgtcgcgcggcccgttcggtcgcccgcggaacgcactatatacccgcgaggtgtcgaggcggccggcatcctccttccgtctcgcccccacatcccacgtccacgtgacgcttccgcgacggccctcgcacgtccttcgcctcccgccgggtccgcgcgatgcgctacgctagccacgacggactcgcgcactcgagggaccaatcggaccccaccgcccctggcggtcggggcggcagaagggggaagcatgtctcagcaggcgggcactcagggttcgctctttggcgacggggacaccgggggagaggggggcgcgtccatgcctccggagccgtcccgccggcagacgcccgcccagcgggcggccgagctcaaccgcatcctcacgcacgccgcgtacgcctactacgcgctcgacgaccccgagatgaccgacgcgcagtttgaccgctacctgacggagctccgcgacatcgaggcagtccatcccgagctggtgacccccgacagctacacccagcgcatcggcggcttcgtgagcgaccagttcgagcccgtcacgcacgcacgcaggatgtactccatcgacgacgccatgaacctgggcgagctggacgagtggctggcccgcaccgacgaggccctgggcgcgacccccgaatcgccggtcgcctacacctgcgagctcaagatcgacggcctgggcatcgccctcacctaccgcgacgggcagctggtgcgtgcggcaacccgtggcgacggcaccacgggcgagaacgtcacggccaacgcgctcaccatacgagacataccgcggtccctctcgcctgccggactcgcccgcgtgcaggaccgcggctttggccagtcggtggaggtccgtggcgaggtctacatgcccaagcacagcttcgtgcgcctgaacgagcagaacgacgccgccggccgcccgcccttcgccaacccccgcaacgccgccgcggggagcctgcgccagaaggaccccgccatcacccgcgcgcgcgacctcgagaccttcatctacgccgtggcggacgaggggccgctcgcggtctcgacccagcacgacttcctggcgtggctgcgcgactgcggcttctccgtgaacccgcatgcccgcctggtggacagctccgcggaggtccaccgctactgcgcggatgccctggcccaccgcgaggacctggactacgacatcgatggcgtggtggttaaggtcgactcgttcgccagccagcaggccatgggcttcacggcgcgtgccccccgctggtccatcgcgtttaagtttccgccggaggagaagcgcaccgtcctgcgccagatacgcgtccaggttggcaggacgggcgtcctgaccccggtcgccgagttcgaccccgtgctggtggcgggctccacgatcgcccgtgccacgctgcacaacatcgacgaggtgcgccgcaaggacgtgcgcgagggcgacacgatcgtagtccacaaggcgggtgacgtgatccccgaggtcgtggggcccgtcaccgagggcgacatggcggacgcccacgcgctccgccccctgtggcagatgccccagacctgccccagctgcggcagccccgtggtgcgcgaggagggcgaggtcgcctaccgctgcatctccatcgactgccctgcgcaggcgaccgagaggctgatccactggggcagccgcaacgccatggacatcgacggcctgggcgacgagatcgtgggccgcatggttgagcagggcatcctccacgacgttgccgactactacgactccctggacgagcggacgctcgccggcgtggacacgggccgcaggtacgagacgagcgggcgcgaccacgtggagggcgatgccatcgcggttggccccaccatcgcgcgcaagatcatggagcagatcgaggcgtccaagcaggccggtctcgcccgtgtgctctttggcctgggcatccgccacgtgggggctaacgtcgccgggctgctcgccaaccactttggcagcatgcaggcgctcgccgcggcctccgaggaggacatctcgcagatagacggcgtggggcccaagatcgcggcgtcggtgcgggaattcttctccgtccccaagaacgtggcggtggtggagcgcctgcgcaaggcgggcgtgtcgctggagcaggagggctttggccaggagccggagtcgccgcagacgctcgccggcctcacgttcgtgctcacgggcacgctcgagaagtacagccgcaccgaggcgggcaaccagctcaaggcgctgggggccaaggtctcggggtcggtctcaaagcgcaccagcttcgtcgtggcgggtgcctcggcggggtccaagctcgctaaggcgcagtcgctgggcgtgcccgtgctggacgaggcggcgctcgaccacatcctccagacgggggaggcgccgcaggcgccggcggagtagggcttggcgcgtgccgtcgcgcctcgacgtggcggcggcacgcgcgtcggccgtgcccaccgcgcgccgaggggacgccgaatcccgtcgggtcccctcccaagacgggggcaccgttcctctcccttgcatgaatacttcctgaaatccaatatcccaaaccaggggagaggggcgtcggcacgccgcagcgccccgtcgtgccgcccgtttgtttcgtcgtggctacgagaaggtgacgcggctttgtcatgttcgcggagcgggggtgtcgtaatcggggcgaaaccaagcgggttatatgattccaaacccacaatggaatcagtgccactaggaaacgggagaggcaatgagctatagcgaactgtccgagggcgtgagggacctcgaggagagggggctgtaccgccaggagttcgaccacgacgcctgcggcatcggcgcgctggcgcagatcgacggcaagcgcagccacgccatcgtggacgacgccctgtcggtgctcctcaacctcgagcatcgtggcggcaaggggctggagcacaacaccggcgacggcgcgggaatcctgttccaggtgcctcaccgcttcttccgcaaggaggcgcagcgctggggccagatcctcccggaggagggcgactacggcgtcgcgatgctcttcttcccccaggacgacgcgggcgtcgcggcggccaagcgcgtgttcgaggagggctgcgccgaggagggtgtgcccctgctgttctggcgcgaggtccccgtggacgcgcatgacctgggcgagacggcgcgcgactgcatgcccaccatcctgcaggcgttcctcgcccgtcccgagggcgtggaccgcggcgacgacttcgagcgccgcctgtacgtgtgccgccgcaccatcgagggcaaggcgaaggccgagcatgcgctggagggcaagatcttctacgtgtgctccatgagctcgcgcacgatcgtctacaagggcatgctcgtcgccacccagatgcgccgcttcttcctcgacctcaacgacgccgccgtggagagctcgctcgccctggtgcactcgcgttactccaccaacaccacccccagctgggagcgcgcgcaccccaaccgcctgatcatccataacggcgagatcaacacgctgcgcggcaacgtcaactggatccgcgcccgcgagccgaacctgtactcgcccgtgctgggcgaggacctcaagaaggtcgtccccatcatcgaccgcgagggctccgactcggcgatcctggacaacgtgctcgagttcctgcacgtcaacggctgggagctcccgcgcgccgtcacgctcatgctccccgagccctgggatcacaacaaggccctctcgcgccagcgccgcgcctacgacgcctacctctccatgctcatggagccgtgggacggccccgccgccatcgcgttctccgacggccgcggcatgggtgctgccctcgaccgcaacggcctgcgtcccgcccgctactacgtcacgcgcgacaaccgcttcgtgctctcgagcgaggcgggcgccctcgacgtggaccccgagaacctgctgcagtccggctgccttggcccgggggagatgctcttcgtggaccaggaggagggccgcgtcctctggaatgacgagctgaggggccgcttcgccagcaggaagccctacgccgactggctgcgcgccgagaccctcgacgtcgaggacctgcacgagcccgagggcgaggccgccccccgtgacgccggagtgggccagaccagccgcatggccaagctgggctaccactacgacgacgtggacgaggccctgcgacccatggccaaccagggcaaggcgcccctctcgtccatgggcgccgacatcccgctggccgtgctctcgcaccacccgcgctcgttctacgactacttcaaccagctgtttgcccaggtcaccaacccgcccatcgatgcgctgcgcgagagcctggtcacctcgacggtgctctacctgggtaaccacggcaacctcctggaggacagccgcgacacctgccgcctcatccgcctgaagtcgcccattctcaccaagggggagttcgagcgcatcgcgtccgtggaccgcaccggcttccacgcgcgccgcttctcggcgacctaccgccgcgacggcggccccgacgccctggagaaggccctcagggacctctgttcccaggtcgaggacagcgtccgcgccggcaccaacatcatcgtgctctccgaccgcgcgggggagggcgaggtccccatcccgtcgctcctctcccttggcgcggtgcacaaccacatgatccaggcgggcatccgcatgctcgccgacatcgtgatggaggcgggcgacgcgatcacgccgcacgacttcgccacgctggtgggctactccgcctcgggcatctacccctacatggcgcatgagacgatcgaacgcatggccgagaagggcgccatcgacgtctcggccgagcagggcgtggccaactacgacaaggccgtggtctcgggcatcgtctcgatcatgagcaagatgggtatctccaccgtccagggctaccactccgcccagatcttcgagattgtgggcctctccgacgaggtcgtgagcacctgcttcgagggcaccgtgagccgcgtgggcggcctggggttcgccgacatcgagcggtggtgcgaccgtcgctacgacgaggcgctcgcgctctccaagtcgcacgcgcccaaccagcttgcgacggccggcctgaccaagtggcgcccgcttggcggcgaggaccacatcatcagccccgacgtgatctacgacctccagcgctccgtgcgcgagggtgactacgagcgcttcaggagctacagcgccggcgtccaccgcaagggccgcaccgtggtgctgcgcgacctcctggagttcgtgcccctgccctccggtcccgtgtccctggacgaggtcgagcccgtggagtccatcgtcaagcgcttcaacaccggcgccatgagctttggcgccatctcgcaggaggcgcacgagtgcctggccatcgccatgaaccgcctgggtgggcgctccaacaccggcgagggcggcgaggaccccgcgcgcgaggacgcgcttcccaacggtgacagcgccaactccgccatcaagcaggtcgcatcgggccgctttggcgtcacgagccgctacctgtgcagcggggtcgagatccagatcaagatggctcagggcgccaagcccggcgagggcggccacctgcccggcaagaaggtctggccgtgggtcgcgcgcgtcaggcgctccacgcccggcgttggcctgatctcgcccccgccccaccacgacatctactccatcgaggacctcgccgagctcatcttcgacctgcgcaacgccaacccatccgcgcgcgtctcggtcaagctcgtgagcgaggcgggcgtgggcaccatcgccacgggcgtcgccaagggcggtgcctccaagatctcgatttcgggcgccaacggcggcacgggcgcggccccgcgcgactcggtgtaccacgccggcctgcccctggagctcggcctggccgagacccagcagaccctgctcatgaacggcctgcgctcccgcgtggtgctcgaggccgacggcaagctcatggacggccgcgacgtcgccgtggcggcgctcctgggcgccgaggagtttggcttcgccaccgccccgctcatggccatgggctgcctcatgcagcgcgcgtgccagcaggacacctgcccggtgggcatctgcacccagaacgcctacctgcgcagccactttgccggcaagcccgagcacgtggtcaacttcatgaccttcgtcgcccgcgagctgcgcgagatcatggccaagctcggcttccgcaccgtcgacgacatggtcgggcaccccgagtgcctgcgccaggtcaaggtcgagggcgccgagaaggccaacctctgcgacctgtcccgcatcctcgcgccgtccaccaacgtgttcggcaagaacgtgcccggcgccgagtgcccgcaccacctggagtccatggactttgaccccgagctcgaccgcacgctcgactccacgctcttcgtgccctacacgagcgacgcgcgcgagcacctcaagcccatccacttccaggtggacatcgccaacgtcaatcgctgcgtgggcactctgctgggctccacggtcaccaaggcgcatcccgacggcctgcccgacggcgccatcaccatcgactgctcgggctccggcggacagagcttcggcgcgttcctgcccaagggcgtcacgctcaacatccagggagacgccaacgactactttggcaagggcctctccggcggcatcctgacagtggcgccctcgccgcgcgcgagctacaagttcgacgagaacgtgagcatcggcaacgtcgccttctacggcgcgacctcgggtcgtggcttcatcaacggcctcgccggccagcgcttcggcgtccgcaactccggtgccacaatcgtgtgcgagggcgtgggcaaccacggctgcgagtacatgaccggcggagaggcgctcatcctcggcgaggttgggcagaactttgcggcgggcatgagcggcggcgtcgcctacgtctacgacgagttcggcaccctcgagcagcgctgcaacatggacatggtccagatcgagcgcccgagcgacgacgagatcgagcacgtccgcgagctcatcagggagcacgtggagcgcaccaacagccccaggggcatcaggctcctgtaccagttcgacgcagagcgcagccgcttcaagaaggtcatccccgtcgagtacgcccagatcctggcgctcgtgcgcgatgaggagtccaagggagcgacccacgacgacgcggtcgagaccgcgttcgagaccatgaggaggggaatgtaatgggcaagtccggagcatttctggatgtcaagcgccaggagcacggcgagcggcccaaggaccagacgctgctcgactacgacgagttcgccattcccctggacgaggagggccagcgccgccaggcgtcgaggtgcatgatgtgcggcgtcgcgttctgccagaccggcatgcccttcggcgaccgcgggcgcgtctcgggctgcccgctccacaacctcatccccgagtggaacgacctggtgtggcgtggcctgtggtccgatgccgcccagaggatgagcctcaccaacccgttccccgagttcacgggtcgcgtgtgccccgccctgtgcgagaaggcctgcaacctgggcctgtacgagggcgccactacgatcagggacaacgagcgcgcgatctccgaccacgcttgggccgcgggcgaggtcgatccgctccccgcaccggcggagggcgcccccaaggtggcggtcgtgggctccggcccctccggtctcgcctgcgcatgggagctcgcgagccgcggcgccgccgtcaccgtggtggagcgcagcgaccgtgcgggtggtctcctcatgtacggcatccccaacatgaagctccccaaggacgtggtgaggcgcaggagcgacctcatggggaggagcggcatacagttccgtctctccaccgacgcctccgaccccaaggtcgccaaggcgctcagggacgagttcgacgccgtggtcgttgccgtcggcgcgggcgacgcccgcacgctgcgcgtcccgggcatggatgctgatggcgtggtccttgccgtcgactacctcacgcaggccaccaagggcgtgctgggggacggtgcccccaaggtgagcgccaagggcagggacgtcgtggtcatcggcggcggtgacaccggcacggactgcgtcgcgacggcgctgcgccagggtgccaagagcatccgtcagttcgagttcctccccgagcctccccacgagcgcctcgcaggcaacccctggcccgagtggcccgacgtccgcaaggacgactacggccagctcgaggccgaccagaggtttggccacgacccccgcacctgggccaccgacacgctcgaggccctggtgggcgaggacggctccgtcgaggggctgcgcatcgtctcgctcgactggtccaacggcaagcccgagcgcatcgaggggagcgaacaaaccatccccgcccagctcgtgctcatcgcctgcggcttcaccggtccccagaggtcggtctacgatgccctgggcgtcgacgtggactccgtgcggggcggcgtgcgtccccgccttgccgaggccggctctcaccgcaccgtcagcgacgcggtctatgcgaccggtgatgcccgcaacgggtcgaccctcgtggtcacggccatcagcgacggcctcgcctgcgccggcgaggtggcggcagacctgggactctagtagccaggggagagaagagaagcgttctagcgaggggcgcccgtggaaacccgcgggcgcccctcgttgcatccgcccccgctggctgtaagtggattccgcggaaggaagccctcaggggtcaaagaagggggtcagctccactccacacgggtaagtgcgccttttcgaggacgggagtccccccgcgacgagggagggcaggccgcgctcctcggtgaccggcaagccctcagagtcaaagaagggatgcggagtcgtttatcatctccgccagcaaacgcgtcattgctggtgggggcccttgcatgggaaggggaacgggaggcgctggcccttctgtaggtgatggggtgtcagagtcaaagaatggacggggtcgggacctgtccccacgggttcttttcgcatgtatggaccatccctccgtagggaaggtccgatttgggcttgaggttcttccatcccgtggcggggaacaccctccgccagaactgccatggcgcgcccgtacgggaatccggcgctcgtgcgcttaacaccctagtcctcatgtcgattccggggaagggtgcttagaagcgctagccctcgtgcgggtttgacggctggaatccacaagaggcctagttccgctaagcatgtggtggcccaatccacaagaggactagtgccgctaagggcacgcttcccgaaccaccacgggactagcctggctaagcatccggaggcaaaacccgtgcggggctagcgggactaagcggacgaggggtccgtccacgcgggccgggggaaattggacagcggcgtccctccgctcgtgcaggagcgtgccctcccgggagacgctcccctcgctgccgttctttcacggcgtcatccggtgtacgtcttcgctccgaacgaggcgcgtgacgtaagccgagactcaggagcgggcagggccggagcccaccgcaccttactcgtggaccccttctttgaccatgctctttactcttgtgagcctctcgtctgcttgaggtgtgagatggatggggatgcaaaggctggagaacccttgggggttcctcctcggcgacgtgggggcggatgccgacggatgtcggctcctagccgatggtcacgtccctctcgccctctgcatcctcatgggcctggtccctgatctggcgggaaaggtgcacgcaggcgaaggtgaagaggatggtgaggaaggtcaggggcagctcactgacggtgatgtcgctgtgcatgaactgcagcacggtccatgcaacctcgagcgcgaggaccacggtcgagaccacgaggaaggggccgatgtgctgcgggtggttggccccgaacgtggcgaggagccccgcgcccaggaggagcccgccggtgattgcgaggccgatttcgccgggggtggacacccatccggcaccgttgggggcgatgccgttggcgccgagcagccaggcgagaagtgcgacgagcagggccaccacgccctcgagcaggagcaccatgcccatgaagtggaggcggcgctgggtcccgtcgagcacgaggagctcacccttgacgccgagggcgtagtccttctccacctcgtcggcgagcgaggagcacaccagcacgtagatgaccgtggcggcaagcacgacggggtcaaagatcacgatcttcccgtttgaccagcccgcgataatcaccagcaggatgagcaggctcacggtgtagcagagcgagcggtaggcgctcgccttggagtagtcgcgggccgcacgtatgccgagccaggaggtgactcccagcagcgccgcggcgcagatgaccaggccgcccatgcgggtctgctggtcggctatgttcgcgtggcccatcaccacgaggacgacgcccagagcgaggatgagccccgcgaggaccgccatgaggatcgagacaaagtagagcagcgtctgcgagggagtgcgcctcgtcaccgttacgtcgcgtctcatgggacctcctgaccctcgcagttctccactgcaccatcatactgttatgtgcctgcggatttcccccctccggacggtcgtggcgccccgggacgaatatactttcgtgccatggaaactacgctgctctccctcttcgtcatcctcgtggtgaccgcgatagcccccttcctcgccagcctggtcccgggacgcgccgtcccggaggtcgtgttcctggtctttgccggggcgctcctcgggccgtatggcgcccacctcgtgagcaacgaggggctcgcgatgcagacgctctcggaccttggcctgggcttcctcttcctcatggcgggctacgagatcgacccgcgcgagctcctgggccaccaggggagggtcgcgtcggcgtcgtggtttttctcgcttggcttgggcttcgccttcgtggcgctggtcttctcccgcctggggttcgagcgctcgtcgtggccagccatggcgctgctcatgaccaccacggcgtacgggaccctcgcccccatcatgagggacaggaacctgggccccacgcgcgtgggcaaggccgtcgtggcgtacggctccacgggagagctgctccccgtcgtggcgatgtcgctcatgctgtcgggcaggaccatctcgcgctccctcgtgatgctcggggtgttcctggcggtgtgcgtggtggtcctggcgttctcgatgagcctcaagcgcatcggtggcaggttctggaccttcgtgacccagagcgccggcacgtcctcgcacgccatgatgcgcctggtcacggcgatactggtgctgctgctcctggcggccgaggtcttctcgatggatgccgtgttgggtgcctttgccgcgggcttcatcctgcgcgccctcttccccgagggcaacgaggtcatggagcgcaacctccacgtggttggcgcggggctcttccagcccatcttcttcgtgatctcgggggcaggcatcgacctcaaggcggccgcctccaacctcccggtgctgtttgggttcatcggggcgctcgtgctcgtgcgcggcgtggtcgtgggcgtctcgctcaagatcgacccgcagacgcgcgacatgggctggcgcgagatcctctcggcatccgcctactgcaccatggcactgccgctcgtcgtcgccatcacgggggtcgccgtggacagtggcgtgatgctcgactccaccgcctcggtgctcgtgacctccggcgcgctcacggtcctgctggtgccggcgctcacgtcgctggtccacgcggcggacgagtcgggcgtggcggacatctcgcaggagcttgcccagggcgaccagaccgtgcgcgaggtcctgcaccgccacaacgaggagtggcaccaggcgcaccacgcctacctggagcagcgcgcccgcaggcgcagccagggcacctacctctccgcggcggacttctacgcgctgtcgggcgggatgtcgggctacgtgccgcgggaggggctcgacctgcacgaacggcacggtcgcggaggccatggcggcagggggaagcccgctgggggaaacgccgggcaggcgcatgggggtcctgccggtcccgcgggcgagaggggagagcgatctggctcctgaccccgtgcggatggctgccgatgcacctcgcatgcggcggagaagggctggggcgcgccggggaggggtctcccgggcgcgcccagattagtctctctcccgtggcctcctagggccggccctccaggggaatgccgtcgtagtcgcgcgtgacgaacggggcgaggcggtcgcgctcgcccgatacgtaggcgcgggagatgccgtcccactcgccgaacgcgttccagaagaggtccgggaagctctcggtgcgcacctcgccggtggaggggtcacgccagggctggtggtccaggttggcgtcggggcagctgtcgccgctgcggttgagatgcgcctgtgccatggccagcgagtgcgggcgcacgatcctctcgaccgagcctatcaggcggttgcgcggcccgtcggcgggctcgatggcatggtagagaaactcgaagtccgccaggctgccctcgtactggcgcgcgtcgaccgagacgccaaacacctgcatggccacctgcgagaagatggcaccccccacgcgggagacgcgctcggtcctcgccagcgaggagctgatgatcgaggggtcgacctccgcctgccgcatggaccagagcatccacacgtccaggtcgctctcgatgagggcgtggagctcgctctgcgcgttcttcagcgaggtgtcggcatgcgcgagcgcgtgctgctgcgcgtagacgaacgcatggcagcggctgtccagcaggtagtgggccagctgccccagcgcaaaggcgcggcccacgcgcatgtcgtcgcgatgcaggtgggcgaccgtctccctcatggcgagaagggaccccatcgccttggggccgtgcatcaggtgcgcgaggctgcggcagcgggcggcccggtcgggcagcgtcgcgaagcgggcgaagaggggatcgggacccaggttgccaaggaggaaggcgagaagctcctcctccccctccaggaggccctcgggaagggcgtgggccgcctcctccccaaagaggtggtgcgtgatgagtgcgggcatgtctgctcccaatgagccggcgtcgcggccggcgtttcgtcgttgcgcgtgtgacagtgaagaggttatcccaatttcgcgtggttttcctcgcgaggcgccggattggccgaccattgcctagcattacgcacttatgcatgcgtggcggtgccgcatgcggcgtggcggtcgcgtcccggtgccgctggggagaggggacaacggtgtcggtcgtagaggtcatcctgctgggtgtcgcgctctccgccgacgcgtttgcggtcaccatctccaactgcttcgcctacccctgcgagcgccgtcgcaggctctacctcatgccgctcttcttcggcttcttccaggcgttcatgcctgtgctgggctacttcttgggtggcgtcgccgccgagctcatcgagcggtacgcggggctcgtgacactggtgatcctgggtctcatcggcgggaacatgatccgcgagggcgtgcacgcgctcaggcaccccgaggaggcctcgtgcgaggtggggagcctcaccatcaccaagctcctcttccagtcggtcgccacggcaatcgacgcgttcgccgtgggcgtgtccctgcgcgccatggtggtgagcctgcccttcgccgtgaccacgatcggcgtcacgacggcgctctgctgctgcgtggcgctcgccataggacgcaggctcggcgaggcgctgggagaccgcgccgaggtcgtgggcggcatcgtgctggtctgcatcggcatcaaggcgtttctgggctagccttccgcgcactgcggcggggtcctgcctgatgggggtggcccctctcgcctagctatcgcatgttaatggccgtcgggtcgtgccggtggttgtgggtggattcgaatgtccgacgatgctccggcggatgacgtcctgggattcgtcacgcccgggtggggacgctatgccgcctgccgtgactgcgtgcgcttgtctgcccgcctgagccacccgccgcggaagtagtacgccacgaacagggcgcaggtgagaatccacgtcacggggtatcccagcatgatcatgttgagcgtgtggtgcgagggcacgaagcccaggagccacaccagcctgaacacgcaggtacccaggatcgtcagcagcatgggcatgaagctctcgcccgcccctcgtatggtcgcggcgaagttgtccatgaacgagtagaagacgtagaacggcccgatgaagagcagcaccctggtcgagatgcccgccaccaccatgtcgcgcatgaagaagtacgagatgggataggcaaacacgacgagaagcgccgacacgccacccacgatcacgacggcgagcgagagggacgtgcggaccccctggcgcatgcggtcgtagttgcgggcgccaaagttctgggcggcgaacgtggtgaccgaggagccgagggcgtccgagaccatccagatcacggagtcgatcctgccggagaggccccatcccgccacgacgtccgtcccaagcccgttgatggcggactgggcgacgatgtttgacacggagtacacggacccctgcacgcccagcgggacgccggtgcgcagcatcgcccgtgccatgcgccggtcgatgcggacctcgcgcagccgcatgcgccaggggccctccgcccgggcgagggcgtgcagcgtcgccgcggaggacagcaccagcgtggcaaaggtggcgatggcgcagccctcgacgcccatgtgcaggccagccaccagcagcaggtcgagcgagatgttgaccacgcagctgagcgccacgatgagcgagggggtgcgcgtgtctcccacggcgcgctggagcgcagacccggtgttgaacacgatcgagaagagcatggcgctcatgtagatgcgggagtacagcagggactgggcgtagatctcggccggcgtgcccatcaggcgcagcgccccgccaaccagcagcacgcccaggacggagcagcccatgccgccgatgatggcgatgcccatggcggtgcgcacggcacgggacacgccctcgtcgtcgtgcgagccaaagtgctggctcaccaccacgccaaagcccacgcccatgcccacggagaagctcacgaccaggtcgttgagcgtgaccgtggcctccatggccgcgagggcgtcctttcccgcaaagcggccgaccacccacgcgttggcgagcgagtaggtctgctggaagaaggagctcaggaacacggggacgaacagcgtgaggagctgcttccagatgacccccgacgtgacgtcgagcgactcttgggcggagcggcgtggcatggtacctccctaggcgaggatcgggttgcggtggatggggtgggatgggtgagccgtcggatggcgcgacgtggttgccgctggcggcggattcatacaagaatatgggtatcacaagcgtaggccccgcgttcgcgaggcatcggagtgaggagaaaccatggagcgcatgaccacctcaaaggcggggacgatcttcgcggggatcgtctcgatcgccctcggtctcgtcctgttcatgaacccaaacggctccaccgtggcgatcgtgcagatcatcgggtgggcgctgatcgtgggagggggcttctcgcttgcgtgtgcgctctccagctggaacgtgatcctgatgcaggcggacctctacatgggcctccttggcctgctgttcggcttcctcatggtgaacatgccgggcgtcttcgtggcgtggctgttcatccttctgggcatctacgtcatcgtcctgggctttgagtcgcttgccgcggtcaacctcgcaggacggctcacggggagcaactccacgggctcccgcatcggcgcgctgctggtgatcgccctgggcgtggtggtcatgctgtcgcccattggctcggccagcgtcgcaatgtccatcacgggcatcgtgctcgtcgcactgggcatcggcaagattatggagggcattcggatgccgggcgggaagggatagcccctcccgtttcggcctgagccatgtctcgcaaggattgacgcggttagcacgctcctaaccgcgtcaaatcttacggaatctcgcgtctcgtaaagaatgacgcgtttaggggcatcgtaaacgcgtcaaaccttacgaggagggggaagaccctacgaaacaggggagaggcgccacccacccgggcagcgcctctcccctctggcatctctggtgcctgtgcccgctacacgtagaagagcatcttgttgtagctggggacaggccagtagtccttgccgcagaccttctccatctcgtcgacggcggtgcgcagcgtcgccattgcggggaggacgtcgtcgcggtaggcgttgtcctgctcggtgcagtcctcgatctcgtgggccgccttgttcttggcctcgaggtcgtccacggcggcggagatcttgttgatcccctcggtgagcgtggtcacgagcgccttctcggcggtcgcggcgatgcccagctcggccttggtggcaacggtggtcgcgatgtcgcccgagtactcgaacagcgcgggcaggtacatgtgcctggtcatgtacgccatcgtgttggcctcgatgttgatgagcttggcgtactgctcggcggccgcgacgtagcgggcgcgggtctcggactcgctcaggacgccgtacttggcaaagaacgcgatgttctcgggcttcaccaggtagggcagggcgtcgggtgtggtcttgaggttgagcaggccgcgcttctcggcctcctcctcccactccttggagtagccgttgccgtcgaagaggacgcgcttgtggtcgcggaacgtgtggcgcacgaagcgcatggcaaccgcggtgaagtcctcgggggcgacgccgtccatgtagttgacgaagcggtcgcactgctcggccacggcggtgttgagcaccacgttggggtcggacaggttctgctggctgccgcacatgcggaactcgaacttgttgccggtgaaggcgaacgggctggtgcggttgcggtcggtgttgtcgcggcgcgcgtcgggcagcgcggggacgcccagatccatgagctcggcgtccttggagtccgcgtgctccttcttcaccagtgcgtccacgaccggggtcagggcgtcgcccaggaagatggagatgattgcgggaggcgcctcgttggcgcccagacggtggtcgttaccggccgaggcaacggaaagcctcagcaggtcggcgtgggtgtcgacggcggcgaccaggcaggccaggaagaccaggaactgcaggttgtcctcgggcttgtcgccgggctccagcaggttcttgtcgtcggcgcagatggaccagttgttgtgcttgcccgagccgttgacatagtcgaagggcttctcgtgctgcaggcataccaggccgtggtgcgaggccaggaggcgcatcttctccatggtcaggaggttgtcgtcgatggcgacggagccctgctcaaagatcggggcgagctcgtgctggcacggggcgacctcgttgtgcttggtcttggcggggatgccgagcttccacagctcgtcgtcgagctccttcatgaactcgttgacggtggggcggatggcgccgaagtagtgctcctcgagctcctgccccttggcgggctcgcagccaaagagcgtgcggccggtcaggatgaggtcgggacgcgcggcgtagtcctcctccttgatgaggaagtactcctgctcggggccaacggtggtgaagacgcggcggggcttggagccaaacagcgccaggacgcgcttggcctgctcctccagggcgacctcggagcgcagcagcggggtcttcttgtcaagcgcctcgccggtgtagctgatgaacgcggtggggatgcacaggacctcgtccttgatgaagacggggctcatggggtcccacacggtgtagccgcgggcctcgaaggtggcacgtaggccgccggaggggaagctcgaggcgtcgggctcgccctggaccagctccttgccggagaaggccatgagcaccgtgccgtcggacttggggttgatgaagctgtcgtgcttctcgctcgtgatgccggtgagcggctggaaccagtgggtgaagtgcgtggcgcccttctccagcgcccagtccttcatcgcgtgagcgacctcgttggcgatgtcgatgtccagggacttgccctcgtcgatggtctgacgcagcttcttgtaggtgggctttggcagccgctcctgcatgtcggcgtctgtgaagagcagactgccgtactcctgcgataccttgtccatgcccatggagcctcgcttccgattgcttgcttgccaggacgtcccagattgtggcacggctgcagcccccgtgccgccctaagacggaagtcatattaatttcgaaatgttacccgtagataaatcgtttcgaacgcgcgtgtgaaccgcacgctgccgcttcgtgaagctgcaggtagaaacaggtatttaggctcttgggggccaaactcggacgagatggcgtccctgcgtgggcggtcgggcggccagctgcacagaagccgtggccttgccgccgccccgtccgggccgtcccaccccgccgttacaatgttgccagacaacgtgagaggggacatgcctcatgccacagaccaaccaggaagccgcacaggtcgcgggggagaagcgcgtcatcgccgtgatcgacggcaactccctcatgcaccgggcgttccatgccatccgccagcccatgaccgcgcccgacggaaggtcgaccaacgcgctcttcggcttcttcaacatgttcatcaagttcgtggagaccttccaccccgacggcgtgatctgcgccttcgacaagggcaagccacaggtgcgcatggacatgctcccgcagtacaaggcccagcgcccgcccatggacccgtcgctgcacgagcagttccccatggtgaaggacctgctgcgcgccatggacgtgcccgtcgtggagctcgagggctgggagggcgacgacatccttgggaccctcgcgcgccgcggcgagcaggcggggtacgagatgctcctggtcacgggtgaccgcgacatgtaccagctggcgacgaacaacgtcaaggtcgtcagcaccaagaagggcacctccgacgtggcgatcatgacgcccgagagcgtggacgacctgtaccacggcatcacgcctgacctcgtgcccgacttctacggcctcaagggcgacagctccgacaacatccccggcgtccccggcatcggccccaagaaggccgcggcgctcatcgtgcagtacggcaacctcgaccaggtcatcgcgcatgccgacgaggtcaagggcaagatgggcgagaacctccgcgcccacgtgggcgacgccctcctcagccgcaaggtggccacgatccgcaccgacgcgccgctggacgtgcgcctcgaggacgccaagttcccgacctttgaccccgccgaggtgagccaggccttctccgccctggggttcaccggcatgaccgcgcgggtgctcaggctcgagggggccaaaccgggcgacgtgcccgcgcccgtggccaaggacgcgctgagcatcccccagccgctgacgggcgacgacgcgcgcaaggccctcggcgaggcggtggaggccgggtcctgggtcggcgcgtgcgtgcagccggagggcgagaagaagggccagcagtcgctcttcgatgccgtcgcgccgcaggtcgtgtgggcctacgacggcagccgcctcatgcgcctggagggcgacgacgcggtggagggggtggcacttctcgcccgcgacggacgcatcgtctcggccgacgtcaagctgctgctgcacgtggcgtgccccatggactcgagcgaggatgccgccctgggggccgacgaggtggaggcggggcgcatctttgacgtgggcgttgccgactacctgctggagtcggaccgctccgacttttccgccagggggctcgccgccacctacctggacgcgccgctgcccgaggcgaccgacgagctgcccgaggccgccatcgacgccgtcgcctcgctcctgctccgcgagccgctccacaaggcgctcgaggccgacggcaagtctctcgccctgttcgaggacgttgagatggagcttctccccgtgctgctgcagatggagcgtaccgggctccacgccgaccgtgcccgcctggccgagcagtcgggcgagctgggtgccgagatcgaccagatggtggcccacatccgcgaggaggcgggggaggacttcaacctggactccccacagcagctgagccacgtcctgttcgaggtgtggggtctccccaccaccgggctcaagaagacccgcaagggcttctactccaccaatgccaagacgctcgacggcctggccgcacgggacgagcgcgtgcgggaggtgctcgactaccgcgaacgcgccaagatcaagagcacgtacctcgacgcgctgccgggcctcatcaggggagacgggcgcattcacaccaccttcaaccagaccgtcgcggcgacggggcgcctctccagctccgaccccaacctgcagaacatacccacgcgctctcagctcggccatcgggtgagaaccgcgttcaccgtgcccgagggctgcgtgttcctggcgtgcgactactcccagatcgagctcaggctgctcgcccacctctccggggacgagcacctggtggcggcattccgcgagggggccgacttccacgccagcaccgccgcgcgcgtgttcgacgtccccgtggagcaggtcacgccgcagatgaggagcagggccaaggccgtcaactttggcatcgtgtacgggcagcaggcgtttggcctctccacctcgctcaagatcccccgcgccgaggcacagcagatgattgaccgctacttcgaggtctatcccggggtccgcacgttcctggaccagcaggtggagtttgcccgcgagcacggctgggtcgccaccatgtacggccgcaagcgccacatcaaggacatcaacagccgcaacttccagctccgctcctttggcgagcgcaccgccatgaaccaccccatgcagggcaccgccgcggacatcatcaagatcgccatgacccgcgtgccctccctgctccgcaaggaggggctcaggagccgcctcgtgctccagatccacgacgagctggacttcgaggtgccagagggcgaggtggaggccgtctcggagctggcgaaggaggccatggagggcgtcgcccagctcaaggtgcccctcatcgccgaggtgtcgtatggctccaactgggcggaggcgaagtagcgtggcagagggcatgagctacgagcagatgctcgccgcccagcgcgacggtcgggtctcgggcggcgtgacgccgatgggcgagacggaccgcatgcgggtcgtggcgtacaccgacggctcgtcgcgcggcaaccccggccccggcggctacggggcggtgctcctctacaccgaccccaacggcgtcacgcacaccaaggagctgagccagggctatcgcaggaccaccaacaaccgcatggagctcatgggggttatcgcggcgctcgaggcgctgcgccggccctgccaggtggagctccactccgactcccagtacgtggtcaacgcgttcaacaagcactgggtggagggctggcagaagcgcggctggaagacggccagcaagcagccggtcaagaaccccgacctgtggaggcgcctcctccaggccaagcgggcgcacgaggtcaccttcgtgtgggtcaaggggcacgccggtcaccagtacaacgagcgctgcgacgagctggccactaccagtgcggacggtctcgcgggtccgctcctcgacgactccggcttcgaggggtaggcctggcggccgacgggacgtgtcgtccgtttggagctaggcccctctcctctcgcaaagtaccaccatggggtatatagttagccccggataacagagggcgagaggagaggccatgctggcaaacgtgatcatcgtcgccatcatcgcggtgcttgtcgtgtttggggtcaggaggatcgtgggaacggcgacgggcaagcgggactgctgctccggcgacgcccggcagacggggaggagcttccgccccgtcaccatcgaggacacggacgagagccactatccctaccatgctgacctcaccatatcgggcatgcactgcgacaactgcgtgcgcaacgtgaccaatgcgctagactcggtcgagggcgcctgggcgagggtcgacctgggcacgcgcaccgcacacgtgctgagcaagggacccatcgaccaggccgcataccgcgacgtcgtgagacaggcgggctatcgtgtcatcggcgttgccgagtagccgcccggacgtgaggtagcgcaacgtcccaagtcgctggctgcggaggatgccggcaggcagggaggcatcggggcgccacggcgagtcgtggcgttgggggtgacgatgggacgttcgaagcacatgaggcgtggtgacggggagggcgctcgcaagaggggcgccctcgcggtcatatggcggctgtgccttgcgtatctcgcctgcacggcggcgttcagcctgctctcggtcggagcggcggcgattcccgtcaacgccgtggaggaaaacgtgcggtcgtcgctgtcaaccctggctcgggagggtcagtatcccaggctctgggctggtggcgagagctggaccgtcgacaactacaccacggcagtcatgctcaaccaagcgactcacaacgcaggcaacccgttcctctcggctgcctataacttccagtggtatgggacggacgggggagacaaccagatcgtcgcgctccgcgacgggctccaatggcagacgggtagcgtggacggcgcgggatggatcgcatacgggcgctactggcacgggtaccttgcgtttctcaagcccctcctcaccttcctcgacctgcggcaggtcaggatggtcctcgccgtggcgttcgtaggcctcctcgcgtggtcggcgatgcggttgggaaggcgtgggggagtcgttgcggcagtcctctacgtctgctccttcctcgcggttcacgttcccgtggcgatggcctcgctgtcgtttgcacccacctttctgatagccgtgggggcgaccgtcttcgtgctgtccagacgggcgggggagaggtgcctcctcggagggggcgcgtgcctgcccttttgggcgaccttctactttgtgatcggcgccgtcacggtctacctggacttcctcgacacgccgatcatcaccctgggcgttcccctggcggtgcagctgtatctggagcggaacgccgtcggcaggcgagacctgcctcgggctcttggcgccgtactcctggtctcggtgtgctgggggctgggttatggcgggctcatggtcacgaagtgggtcctctccacgctggtcacggggcacgacttcgtcgccgatggtcttgggaccgcgctctaccgctcggggcagacctccacgacgggagacatcacgcgggcgatggccatcagcaagaacgtgagcttcctgggcgcgcgacggatggcggttgccttcgccgtcctcgtcgcggtggctgctgcgtggctggcgcatcgcgccgcccacggggtggctcctagggcgtcgtggtggtttctccccctgctcctcttggtcgccctctatccctacctctggtacctggcggctgccaaccactcgtacatacatacgttcatcacgtatcgagaccagctcgtcacgctggtggcacttggccttgcggttggttcggcgttttgcccgccccgcctcgagggtactgacgtgagtgcggacgggccgtgcgcggtcgcatccccgcgctagccgcactgttcgatgggcgggccggcacaggagcgtatggaggttctccccaggttgctgtccataaaatacctggcggggagaagggcttggatgggggagaggtgcttagcgaacctagtcctcgcgtggattccagtactggacgcttaacatcgctaggcctcgcgcggatttctgccgcacaacttgcacgagggctagcagcgctaagcatccagcgaggaaatccgtgcgagggccagcgggactaagcaccgccccgcaaccccaggcggctagctctccgtcacgtcggtcttgccgatcatgatgttgaggatctcgacgtcggtggggtgcatgccgacgcggcccacgtaccccatggagcggatcgtctcctctgcgttcctgcccaccaggccgtcgcccgcgaggaagttgtcgtccgagagggccgtgtcgcagcccaggatcgccgcgtccacggcggcgctgatctttgcggcgcagctgggcttggcgccgtcgcagacgatgccgcccacgttcgcaagcgtgttcacgatggtcgcctcgtactgggcgaacgaccctccgcgcaggtagcagatgcccgcgcccgccccgcacgacgccgacacggccccgcagaacgcgctcagctcgccgatgaagtacttcacgtgcacggcggtgaggtccgagaggaccacggcgcgcaccaggtcgtcgtgcgaggaccaaaggtcgtgcgcgtactccagcacgggctgcgagcaggtgatgccctggttgccgctgccgcagttgatgaccaccggcagggggcagccgctcatgcgggcgtccgagcctgcggcggccgcggcgcgcgccttgcacgagatgtcgttggggcgcgagtggagcagcgtgctgccgatgttcgcgccccacctgccgctgagcccctcgcgcgagatgttctggttgagctcgatctggcgagagatgagcccatcgacgtcggtgacctccagctggtgggcaaactcccagatggacttgagcgagaggtcctcgcgcctcgcgcgggagctcccggcgtcgccctcgccgtccgttgcctgggtcacgccggcggcggtgaccacctcgccgtcgagggtgagctcgaccacgttggtgtggcgctcctcgatgcatgcgaccgcctcgtgaccctgcgcgcgggcgaccacgcgcacgtacaggttggggacgccctcggccagctccacatcgcagaagtcggcgtcgaccagctccttggtgcgctccacgtcctgcggctgcaccgcctgcagcacctcgagctcgcgggtggggtcgccgccgagcgcgcccagcgtcgcagcggcctcgatgccgcgcagcccgcccgagttggggacggtgacgctcttcacgttcttgatgatgtttccgctgcaggcaacgaccagcgactcggggcgctggcgcagggcggcgcgggcgagtgccgccgcataggcgacggcgatgggctcggtgcagccaagggcgcacaccagctcctcgcggaggatcgcaacgtggttgtggtattcgctgggggtcatcgtctctcctgtcgtctggtgccgcgggtcgcggccgtggtgcctcgcgcccctctcgcccggctagcgtcccttgcgggcgtcccgcgagtcgagggtggcgcagatctcctgaaggtggttgccaagctcgccgatgggaccgcgccacaccgcgcgctgcgggagcccgtgccccacgtacgccgtgcagagccctatgtccgggcgggggaagtccctggtcgcgtcgttgcccaccatcaggcactcctcaggggcgagcccaagctgggcgcagaactcctggtagtagcgggcctcgggcttgcagcgcgtggagttgtcgatgtgcgacaccagcctgaagtccaggtcgtccacgtgcgcccactccatgcgcaccaggtccacggcgagcgagaacgtggggttggtcgccagggcaaccgtgtagccgagcgacatcgcgcgctccaccgtcttgcgggcacccctctgcgggcgggccatcaccaggccgtcgcgaaagcggcgtatgtactcccgctcgtagaagccgaaggcgttgacgagggagggctctcccatggggacgcccgagagctccgacacgcgacggtcaaagtattcgccgttggtgagggagtcctggcgccgccccggcgagttgatctcgaggtagccctgggcctgccaggcgtaggcgagggggagggggatgcgtgcggcacgggagaggatcttggccctgccccagaggaagcgcgccacgaaggcggtgaggttgatgtcgaggagcgtgtcgtcgaggtcgaagaggaccgccttgatcatgtatgccgctcccttccgcgtcccgaacgtcctgcatcgtccctgttccccaccccgcctgtgaaattgcggatttggcaacgaagttcttgaaaaagggacgtacgtaaaggtaacctatcaaacgcatgagtagaatgctcatgcaaagtatctgtcggcccccgagagcatgtaagtttccaattgcgcgacgcccacgccgagcgccctaggcagcgatcatgtggtcggggccccgtttttcgaaaggggtccacctttgagtgagattcagaactcgtccatcttctcgctagatgatgtgtccgacgaggagatgaacaacctcatcgacggcaccatcaccaacttcgacgagggtgatcttgtgacgggcaccgtcgtcaagatcgagcatgatgaggttctgctggacatcggcttcaagtccgagggcgtcattccgtctcgcgagctgtccatccgcaaggacgtcaaccccgaggacgtcgtccacctgggcgacaccatcgaggccctcgttctccagaaggaggacaaggagggtcgcctgatcctctccaagaagcgcgccgagtacgagcgtgcgtggaaccgcgtggaggagaagttccagaacggcgagaacgtcgagggcgaggtcatcgaggtcgtcaagggcggccttatcctcgacatcggcctgcgcggcttcctgcccgcgtcgctcgtcgacctccgcagggtcaaggacctcaacgcctacctcggcacccgcatcgaggcccgcgtcatcgagatggaccgcaatcgcaacaacgtggtcctctcccgccgcgtcgtcctcgaggaggcccgcaaggccgagcgcacggagatcctctccaagctcaagcccggcatgcgcctcaagggcaccgtctcgtccatcgtggacttcggcgccttcgtggaccttggcggcatcgacggcctgatccacatctccgagctctcctggaaccacgtcaaccacccctccgaggtcgtcaaggtcggccaggaggtcgaggtccaggtgctcgacgtcgacctcaaccgcgagcgcatctcgctcggcctgaagcagaccaccgaggatccctggcgcaccctggtcaagaagtaccccgtgggcgccatcgtcgagggcaccgtcaccaagctcgtcaccttcggtgccttcgtggacctcggcgacggcgtcgagggcctggtccacatctccgagatggccaagcagcacgtcgaccagccgtcccaggtctgcaacgtgggcgacaaggtccaggtcaaggtcatggagatcgacctcgatcgtcgtcgcatctcgctgtccatgaaggctgccgccgagaccctgggtaccgaggtcgaggtcaagccgctggacaagcccgaggaggacgaggagaacgccgccgagtaggctgcgcctctacaatctgggttgtgagggagccgcccttgggcggctccctttttcgtacgtcgcgcccctcgtacgcccctgcccctcccctgcgtgccggggcagggttcgatgtacatgcccgcctttccgcaaactttggtttggggttgtataagccgcagctcgcggggcatatcaagaaaagcgatagctgggaatgcacaatcccattatctctggcgttaattgtcaccgtgctcgtcttgattaatcccaccgcgagggtatagtttcaccaaagattgcggaaggccacctaatcaagctcggtggcattcaccgtgcggagcgaccgctgcccttggccaacgctccgacacacgagaagaaggggcatcaccatgaagtcaatcgataacctcatcctgagcaggcgtcaggccatcacgcttgccggcggcagcatcgccaccgctggtctcctcagccttgccggctgcggctccacggacgacacgaccgcggcgtccaccagcccctcggactcctccgcggacagcgcctccagcgcctcgaccgacctcgacgcggatgcctacgaccagctcatcgccggcggcaagaccgctgacgacgccaccatccaggcgagcgagtgggccaagaaggtcaaggacgccggtgccctccgcgttggcggcacccgcacctccacgctgttcagcctcctcaacgagcaggacaacaagatccgcggcttcgacgcgggcctgtatcagctgctcacccgctacatcctgggcgacgagtccaagtacgagctcacccaggtcacgtctgacacccgcgagtcggtcctccagaacgaccaggtcgacgccgtcttcgccacgtactccatcaccgacgaccgcaagaaggtcatctccttcgccggcccgtacttcgttgcccagcaggcgattctcgtcctcaaggacaacaccgacatcaacagcgtggacgacctcgacggcaagacggttgccgtgcagtccggatccacgggccccagcatcgtcaagcagtacgcccccaaggccacccagcaggagttcagcaccgacgaggaggcgcgtcaggcgctcgagcagggtcgcgttgacgcctacgtcatcgacaacaccctgcagatgggctccgtcgtcaagaaccctggcaagtaccgcatcgccggcgacacctttggaccggacgacccctacggcatcggtctgcctctcaactccgatggcgtcgacttcgtgaacaacttcctcaaggagatcgaggacgacggcacctgggctcagctgtggaagatcgcgatcggtgaccgcaccggcctcgacaaggcgcccacgcctcctgcgatcggtgcctagcccgtctgtcggaaacattactttgttgtaaaacgaagtctgaggtctccgctgttgtacggcggagacctcatattaataatgtatgcaagacccggtgtcgccccatcgtcccgggccacccgtcgagggggagggagaggatgcatgggatttgctgagctttggaaggcctatggcagcgactacattgccgcgctcctcactacctggcagctcactgccgtctcgttcgttttcgtcatgatcctgtcggtgctcgtcaccgtcatgcgcgtgtgccccatcaagccgctcagggtcgtgggggacgtctacgtgcagatcttcaggaacatcccgggcgtctcgctgctcatcatctgcgtgtacgcgctgccgttcctcaaggtccttctcgactaccgcacctgcgtcatcgtgaccacgatcctgctcggctccgcatttgggtccgagaacttcatgagcggcatcaacaccatcggcgtcgggcagatcgaggccgcgcgctccctgggcctcaccttcacgcagatccttcgcaagatcgtgattccccaggcgcttcgctccgccgtgctgcccatgaccaacctgctgatcgccgtcatgctcacgacggccctgggctcccaggtgccgctgtcgccccccgagctcaccggcctggtgtcgatgatcaacacgcaggtcagcggcggcatcaccacgttcttcatctccgcccttggctatgcgctctcggccctggccataggctacgtcggcaacgcgattgacaagagggtgaggattcttcgatgagcgatgcaaccacctccatgcgcgacgcgctctacgaggcccccggcccaaagacccgccgccgcatccgcttctggacgttcatctccctgctcctcgtggcgtggggggtgtgggcgatcgtccggcgcttctacgtcaccgggcagctgtcgcccaagtactggctgttcttcacccgttggaccacctggcgcttcctgttgcagggccttgtgggcaccgtcgaggtcgccgtcacgtcgggcgtcatagcgctcctgctcggactcctgctcatgctggggaggatcagctccaaccgcgtgctgtccgccgtgtgccacgtgatcatcaacttcttccgcggcgttccgagcctgctgctgatctacttcttcttcctggtcattccgcagtacgggatcaagatgtcgtcgttctggatgatcgcgctgccggtcgccctcgcggcctcgggcgtcctcgccgaggtcttccgcgccggcatgtacgcggtgcccaagggacagaccgaggctgcgctctcgcttggcatgagccccatgcacgtcaagctcaagatcgtgttcccccaggcgctgcgcatggtcatcccatcgctcgtctcgcagctcgtggtcgtggtcaaggacaccacggtcgcctacgtcgtgagcttcccggacatgctccagaacgcacgcgtgctcatcagcaactacgacgcgctggtctcaacgtacttcgtcatcgcgatcatctacatcctcatcaactacggcatcaaccagctctcggtgtaccttgcgaggaggtcggggaccaggatcgtcgcgcgcacgtccgagaaccccatgtaggttcgctcagggtcaattgatcgtggcccacgcgccacggatgggagggacatggccaccaccatgcaggacgagggcaagcagatccccgtcatcgaactcagggacgtcgacaagcactacggcgacctccacgtgctcaaggacatcaacctcagggtcgacaagggagaggtcctcgtcatcatcgggccatccggctcgggcaagtccacgctctgccgcaccatcaaccgcctcgagaccatcgactcgggccagatcctcatcgagggcaagccgcttccccaggagggcaaggagctcgccgcgatgcgtgccgacctgggcatggtgttccagcagttcaacctcttcgcccacatgtccatcctggacaacgtcaccataggccccatcgacgtcctgggcgtgcccaaggagaaggcgcaggcagaggccatggagctcctcaggcgcgtgggcgtggcggagcaggcctccaaggtgcccgcccagctctccggcggccagcagcagcgcgtcgccatcgcgcggtccctcgccatgcaccccaaggcgatgctgttcgacgagcccacgagcgcgctcgatcccgagatgatcaacgaggtcctcgacgtgatggtcgagcttgcccgccaggggatgaccatgatcgtggtcacgcacgagatgagcttcgcccgccgcgtggcagaccgcgtcgtgttcatggcggacggccagatcgtggaggagggtaccccggacgagttcttcgaccatcccaagagcgagcgtgccaaggagttcctggagtcgataagcgggcactaggcagcgccggtgttctgtttccatgaaagcgccccgtggctgtccaaggccccggggcgctttcctagaatgcttggggtttgaggcgattgaaaagggggagttcgagtggctgaggctcatgtggacgaggtcgtttccagtagcaggggagaggggcacggccccatcatcggcgtcgcccctcgctgggaggtccaggagccgtcgctgaggatccccgagcaccttgcgccgagcgagtccatgatctcggtcttcgccgatgccatcatcgacgcgggcggcgtccccctgatgcttcccctcacccacgacgaggggctcatctcccacctcgtcgacatctgcgacggcttcgcgattcccggcggtccggatgttgacccgcgccgctttggcgacgagagcccctacgaccagtccctgctgtgccccgagcgcgacggcttcgagttccccctcgtcgagagggtcctccaggcggacaagcccctgttcaccacatgcagggggacgcagctgctcaacgttgtcctcggcggcacgctgtgcatggacgtccccggcctcaagccccgcgagggcatggccctgtggcgtcacgcgatggtgctcaccgatcccgcccaccccgtcgaggtgcgagaggggacgctcctgtcgagcatcgtgcggtcgccgctcatccaggtgaactccagccaccactgctgcgtgggcaagctgggggagggcgccgtcctctccggcgagtcgacggacggcgtgcccgagtgcatcgagctccccgacaagcggttcgtgctcggcgtgcagtggcaccccgagtacacgtggcgctcgctcgcaagcgaccgtgcgctctggcacgcgttcgtggaggccgcgaggtagtccctcgctggcgctcggatcgggtggtgggctttgtggggccattgcgggggcgcgggcatagccctggcgcgatgcgctaagctactgtactaccgtagtacctgggcgggtttgacccgtccgatggtttgaaggacaatcgcacgggagcctcgtcccgggaaagaggtcatggtggcaaagagcggctttggcggcaactcatccaacttcatgaacggtcgcaacggggttgaccagctctccatcctcgtggtgatcgtggcggcgatcctgctcgtcatcaatctgttcgcccgcacgctgccccttacgatcatcgtcctcctgctcgtcgcatacgcggtgttcaggatcctctcgcccgacgtggcgtctcgtcgcagggagaacgaccaggtaatgtccaagctcggccctgtgagcggctggatctccaaccccgctgccgccgcccgtgaggggcgcgagttcaagcatgccacctgccccaactgccaccagcgcgtgcgcgtcccgcgtggaaagggtcacatcagggtcacctgcccgcgctgccaccagaagtttgaccttcgctcctagacccacttccaatgatcacgggggcgcggctggcttctggcctgccgcgccccctgcttcttccgcgtaccctatcgccagacgggcgtgaggcgccacttctcaagggggagagatgtacgttgcgttcgtggccggtggcatcgcctccggcaagtcaagctttgcccgccgcctccaggcaagaggggcgcggaggatagacctcgaccagctctctcgcgaggtcctggcaccagggtcagactgtctcaaggcggtcgcacgcgagtttggtggcgacctcctggaccccgtcaccggcgagctggaccgggcgctcctcgcccagagggcgtttgccacggcaggggacacggcgcgtctcgaggcgattgagcttccccacatcgggcttgcgctcatgaggaggctgtcgagcctgagcaggctctccgacgcaccctcctgcgtcgtggtcgaggtcccgctcctcgatcggtttcagtcgtacgtccacctcgcggacgaggtcgtcgccatcgcctgcccactgggggagcgccgtcgccgcgccatcggtcgcggcatggacggcgcggacttcgatgcacgtgcggcacgccagccgagtgacgagtacctggggtctcactgcgacacgctcgtcgacaaccggggtggcgccgacgagctgatggcacgtgccgacgcctggtgggaatcccaccaggccaatggctggcggcctgccaggaaggcggagtgagcatgggagacacgcgctttctcaggtggtaccggaccatccccatcaccctcatggccatcgtgtgcgtcctcacatttggcttctcgctggtgcccgacaacctcgtgaggtccatcttctacccggtgaagtatgcggacatcatccaggaagcgtcggaccgctacggcgtggacccctacctggtgtgcgcggtcatcaagtgcgagtcaaactggaaccccaccgtgcagtctgacgcgggggcgcaggggctgatgcagctgatgcctgcgacctcgcaggagcttgcgaccctgggttccgtggactcgtccacctacgatcccacggcgctcacagaccccacgaccaacatcgagtatggaacggcgtacctggcctacctgcaggcaaaccttaactccaccgacgaggtgatagcggcgtacaacgccgggcttggctccgtgagcagctggcagagctcgggcggcgacatctccaacaacatcacgtatgccgagacggccgcctacctcgtgcgggtgaaggatgcctacgccaagtaccaggagctctatcccaacggcatcaccgactccaactagccgctgcatgtgcggggcagctcaaatccgcacgggtgccagggaaagcactggtggcatcgcctccatggctgtggaaggctcctctcccatagggtacacttgttctgttggagagaagagggaggcttgccatgacacaggcgggagagggtcgctcgttcgtggcggaggacggcagcacggtgcgctacgagccgcttgccggcacgccggaggccaaggagcgctttggcgccgagctccgacgctttggcctgacgcatggcggggagcgccttgaggtcgtctcgccctaccagccggcgggagaccagccacaggcaatcgcaaagctcgcggatggggtcgagcgcggcctgcgctaccagacgctgctgggcgtcacgggaagcggcaagacattctccatggcaaagaccatagaggcggtgcagcgccccaccctgatcatggagcccaacaagaccctcgccgcacaggttgcgagcgagatgcgcgagctgtttcccaacaacgccgtggtctactttgtctcgtactacgactactaccagcccgaggcctatgtcccgcagacggacacctacatagagaaggacgcctcgatcaacgaggaggtggagaagctccgccaccaggcaacctcgagcctcctcagccggcgtgacgtgatcgtggtcgcgtcggtcagctgcatctacggcattggcagcccgcaggactacgcgggccttgcgcccaatgtggacaaggaggtcccgctcgagcgcgacgacctcattcgcgagctcatcgacatccagtatgaccgcaacgactacgacctgtcgcgcggcaccttccgcgtgcgcggcgacaccgtagacgtgtttccgccctatgccgagaacccgctgcgcgtgagcttctttggcgacgaggtggaccagatcgcagagatcgacaacgtgacgggcgaggtcgtgcgagagtacgacgccatccccatctggcccgcgtcgcactacgtcaccgagcggcccaaggtcacgcacgccatcaagacgatcgaggacgagcttgagcaccgcgtggcggagctcaaggcaaacgacatgcttctggaggcccagcgcctctcccagcgcaccaactacgaccttgagatgcttgagaccatgggctactgctcgggcatcgagaactactcccggcacctggacgggcgcaagcccggcgagccgccctacacgctcatcgactacttccccagcgacatgctctgcatcatcgacgagagccacgtgaccgtgccgcagatccgcggcatgtacgagggcgaccgagcccgaaagatcacgctcgtggaccacggctttcgcctgccctccgcgctggacaaccgtcccctgcgctttgacgagtttgagcagcgcatcccgcagttcatctatgtgtccgcgacgccgggagactacgaggagggtgtcacgcagcaggaggtggagcaggtcatccgtcccaccgggctgctcgaccccaaggtggaggtccgtcccgtccgcgggcagatagacgaccttcttgacgagataaaggcacgcacggcaaggggggagcgcgtgctggtgaccacgctcaccaagcgcatggcagaggacttgaccgaccacctgctggacgagggcatccgcgtcaactacatgcacagcgacacggcgacgctcgatcgcgtcgacatcatccggagcctgcgcctgggcaagatcgacgtgctggtgggaatcaacctcctgcgcgagggtctcgacatccccgaggtctcgctcgtggcgatcctcgatgccgacaaggagggcttcctccgcaaccgccgctccctcatccagaccatgggacgcgcggcgcgaaacgcgcatggcgaggtcatcatgtacgcggacacgatcaccgactccatgcgagaggccatggacgagacggcacggcgtcgcagcatccagatggcctacaacgacgagcacggcatcgtcccacagacggtcaagaagtcgatcaccgacgtcacgagcttcatcgaggaggcgagcaagaccctcgacaccaagtcgcgcgtcaacggggagttcttcaccgcgagcggagcggagggtgacgccggtgaatccgaggcggagcgcgaggcgaccattgatgccgttgcggacgagctctcggcgctccccaaggaggaggtctccaaggtgctcggctcgctcgaggacgagatgatccaggcgtcggcggacatggacttcgagcgcgccgcccggctacgcgaccaggtggttgcccttcgcgccaggttggagggggagtcggagcaggacgtgatcgcccgtctcaaggccaccgaccgcaagggatccgcgcatgccacgcgtcggaagtaccgtccgcgcaagcactgacggcggtccagccatgtgcagccaacggggggtgcgtcccgcgggggacgcgccttccatcgcgtttcgacaggcatgtctcgcgtgcatgcgaacatgttcattagactcctgtttccgattgcccaaacgggcgaattctgcgtagacttagtgcagttgtgagtcagttgagaggggatgcacatgcccaaggtcgttgtcgcatgcgggtcgggtgtcgccacctcgcaggtcgtggcagacaaggtcaggaagatgctggcagcccgtggcgtcgacgcggatgtcgtcgcggttgaggtcgcggacctgcccaaggcgctcgaggacgcggacgcgtacgtctcggtcgtgaagtccgagggcgaggactacgacgtgcccgtgttcaacggggtcgccttcctcaccggcatgaacgtggagtccgagctctccaggctgatcctggcactgggcaagtagaagtttccgcgggtctttcgcccattgggcgttcctttgtgcgggaacgttcccacgccagtctgaaagacgcaaggggcgccgccgtccgtgatgggcggtggcgcctcgcttgtgcgcatttgtacggtgccagggctgctacttgagggatgcgaccagggcctcggcaacgcgaaggccgtcggtcgcggcgctcatgatgccaccggcatagcccgcaccctcgccgcacggccagaggcctgcgcacgagacggactgcagctccttgccgcgcgtgacgcgcacgggggagctggagcgggtctcgacccccgtgagcaccgcgtcttccgttgcaaagccgtgcaggtagcggtccatgaccgggatggcctcgcgaagggtctgcgcgatgtagtcgggaagacacgtcgcgacgtcgccccaggcgaccccgcgcgggtaggtgggcaacacatcgccgcccgcagtggaggggacacccctcaggaagtcgcctaccaactgcgcgggagcgacgtagccgccgccaccggcctcgaacgccgcacgctcgcatgagcgttggagctccacgccagcgagcacgtcgtcgccgggaaggtcctccgggaacacgttggcaaggaaccccgcgttggcgttctgcccgtcgcgcgcggagaggctcatgccgttggtaaccacgccgcccggctcgctggcggcggcgaccacgtagccgcccggacacatgcagaaggagaacgcgctcctgccggaggggaggtgcgccacgagcttgtacgaggcggggtcgagggcgggatggccagcgacggggccgtactgcgagcggtccaccatcgactgcaggtgctcgatgcgcacgcccatggcgaaggtcttgcgctcgaggcggatgcccgtctcaaccagcatggagaagacgtcgcgcgcggagtggccgcaggcgagcaccacgttgtccgccgggacgtgctcctccaccacgatcccggtctgggggtcgcggcgctcgagcgtgaccccgctcacgctgccttccgatgtggagatgcccgtgagccgggtgccaaagcgcacctctcctcccaggacgccaatgcgcccgcagatgttggtcacgaccgtgggaaggacgtcgctgcccacgtgcggcttggcgtcccacatgatcttggggtctgcccccgcgtccacgaaggtcttgaggatgaggcggtgtgcgggactctttgtgcccgtcccgagcttgccgtccgagaaggtcccggcgccgccgagcccaaactgtatgttgctctcggggtcgagctcgccggtctcctcaaagcggtcgatcttctcgcaccgccgctcggcgtcctcgccgcgctccacgagcagcggctcaagccccgcctcggcgagtgcgagcgcgcaaaagagcccggcacagcccgcgccaacgaccacggggcgctttgccggcatggtacccaggtgcgcggggaagcggtaggcggtctcgttgtgctcgcgcacgccgcgcagctcgtgatgcctcctcaggcggtggagcagctcgcgctccgcctccgcgccgccgcagagcgtaacgaggagggtgtagttgtagcggacgtccgacttcttgcgggcgtcgagggagcgcttcctgagctcgatctggtcgatgtcgctaagggggaggtgcagctttcggaggaccgccttctggattgcctcctcctcggtggggaaggtgccgtccaggcggtccagggggatgcgaatgccggtgagctcgagcatgctagcgtgtcctctccgcggcgtttgagccggcaaccagtccgctcttccaggcccaagagagattgtatcccccacagtccccatccacgtcgagcgcctcgccacaggcgaagagaccacgcatcccccgtacccccatggtgcggggatcaacctgcgaggttgcgattccgcccctggtgacctgggcgggtccgtcctggtgcacccccgtcacgcgtaggggcagcccgctcaccaggcgcacgagggcctcggagtcggagcggggagggtcctctcttccggggagctcgaagccggcgtcccagcgctcgcgcgcgaggcgttcgaggagacgtgcgatcacggggtccaggatcccgtcaaggcagccctcctcgaaggtgccgtgggcgaaggggtccacgagcccctgcagctcggagcgtgccacgtcgggggcgaggtcgatcgtcacggcgtcgcccggctggacgcggcgggagaggtcgaagaccacgatgcccgagaggccgtagtcgcggaagaggacctcgcccctctccctccagcaggggaagtgcccgtggacgagcgagaccgcggcctggtccctcctgccgtcgaggccgagcacgggggagtcctcgcagtcgacgggacagagcgcccgggacgtgggggtgacctccagtcccaggtggcgggggaggtccagggcgtcgccacccatcgccaggacgacgcggcgggcgaggagcccggagacggcctcctcgccctctgtggagagggcgagggagaacccgtcggggccgggctcgagcgagacgaccgtgcgtgcgggggcgagggtgacgcccgccttgcgcgtgcggcgaagcagcacgctgcgcaccgacgacgcctggcgcgagacggggtacaggcgcgggccctcgagggaccaccgcagcccggactcgcggaagaacgcgaggatgtcgtccaggggggtctcgccgagggcggcggagacgaacgcggggtcgttgtagcggtccgcgcccagctcgacggtcgagaagttgcagcggccgttgcccgttgcgaggatggtgcgaccgcactccaggtcgcgctcgagcacgacgacacgtgcgtcagcctcggcagcggcgatggcggcacagaggcccgacgcgcctcccccgacgacggcgacgtcacaggacgtgggcagctcgatggagcgggcccgccgaagctggccctcgcggaccgccgcccgggaggggccgcgtccagccctgcgctgcgtcatcggccgtccgcctcgtcgtgcgcgaggatctggtcaattgtcttggcgaccaggccctggggcatcttctgctcaaagtcgccctcgtcgcagctggcggcgatggcagggtcaatggggagctggtcaagcgccatgatgccaaagtggtcggcggtctcctggagtcggctgggaccaaagggctcgatcctctcgccacagtgcgggcaggtgaggtagcccatgttctcgaccaggccgaccacggggacctccatcatggcggccatgttgagcgccttgcccacgaccatctggaccaggtcctggggggagctcacgatgaccacgccctcgacggggagcgactggaacaccgtgagggcgacgtcgcccgttcccgggggcatgtccacgagcaggtagtcgagctcgccccagtccgtgtcgccaaagaactgcttgagtgcgcccatgagcatggggccgcgccacagcacggggtcggtctcgctctgcagcacgaggttggtgctcatgacctcgatgccgcccttggacaccgcggggaggatcttctcgtcgcgtgccatggcgtggaccccggacatcccgaacatcttggggatggaggggccggtgatgtcggcgtcgaggatgccaacgcgcttgcccgcgcgcctgagactggttgccaccgcgccggtgaccagcgacttgccgacgccgcccttgcccgagatgacgccgatcacgtgctttgcggaggagccctccgccatctggaactgctccggaccctggtgctggggggcgctcccatgccccagcgcctggtcgacctcgcggcggagctggtccctgtccagttcgtctgccatgaaggcactcctttttctgcttgccaagcttgcggatgtctgaccagacgattctaccccgcggcatggccatcatgcgccttctgtgagtcgtctacggcggctatacactggtaggctgaccaaaacgatttgtcccgtgcccaggccgtcacggctgggcaaagtagcataggggtctctcacatggcatcagactcgatcgtcatccgtggcgcgcgcgagcacaacctccgcaacgtggacgtcaccataccccgcgacaagctcgtggtgatcacgggcctctcgggctcgggcaagtcgagcctggcgttcgacactatctacgcggaggggcagcgccgctacgttgagtccctctcgagctacgcccgcatgttcctgggacagatggacaagcccgacctcgactccatcgatggcctgtcgcccgcggtctcgatcgaccagaagaccacgagccgcaacccccgctccacggtgggcaccgtcaccgagatctacgactacctgcgcctgctctacgcgcgcataggcaccccgcactgccccgagtgcgggcgcgtcatcgagcggcagaccaccgaccaggtggccgacaaggtccttgccgcgggagaggggaggcgcgccctcgtgctggcgcccgtggtgctgggcaggaagggcgagtacaccaagctcttcgaggacctgcgcaaggagggcttctcgcgcgtccgcgtggacggcgaggtccgcgacctggacgaggacatcaggctcgacaagaagtacaagcactcgatcgaggtcgtcgtggaccgcgtggtcatacgcgagtcctcgctgggccgcgtcgccgaggcggtcgagactgccaccaggctggcctcgggcaaggtggggttctacctcctgccgccgcgcgacgcccccgaggggacggagggcgagcttctccaatactccctcgccctggcctgccccgagcacggccactccatcgacgacctgcagccccgcgacttctcgttcaacgccccctacggcgcctgccccgactgcgacggcctgggcgtgaggcgcgtggtcgacgcggaggccctgatcgacgacccgtcgctgccgcccgcgagcggcgccttcggcggcatcttcggccactcaaactactacccgcagatcatcgcggctgtggtgcgccacatgggcgaggaccccgcgaccccgtgggagaggctcaagcccaagacgcgcaaggcccttctcgacggcctgggtgacgccaaggtcgccgtggagtatcacacgcgcgacgggcgcgacaccaactggaccaccaagttctcgggcgtgcgctccatcctgtttgacaagtaccaggagacgacctccgagaccatgcgcaagcacctggagcgctacatcagcgaggtgccgtgccccacgtgccacggcaggaggctcaagcccgagtacctggccgtcaccgtgggcgacaagaacatcatggaggtctgcgacctcagctgtcggcaggcactggagttcttcaagggcctgcagctcaccgagaggcagtgcctcatcggcgcgcccatagtgaaggaggtcatcgcccgtctgcagttcatggtcaacgtgggcctggactacctcacgctcagccgcgccgccaccacgctctcgggcggagaggcgcagcgcatcaggctcgcgacccagataggcgccggcctcatgggcgtcctctacatcctagacgagccctccatcggactccaccagcgcgacaacgaccgcctcatcgcaacgctcaagcgcctgcgcgacatgggtaacaccgtgatcgtggtcgagcacgacgaggacaccatccgcgccgccgactacgtggtggacatgggcccgggggcgggcgagatgggcggcaccgtggtcgcctgcggcaccccgcgacagatcatggagaacccggactccctcacgggcgcctacctcacgggacggcgcatgatcgcgctgcccgagagccgccgcaagcccgggcgcggctgcctcaaggtggttggcgcacgggccaacaacctcaggaacgtcaccgtcaagatcgagctggggaccctcaccgtggtcacgggcgtctcgggctcgggcaagtcgtccctggtcaccgacaccatcgccccggcgctcaccaacgccgtgcagcactccaagcgcatcgtggggccctaccgccgcatcgagggcgtgttcgacgaggacggccgcaagatcatagacaaggtcatcgacatcgaccagagccccatcggccgcacgccgcgctccaaccccgcgacctacatcggcctgtgggacgacctccgcgcgctgtttgcctcgacgcccgagagccgcgcccgcggctacagcgccgggcgcttctcattcaacgtgccgggcgggcgctgcgaggcgtgcaagggcgacggccagatcaagatcgagatgaacttcctgcccgacgtgtacgtgccctgcgaggtgtgccacggccagcgctacaaccgcgagacgctggaggtcacctaccacggcaagaacatcagccaggtgctggacatgaccgtgaccgaggcgctcgcgttcttcgcgaacatcccgcgcatcaagaacaagcttcagaccctctacgacgtgggcctgggttacgtgcacttgggacagcccgccaccacgctctctggcggcgaggcgcagcgcgtgaagctggccaaggagctgcaccgccagcagacgggcaagaccttctacatcctggacgagcccaccacgggcctgcactttgaggacgtgcgccagctggtggacgtgctcgagaagctcgtggacgccggcaacaccgtgctggtgatcgagcacaacctcgacgtgatcaagatggccgaccgcatcatcgacatgggccccgagggcggcgagggcggcggcacggtcgtcgcctacggcacgcccgagcaggtggcaaaggtgagcgagtcgtacacgggcaggtacctggcgcccatcctcgagcgcgaccgggcgcgcatggcggaggagaggtagatggccaggcgggacaaggtccagaagaccaacgccatgcgcgagctggagcgcgggggcgtctcgtacgagtggcgcgagatggaggaggacgacctctcgcgcggcctggggctgcggatggccgaggaggcgggcgaggacccggactcctcgttcaagacgctggtgaccgtggcgccgtcgggcgaccacgtggtgtgctgcatccccgtggcacaggagctcgacttcaagaaggccgccgcggccgcaggggagaagagcctctccctcatccccgtgaaggagcttgagggcctcacgggctacgtgcgcggcggctgcacgcccgtgggaatgaagaaggcgtttcccacgctgatcgacgagaccgcccagctgttcgacaccatcatcatctcgggcgggcggcgtggcctctcgctcacgctcgaccccgtcgcgctccgcgacttcctcggcgccgccttcgctgacatcacccgatagaggaggaagccttgtcttcggcacccaagcacctcgccgcgggggacggatcgaccccgcgccccaacatggatcccagccagcgcggaaggcgcctctcgcccgacgagaccatgctctacgtgcaccttgcccaggagagcagggagggggcggctcccgtctcgtccggcacttcgcgcgaggtgtcgggcgggtccgtcagggccggacagggcgacccgtggctggcagacgactcgctcgccaacatggagccgatcgcggtcggggaggatgcagctgccggcgcggggacgtcccgggccgagggtggcgcgcccctctcccttgcagacgaggtcgcggacgacgcccaggccgagccctccgaggaggagaaggccgcccaggtgggccgcaacaccgccctcatgagcgtgctggtgatcatcagtcgcctgaccggcttcttccgcacctggggacaggcgtacgcgctgggcgtcacggtcaccgcgagctgctactcggtggcgaacaacctgcccaaccagctctacgagctggtggtgggcggcatgctggtgaccgccttcctgcccgtgtacctctcggtgaagaagaggctcggcaccaagggggcgagcgagtacacctccaacctcatctcgctcgtggtcctcatcatgggcgcggtcgcgattctgggctttgccttcgccgcccaggtggtgtggacgcagtcgttctcggcgagctcggacttcgactccaaccttgccacgtacttcttccggttcttcgtgatcgaggtcgtgctgtactcgctcgactcgatcttctcgggcgtgctcaacgccgagcgcgactacttctggagcagcgccgcgcccatcttcaacaactttgtgaccacggcgtcgttcttcgcgtacgcgtttctggtgcccagcaaccccaggctcgcgctcctcgtgctggcgatcggcaacccgctcggcgtcgccattcaggcgggcatgcagattccctcgctccgcaagcatggggtccacatccgctggcacgtggacgtgcacgacccggcgatcaaggagaccctctccatcggcatcccgtcgctcgtggtcatggtctgctcgttcgtgacggtctcggtcatgaccagctcggcgctctcggtcacagccgcgggcgcctcggtctcctactatgcgcgcctgtggtacacgctgccctacgccatcctcgcggtgcccatcaccaccgccatgttcacggagctctccgacgacgtcgcgcgtggtgacatggagtcctaccgccacggcgtgtcggcgggcaccagccagatcatcttcctcatgattccattcatgatgtacctcatcgcgttctcgcgcccgctcatcacgctgcttgccgcaggcaagttcacgggcgaccagattggcctcacggcgacgtacctcgcgaccctctcggtgtcgctgccggtgtacggcgtgtgcatgtacctgcagaaggtgtgctcgtccctcaggaagatgggcgtgtacgccgtggccaacgtggtcgccgcaggcgtgcaggtggtggtgtgcatgactctcacgcagaggaccgggctgtggatggtggcgttctcctcgttcctgtactttgccgcggtcgacgtggtgaccttcgcgatgctgcgcggggagctcggtcatgtggggcttcgcagcatcatcggcgctggggtgcgctcgaccgtctacgggctcgcgggcaccgccgtcggcatgctaatcgtgggcctgacgccgctgggcgattacgcggtgaccaactcggtcggccgcgccctgatctacatcgtggtgggcggggtgcccgcggtcgccgtcacctttggccttgcgctcgccaccaaggcgcccgagatgggcgtcgttcgtcgcctccttaaccgggtgttccaccgcgggtagggggtcgccctaaccggacggggcatgtggtcggtcccaggctcgtgcatgggtgcgaacggcaggtattcgtgtccctacggcgtccgccaggtccccaacgggtgcgcggaagacgacctgctgaggaaagcagagttttggcaatccgcaggcctgagctgctgaggaaagccgagtattggcagtcgaaagggtgcttgggctgccaaacctcgcgattcctgagcttccgacaggaccggactgccaatactcggctttcctcagcagggaaccgtcgcctgggtgccctcggtggccccgtcgattgccacaactcaagattccttagcaggcccgcggcagggagcgaggccgaggacgccaaaagctgcgggtggggttgcgatccggcggcggacccccctggcgaagcgcttgccgcgcgccgcctcccgtcacaacgccctacagcagcgaaagcagcacgtacgccacgactccagccatgcagcaccagagcatcgacttggtgcgccacgccaccagcaccacgacgcctcctgcgacgagcggcatcaggccagaccacaggcctgccgagaacatcccgggcgagaggaggtcgttggcgacgagcgcggcaaacgccgcgggcgggatgtagcccagcgcgtcgacgacccggggcgagaggggcctccccctcagggccacgaccggtgccacgcggcagaacaggatgaagccgaacgaggcgagccagaggatcaggaagtcgttggtgcccataggtgccgtcatgcgcgcgacctcccgttccccctcgtgggaagcgcctgcgacgccatccccgcgacgactcccacgacggcggcgacggggaccgcgaccccggcgaggcccgaccacttgcaggcgaccaccgccgcaaccgccccgactacggcgcaggcgttcccgcaggagtggggctgggaccagagcaggtagatgaacagcgaggtcatggcaaagcccgcgatcgcggtgggcacgtccacgatgccgccgagagcggctcctgcggcgcacgagagcgcccaggtaagctgcaccgtcacgttgagcgcgagggcccggcgcgcgtcccagtcgccgccggaggcgagctttcccagcgtgatgccgtacgcctcctccgtgtagcagcaggagatggcaagggcgtccctgcgatggaaccgggtgaggtagggggagagcgacgccgagtacagcgcaaagcgcgtggatatcgcggcgaccgaggcgacgatcgaggggaggggagtccccgccagccacaggttgctcatcatgaactggccgccgcccgtgaggaaggtgagcgagaggacgaagttcatcagcggatccatgcccgccttggcggcgagcaccccgcagggaaggccgaccgcgacgtacgacagcatgaccggccaggcgaccgccagcacgtcgcgcatgaccgcgcgtctctcttccgccacgctcgctcccctcggttaaagacggcccgccccgcgtcgccggacgatcccggtgagcggggcgggcctatgtcggtggaaagcatggtacaccatgggtggtggctgacgtggtttggcacgcagcccatgccgcccgcatcggtgccgtctcgcggcctcctagcgcagcgcgcgggtcgcgttgagcacgcagagcaccatgacccccacgtctccaaacaccgcgagccacatgggggccagccccagcaccgccaggatcaggatcgcgatcttcacggcgatggcgaacacgatgttctggcgggcaatcccaagcgtgtgccgggcgatgcggatggcgaccgcgatcttggagggcttgtcgtccatcagcaccacgtcggcggcctcgatcgccgcgtccgaccccatggcgcccatggcgatgcccacgtcggcgcgcgcgagcacgggcgcgtcgtttatgccgtctcccacaaaggcgaggcgtgcgccctcgggctcggtcgagaggagcctctccacgttctcgaccttgtccgccggcagcagctcggcgtgatactcgtccaaccccagcttgcccgcgacccgctccgccacgtcctcgcggtcgccggtgagcatcacggtcctgcggacgccctcgcgcttgatggcggcgattgcctccgcggcgtcgtccttcacctcgtcggagatcagcacgtgtccggcgtacgttccgtcgatcgccacgtggatgatggtcccggtgtcgctgctgcacgtggtccacttggcgcccacggcgtccatcaggcgagagttgcccacggccacgctccgcccgttgaccttggcgacgatgccctcgcccgcgtgctcgacggcatcggtgacctcgcaggagtcgttctcgttggggtaggcgtcgcgcagcgccgcggcgatggggtgtgtggagttgcgctccacgtgggctgcgaggtgcagcagctcgtccggccccaccagcgaggggtgcacggcgctcaccgcgaacacgcccctggtgagggtgccggtcttgtcgaagacgatggtgtcggtctgcgccagcgcctccaggtacgacgagcccttcaccaggattcccttgcgcgacgctccgccgatcccgccaaagaaggtgaggggcaccgagagcaccagcgcgcaggggcagctcaccaccaggaaggtcagggcgcggagcagccacgtggcgaagttcgccccaaagtcgcccgagacgagcggggggagaaccgccacggcgatggccaggtacaccacgatgggggtgtacaccctcgcgaagcggcggatgaagttctccgacttggacttgcccttgctcgcgtcctgcaccaggtccaggatcttgctcgcggtggactcgccaaagctcttcgtcacgcgtgcgcgcagcacgccggagacgttgacgcagccggagaccacctgcgagcccacggtgacgtcacgcggcgcgctctcgccggtcagggcgacggtgttcagactcgagctgccctcgacgaccaccgcgtccatggggaccttctccccggggcggatcacgatcgtctctcccacctcgaccgtcgacgggtcgacggtctgcaccaagccgtcgcgctccacgttggcggtgtcggggcggatgtccatgagctccgagatggactttcggctgttgcgctgcgccatgccctcaaagagctcgcccacctggaagaacagcatcacgaagacggcttcggcaaactcgggctcgccgccggggacgaacgcgatgagcagcgcgcccagggttgccacggacataaggaagtcctcgtcaaagggatggcccgaaaggaggttctcgcccgcctcgcgcagcacgccgccccccgcgacgaggtaggaggggaggaagaggagcagctgcgccaccagcggaagctgggtcacatgctggatgaccatggcgacgacgagcagaatcgccgaggcgatgatccggctcagcgtctcgcgcgggtcgtcgtcatcgtcgtcatccccgtcgcactggcagctgtcgccacagcagttgccgcaggagcattcgccctcgccctcggcggcttcgtcgtggcagtggcagacgtgctcgcgctcgtcctcgtcgtcgtggtggcagcagctgcatgccatggtgacctcctaatattgaacacatgaacaaacactcataattactggtccataagctatcaggggaaaggtggggtgtcaagtacagagcgaactttggctgaccaatcttctggggaagcgagtgcggaaaggggagagaagagccacctccttggccccagccaaccgcgccggcatcagcgttgtcgctctggccagcgtcgttgcgtctcccggattctggggtctgccgtttcgtggagcctcggcaccgttgacctgggctgccgttggggcacctgggtcatcgcaagccgtgcggtcactcgaagtcaaggaaggggagagggggctggggagcgagctcaggttctgccaggttaacccggttcccgtcgctggcatccgccgagcgtgcaggcgtgcggcagccgcgggcctggttcagcgtcagaagttgcgtcccgcatgggcacacgggacgtagtttccgacaaggcttgagacctggtgggccactaggttcgcgtcgctgggtcgccttccctgtgtgctacctggggaaggtgtgcatcctcgcgtcccaatcccctcggctcacttggcacatgacatcaaggctcgaagcatggcgacgagagcccgatatgagcactccttacggggatttcgctcggccgttggcctttgccccacgttgtcgcagataaaaaggatgggaaaggctccgtctcccaactgctggcagggaactcccgaagtgagcactcacaacgggagccccttgccagtcgaccatcttcaggcggcttggatggcagccgcggcctgatatgagcactcacatcgggagatacttgccatggttggaagccgggatgccggacaactgggggaacgagaccctaagttgtcctccatggcagcgaaagaccgatgtgggcactcacatcgggaggttccagccagatgctcggcatgccacctccgttgagtccttttatcttgacttgaatgtttgcgtactcgttgttctcgtgtcgaggctggacgaggattcttggaagaaacgcaggagcggccagcctgcaacgggtgtctggagtcatcttggctgttgcgccgtcggaccccctccgtcgcttcgaggcccttccgcacgcactgatggcggaatcagggttcgaggtctgacgttccctcaactgggaaaatgctgggctaccgcctgtggctgccgtccgagggtgcttccgcgttcccttctcagagttctcctgtagcgcggctgacatgcgagacgagcgtcgctccagacccctagtgcccccgtggctctcctccatgagttcttccgatgaccgtacctgtggcggtgagctgggagctttcgtgggcaaggcgtgatgatcgccccccctccggccagggggcaggccccattcccgccaccccgcaagatgcgcccaatgtggcgatgacatttcgagcgcgttacctcagcgccagcctttcgctccaggcactttatcgcgctaaagtgtagtcgtcacgagacgggcgagacgccgcacgggaaggccggcgtcccgcaaccgggccgcaagggcccgccagacgaggggagcaagcgtgctgtcaggaacgcccagcggattcagggacatcctcccgaccgaggcgctcgcccgcgagcgcatcagccgaacggtcaccgagggcttcgcgtcgcatgggtacctcccggtggagacgcccctcctggaggaccgtgcggtcatcgagcggggcggtcgcatccaggacagcccgttccagctctttgacacggacgggagcctgctcgtcctgcgtcccgacctcacgctccccatcgcgcgcctggtggcggcacgcgttcccgacgcccagctgcccgcccggctgcgctacgcggcgcccatcgtgcgcgaggagtccgtcctcggcggccagccccgacagttcacgcagctgggcgtagagcgctttggcggcgacggcatggagggcgaggtcgaggtcgtgacgctgcttggcgaggccctgcgcgccctcgacgtgcccgcctggcgcatcgtgtgcggctccgtctcgcccctcaaggcgctgctcgactcgtgcgccccgagcgacgagttccgcgagaccgtccagcgcctggtgcacgagtccgacctggtctcgctcgacgagttcgttgccgcctcggacgtggaccccgcggcggcccgcgcgatctgcgcaatcccgcgcctggcaggcgacgcgtcggtcatcgacgagctcgaccgactcctcgacgcggcgggcgttgcggcggagaggcgcgggaccgccgagctccggtccttcgtccgcgggctgggcgacctcgtggctgaggaccacgtgtccttcgacttcagcgtcatcaactccttcgactactacaccggcctcatcttccgcgcctactgcgagagctcgtccggggccctcgccatgggcgggcgctacgacgcggttctcgccaacttcggtcgtcccggcgtcgcatcctgcggcttcgcgcttctcctcgagcgcctccaggaggtcctgggcgagcagggcgagagcggcgtggtctccggcgtcgcgccccgtggccagcggccgctcagggtcgccgtgcccaagggctccctcttcgagggctccgtccgtctcctcgagcaggcgggcatgccggtggacgagctgcgcgagccgggacgccgcctgatcatcccggcgggcgacgtggagtacgtgatcgtgcgcgcccaggacgccccgagcttcgtgggccacggcggcgcggactgcggcatctgcggcaacgactcggtcatcgaggcgggcatcgacctgctgcagctcgttgacctcggctttggccgctgccgcttcgtggtggcggagcccaggagccgtgcgggcgaggcggagcgcgcctaccagtggcgcggcaccgtgcgcgtggccaccaagtacccgcgcatcacgcgcaggtactacgacgccatcgggcagcacgccgacatcgtgcagctgcacggcaacatcgagctcgggcccatcgtgggcatgaccgaccgcatcgtggacatcaccgcaacgggcaccacgctgcgcgagaacgacctggtggtcgtggacgacgtaatggaatgcaccgcccgcttcttcgcgagccctgccgcgtaccgtaccgacgtgcgcgtgcgcgacctggccgcgaggctcgggcggatctgccagagtgaagggaaccagcaatgagaacggtggagcttaggggagaggagcgtctctccaagaaggacctcgcccgcacgggcgcactgccccgcgaggtcatggacagcgcgcaggcgatcgtggacgacgtccgcgagcgcggcgacgtcgcggtgcgtgagtactgccagcgctttgacggcgcctgccccagcgagttccgcgtgccggacgaggtggtgaggggtgccctcgacatggtcgaccccgagttcctctcgtcgctccgcaaggcgtacgaccagatccgcgacttccacgagcgcgagcgagagcagtcgtggttcacgaccaagcccgacggcaccatcctgggcgtcaaggtgaccccggtcccgtccgtcgccgtgtacgtgcccggcggccgcgcccagtacccctccaccgtgctcatggacacgatcccggccaaggtcgccggcgtgccccgcgtggtcatggtgaccccgccccagcgcgacggctcgctctcggcctacaccctcgccgccgcggcggtcgctggcgtggacgaggtctacgccgtcggtggcgcccaggccataggcgccgtggcgtacggcacccagagcatccccgccgtctccaaggtggttggccccggcaacgcctacgtcgccgcggccaagcgctacgtctcgggcgacgtggggatcgacatggtcgcaggtccctccgaggtgtgcgtgctcgcggacgcaacggccgaccccgccatcgtcgccgcggacctcatggctcaggcggagcacgaccccatggccgcctgctacctggtcacggacgaccccacgctcccgggccgcgtgttccccgccatcgaggccctggtctcgcagagcccgcgcgaggagatcacccgcgcctcgctcgacggcaaggggctctgcgtggcgtgcgactccctcgacgccgccatcgacgccgtcaacctcattgccccggagcacctggagctccactgcgccgacgccttctcccttctcggcaggatccagaacgccggcgcgatattcgtggggccctggagctccgagcccctgggtgactacgttgctggccccaaccacacgcttcccacgggcggcaccgcgctcttctccaacccgctcggcgtgtacgacttccagaagcgctcgtcggtcatcggctacacccccgaggggctgctcgccgacgccccggcggtccaggcgctcgcgcaggcggagggcctgtgggcccacgcgctctcggtgggcatgcgccgcaagctcctggcggagggcggcgacaatttcgccgatgtaacggaagcctgcgcggatgccatgcagacggcgtggccgcgtaagcttgaggagcccggcaggcccgtcctctccgggtacgagtcgcgctgacgcgggggaggtcatcctttggcacagcagatttcccaggcggtgcgggcggtcatgaggccgtctgcggcgagcctggagccctatgacccgtccttctcgccctgcagggtcaacctgtcggcgaacgagaacacctacggcatgccggccgaggtgcgcgaccacgtgtcgcaggccctcgcgcaggtggcgaccaaccgctaccccaagcccatgagcgacgagctcagggggcagatcgcggagtggcacggcgtcgcgcccgagcaggtgatcgtgggcaacgggggagacgagctcctcttcaacctgttcctcgccttcggtggcagcggccacaccatggtcgactgcccgcccacgttctcggtgtaccgcctgtacgcggagctggtcgagaccaccgtgcgcgacgtgcgacgcaacccggaggacttctcgcttgaccccgacgagctggtcagggctgccacggacgcgagcatcgtggtcctgacctcgcccaacaaccccacgggcaacctcgtccccaccgagctggtggcgcgggtgtgcgaggcgtgcccgggcgtcgtgctcgcggacgaggcctacggggagttctcggccgcgggctcctcggccgagcctctgctggccagccaccccaacctcgtggtgctgcacacgctgtccaaggcgtactgcatggccggcgcgcgcgtgggctacctgctgggctcgccctccgtcatcggcgcgctctcggcggtgcggcagccctactccgtcaacgtcctctcgcaggcggcggcctcggtcgtggtgcgcgagcgcgagtcgtttgagcccaccatcgcccggatcgtctcggagcgctcccgccttgcgggcgggctctcgtcgctcgagcgcctgggcgtgcgcgtgtggcccagcgaggccaacttcctcctcgtgcgcatgccagacgcccatcgcgtccgctgcctgctgcgcgacgagcactccatcctcgtgcgcgacttctccagcaccccggggctggaggactgcctccgcgtcaccgtgggcacccccgccgagaacgacgaggtcgtctcggcactatcccagatcctgagcagggaggactgatgggcaggacatccaccgtatcccgcaagacgggcgagacggacatcacggtcaccctcgacctggacgggtcgggacggtgcgacataagcacgggcatcggcttcttcgaccacatgctgtccgcgctcgggcgccactcgctcatggacctgacggtccatgccaagggcgacacctgggtggacgaccaccacacggtcgaggacgtggggatcgtgatggggcaggccgtccgccaggcgctgggcgacaagagcggcatcgcgcgcttctcccaggcgatcgtccccatggacgaggcgctggtgcttgccgccatcgacgtgagcgggcgcggggagctgtactgggacgtccccatcggccccgacaaggtggggaccttcgacaccgagctgggccacgagttcttccaggggttcgcacgggacgccggcatcacgctgcacctgcgcgagctggcaggcgagaacgcccaccacatcctcgagtgcgcgttcaaggccgcggcgcgcgcccttcggcaggccgtggagagcgacccgcgcgtgagcggcatcccgtcgaccaagggaagcctgtgatgagcgccggggacatcgtcgtggtcgactaccacaaggggaacctccagagcgtcgtccgtggcatcaacgccgtgggcggcagcgcggtcgcgtccgacgacccgcgggcgatctccgaggcgtcgggcgtggtgctgccgggcgtcggggccttcgaggacgccatggccttcctgcgccagagcgggcaggccgacgccatcgtcgactccatccggcgcggcgtgccgttcctgggcatctgcctggggctgcacctgctgttcgagcgcggagacgagcgcagcgccacccccggcaagtcgttccagggcaagtgggtccccgggctcggcgtgctcggcggctcggtgacgcgcctggagtcggaccgcctcaaggtcccgcacgtgggctgggaccaggcctacctcacccaggtgggggagaggtgcccgctcctggtggacgtgccccagggggccaacgtgtacttcacgcactcctacgccgtcgcggacgacgtggacggtggcatcgtggcggcgcgcacccactacgtgcgcagcttcgcctcgtgcgtgtggcgcgacaacgtgtacggggtccagttccatcccgagaagtcctcgggcacgggcagcaggatcctctccaacttcgtgcgcgtggtgaggggatagcgatggtccttctcccggcgatagacctggtggcgggcagggtcgtgcgtctctcccgcggcgaccgctccaagatggacgtgtactccgacgacccggtggcggtggcgcgcgactttgccgcaagcggggccacgtgggtgcacgtggtggacctctccgcggcgtttggcgaggacgggcgggcgctcgaggccaaccgacgcgccatctcggccatctgcgagctcggcgacctcaaggtcgacacgggtggcggcgtgcggtccatggacgccatcgagcgcctggcccaggcgggggcaacccgcatcgcggtggggacggcgctcgtgcgtgacgccgacttcgcccgcgaggcagcccggcgctacggggcgctgctggcggccgacgtggcaggccgcgacggcatggtccgcgtgaacggctggcgagagggggcgggccttggggtggacgagctcgtctcgtcgctcgcggccatgggctatcggcacctggtctacaccgacgtcgcccgcgatggcatgcagtcgggcatcgacgaccaggcgtaccgtcacgtcgcccaggtggcgggcttccccgtggtcgcctcgggcggcatcgcgtcgctcgacgacgtgcgtcggctcgctgggctgggggacggcgtggtggagggtgcgatcaccggccgtgccatctacgaggggagcctgtcgctgcgcgaggcgctttccgtcgccgcgggcgagggcgattccgtgaccaagggagaagcgcatgctgactaagcgcgtcatcccctgcctggacgtgaaggacggcagggtcgtgaagggtgtcaacttcgtggggctccgcgacgccggggaccccgtggagctcgcggcggcgtacgaccgcgagggcgccgacgaggtcgtgttcctggacatcacggcgacctcggataacagggacaccaccgtggagctcgcgtcgcgcgccgccgaggaggtccgcatcccgtactgcgtggggggtggcatgcgcaccgtggcggacatgaggcgcatgatcgccgctggcgccgacaaggtgtcggtcaactcggcggcggtgagggacccgtcgctcatcaccgccgcggcagacgcctttggtagccaggcggtcgtcgtcgccatcgacgcgcgccacgtggggccgggagacaagtgggaggtctacaccgccggcgggcgcacccccacgggcatcgacgcggtgaagtgggccgaggaggccgcgcgccgcggcgcgggcgagatcctcctcaccagcatggaccgcgacggcaccaaggacggcttcgacatccccctcaccagggcggtcgcccgtgccgtgcccatcccggtcatcgcctcgggcggcgtgggctgcctggagcactttgccgagggcatcgtggacggcgaggccgatgccgtcctcgccgcgagcgtgttccactttggcacgtacaccatccgccaggtcaaggagtacatggcatcgcagggcatcgccgtgcgcctggacttctaggccgtctccccgcgaatgagcctctctcccctgcggtagatatcccctgacgtcgcttttggcgccaggggatttttgagaagaacggaagtggttctcgtgggggagaagattggcttcatcgggcttgggaacatggggaggccgatggcgaccaacctcgtgcatgcgggctacgacctcatggtgggcgacctcaaccaggactccgtcgacgcccttgttgccgagggcgcccggaccggcgccaacgaccagatagccgcgtgggcagacgtcctcgtgacgatgctccccaacggccccgtggtccagtcggtcctctttggggcctcgggggcgaagaccgtcgaggccggcacggtcgcctcgtcgctgcggaagggcgcgctggtctgtgacatgagctcggtcaagccgtcggagtcgcgtgcgtgcgagcgtctcctcaagacggttggcgtgggctttgtggacgcgcccgtctccggtggccagaggggtgccgaggagggcaggctcgccatcatgtgcggcgggagccagccagacttcgaccgcgtgtcccccatgcttagcgtgatgggcgcctccgccaggctcatcggccccgtcggctcgggcagcgtcgccaagctcgtcaaccagatgatcgtggcaaacaccacggcggtcgtctgcgaggcgtttaccttcgcccgcaaggagggcgtggatcccaggaccgtcttcgaggcgatacgtggcggcgcggctggctcggccgtcctcgagatgaagctgccccagatgctggcgcacgacttcacgccacccagtgccgcgacgagcatcctccacaaggatgtcgcgaactgcctggccgcagctcacgaggcggactcccccgtgccgtacaccgcccaggcgtacgagatcctccaggcgatgagggcaaacggcctcatggaccaggactttgcgtcgatggtcacctacttcgagcggctggcggactgcgagctctagggggtgtcgaggaatccgggcgccgtggcggcccctcccgctcctggaggcactgggtctccggagacgcgtccgcctaatatttccggtactagctcgaatggggggacgtctgcttaacatttccggggcccggcgaatgagaaggcgaccctgcttagctttcccggggcgtgcacgagttctgagaccaaatgcttaatccccccggtgcttgatcgtgcggggagggcggaaatcggtgcccgccccgggacctttaagcagggcccgccctccaccggttcaggccccgggatttctaagcgcttcgagattcccagggtaatgatgcctaaccttcccaggcctcgtatggattcccacgacaagcgcttaacaagcctagccctcgggtggttttaggggagaggtgcttagacgcgctaggcctcatgtcgatttcgaggcgatatgcttaaccgcactagccctcgtgtgagctgcgcggcggtaatccacacgaggtctagcatccctaagcgagcaggaatcaaatccacaagaggcctagcgccgccaagcatcctgggccggaatccgtatgggagcagtgactctccgtgcgcgtctcggcggtggcgatagcgaatggactgttgccccccgcccaaaggcacccctctccgtcccttctcagcgctctatctcctccggcgtaacttcagcacccgcgcttgcgcactgtctgccggtcccgcgacggcccggcatccggccgcgccccgtcccaacccgccttccgtttccagttgatgcgacctgtcctgccggtcactgtagtgtagtaaagtgagcgcgaacgcaaggcgtccagggaaggttggcacacatggcagagtcgcggcagggggagtccccctccacgtacgcgggcgagtccctgcagcaggtcgcggcaggcgagacaaacatcaggtacgacgaccgcggcctcgtcccggtggtggtgcagcaggcgggcacgggcgaggtcctcatggtcgcgtgggcaaacgccgaggcggtgcgcctgaccttctccaccggcaccagctggttctggtcgcgctcccgccaggagctgtggaacaagggcgccaccagcggcaacatgcagcaggtgcgccgcgtgctcgtcgactgcgacgccgacacgctgctgtacgaggtggactcgcccggaccggcgtgccacacgggaaagaggagctgcttcttccgtcagctcacggcgggggacgacgcaaagggggagtgctagatgggcgtgaggaccgccaacgttcaggacggcgacatgggagagacgctcgcgagcctggcccagaccatccacggccgctgggaccacgaccctgccgagtcgtacaccgcgcgtctcctcaacggcgaggaggacgagctcctgaagaagctcgccgaggaggccagcgaggtcatcatggcctgcaaggacgacgaccacgaccacatccgctacgaggcaggcgacctcgtgtaccacctgctcgtgacgctcgagcgctacggcgtcacgctgcccgagctggcgggggagctcaacgccaggatgaggtagccgcggccgcgtggccccgtccctctcgcccgccgggaatgtctgcgtcgtgtggcgggcccgaggttgccatacactgttgagcgtcttttccgcagccaacaccatgggggcgtccaacctatgtcaaagagtcccgcggcagcttcgatcaacagcctggacgacgtgagggagaggctcgttcccgtcgtccttgggggagacatactcggctactcgtacgtgagggagttccaccgggtgtacgggatcaactcgatcctgctcgccacggcggacgtgaaggcggcctcgtcgagccgcttctgcgactaccgggtggtcaagggggtcgaccaggaggagtccctcatcagctacctcatgagcctgggagacgagctcgccgccaagggcaaggtgggcatcctcgtgggctccggcgactggtacgcccgcatcttctcccagaacaaggccaagctcgagcaccgcttcgtggtgccctacatcgactttgacctcctcgaccagatcacccagaaggagcgcttctactccatctgcgaggagctgggcatcgactaccccaagacctggctgttcgactgcgccgaccgcgacgccactatcgacgcggaccagtttgactacccgctcatcgccaagccgtccaactcggcgcgctaccactacgcggagttcccgggcaagaagaagatcttcgaggtccagaccccggacgagctgcgcaccatctaccacaacctgcaggagtccagctacgacggcgagctcatcgtgcaggagttcatccccggcgaggacgacggcctgcgctccgtcaccaccttcagcgacgacgagggcaacctgcgcgtgagctgcatgggccaggtcgtgctgcaggaccacgccccctcggccatcggcaaccccgtggtcatccgcgacgcccgcgtggagtccgtggtggagcaggccgcgcgcttcctcaagcacgtgggctaccacggcttcgccaacttcgacgtcaagtacgacccgcgcgacggctcgtaccggttcttcgaggtcaacacgcgtcccggccgcaacacgttctacctcagcctggccggtgtgccgttcgtgagcctgttcgtggaggactacgtgctggggcaccagattcccgtcaccgtggcaggcgaccccttcctgtatgcgtgcgtgccgcccaccgtggtgcgccgcacggtcaaggaccccgccctgcgcgacgacgtcctggcgcgctaccgcagcggcatggcacagttcccgctgttctacgacgccgactcgctcaaccactggttctgggccgaggtcacctactaccaccagatccagaagttcaagaagtacgtgtgggacaccggtggcaggcaggcagatgcggactagccccgaccacggcgtcccctctcgggaggatggcccgggcgagagaggcgtgcgcgatgccggcgaggttgttggcaggcgagaggggacgtccctctcgcctgacgacggagccgccacggccgtgacgcccccgtccgggacggcgggcccccccgttgcccccgcgcatctcccctcgatcgccgagcaggtgaaccgggttcccaccgagcccggctgctacctgtggaaggacgccaagggcgaggtcatctacgtgggcaaggccaagaacctgcgcgcccgcatgcggcagtacgtcacgctgcaggacgaccgcgccaagattcccctgatgatgcaggtggtgcgggggttcgactacgtggtggtgggctccgagcacgaggccctggtgctggagcgcaacctcatcgcgcagtaccacccctacttcaacgtcgacttcaaggacgacaagagctacccctacatcgcggtcaccgagtcggacgtgtaccccgccatcaagtacacccgcgagcgccaccgcaagggcaccaggtactttgggccctacaccgacgccaaggcggcgcgcgagaccatcgacacccttcgcaaggcggtccccatctgcataggcacctgcgccgagtggaagcgcgcgcggcgctacctcgcgagccaccccgacgacatcccggtggccaacatggtgctggcaaagcgcggccgcccgtgcttcgactaccacgtggggcgcggccccggggtgtgctgcggcgagatcgacaccgtggagtacgcccgccatgtggaccaggtggagaagttcctggggggcaagcgagcgcagatcgtggacgagctccaggaccagatgcgcgaggcggcccagaacctggagtttgagcgcgcggggcgcatcaagcggcgcctggacgtgatcgccgggctggacgaccgccaggaggtcatgttctcgtccgacgtgagcatcgacctcatcggcttctaccgcgaggagaccatcagcgccgcgtgcgtgttcgtggtgcgcgaggggcggaccatccgctccagcgagttcgtgctcaacaaaggcatggacgtggaccgagtggagctggcggagggcttcctcaagcgctactacgacgagaccgccgacgtcccccaggaggtcgacctggcgtgcgagctgcccgacgagcctctcctcgaggaatggctgggcgagaagcgcggccacgtctgccgcatccaccatcccgtgcggggcgagaaggcccacctcctcaagatggccgagagcaacgcccggcatgcgctcaaccgctacatggtgcgcacggggtacgccgacgaccgcaccaaccaggccctgctgcagctggagagcgcgctcgccctggaccggccgccgctgcgcatcgagtgttttgacatctccacgctgcatggcacgttcacggtcgcctccatggtggtgtttaccaacggccgtcccgacaaggggcagtaccgccgcttcaagattcgcgccgagctggacgaggcaaacgacttccagagcatggaggaggtcctgggccgccgctacggggagaagaacatggccgacgagcgctttgccgagcgcgcgcccgacctgctcgtggtcgacggcggaaagcctcagctcactgctgccatgaaccagctctcggcgttggggctcgacatccccgtgtgcggccttgccaagtcggacgaggaggtgttcgtcccctgggacgagaccccggtggtgctgccgtcggggtccgcctcgctctacctcatcaagcaggtacgcgacgagtcgcaccgctttgccatcaccttccaccgtgagttgcgcaccaaggcgcagtccgtctcgattctggacgaggtcgacggggtggggccaaagcgcaagcgcgccatcatgcggcagtttggctccatgaagcggctgcgtgccgcgaccgaggagcagatcgcggccgtcaagggggtcccgcccgaggtcgcccgtgcggtgtgggagaccctgagagcctgggacgaccaggcggccgacgttgccgctgccgccgcaggcgacggcgggtccgacgacgaccgcaaggggagaggaaccggcgtcctggccgacgacgatcccgccggcagcgcgggaaccgacgccgttacgtctgccggcgacggtgggtccgacgacggcagcgggctcccctctcgtcgcagcccgtccgccgaggcctcgtaagacttcgcgcgtttacgggcgcctaaccgcttcaattcttacgagactcgaagccccgtaagactacgcgcgtttacggggccctaaccgcgccaatccttatgagaccggtttccgccgccgcaacgtgctcctcggcggcggccccgggcgtgggggtcgggagggtgtgccctcgccgcgagcgagacggggcgcgtcgcgttcccgctcacgggagggtccgctggccaaagaaggggagatgatcactcggcacaggcgagtcttggccagtgtgcaagtctcccccgccggtgatggccgttggccgcccggtaatcccctgcctccacttcttcgagggctttccgcacggcagcgggccccctttcctgggggaggccttaactccttgcggacgcctgtcagaaagtccttcgcgtgagtacacacgcgacacgattttggacagagtggccttccgtcatagacttcccccagttggcatccaatcaagtttctaaccttggcagaaagtcgcttgcgtgtgtacacgcgcgacgcggtttctgccattcgggcacccgaaatggggccgattgtcagtaagcccctcgcgcgtgtacacacgtgacgcagtttctgccagcggagtttgcccgtccgacatttccgcaggtcgcatgacatcaatattcgaatgaaggcaggaactcgcccgtgtgagtgctcacgcgaggctcctgctgccatgggaggaaatctggctccgcctcagttcatcccgaggttgccccgtcttccaccatgagcctcgcctcgaatgagcggccttccttccctggggattggcctctcttcccgtcccctctctgagccccttctggtgccatcaaagtcagggccatcaatcccctacggattgacctctctccatccccttccttgagttctttccaatggcccgcaaccacggccactcccaatgccggcgggattgcctgctgccacggccgtcgtccctctcgcccaaagccaacgttctacccttgaccagaaatgacggaaaatgacaaaataagcttgcaagcgcccaaaaacgcgcaataatgagcatgcaagcgcattgggttccgcagccaggcatcacccaccccgcgggaccaccaaacccaggaggacacaatggcagcaaacaagacgcccgcaggtcccatcgacgcggcggcagccgcaaaggcggcgttctccgcagtggagggcaagccgttccccaacgacatcttcaccgccccgcagctccgttgggcggtcatcggctgcggggtcatcgccaaccagatggcgatctcgctctcgcttgccggccgtcacctgcatggggtcgccaaccgcacgcacgacaaggcagtcgcctttgcccagcgtcacggcgtcgagcgcgtgtacgactccgtcgaggacctctacgccgaccccgaggtcgacgccgtgtacatcacgaccccgcacaacacccacattcgctacctccgtggcgccctcgccgccggcaagcacgtgctgtgcgagaagtccatcaccctcaactcccaggagctcgacgaggcacgcgccctcgccgaccagcacggcgtcatcctcatggatgccacgaccatcctgcacatgcccctgtaccaggagctcctccgccgcgccaaggccggggagttcggccccctcaacctggcccaactcaactttggcagctacaaggagtacggcgacctcaccaaccgcttctacaaccccaagctcgcgggcggcgccatgctcgacatcggcgtctacgccctctcgctcatgaggctgttcatggtgagccagcccaaccaggtcgtctcgctcgccaacctcgcctccacgggggtcgaccagacgagcggcatcgtctgccgcaacgagcaggggcagctcggcgtgctctcgctctcgctccactccaagcagcccaagcgcgcggtcctgagctttgacaagtgttacgtggaggtcatggactacccccgcgccgaccacgcgaccatcgtgtggaccgctgacggcagccgggaggagttccacgccggcaccgagggctacgccctgtgctacgagatggccgacctcgagcgcgcggttgccggcgacgagcgtgcggcctcgctcatcgactacgccgccgacgtcatggacctcatgaccaacctcaggcgcgagtggggcgtcacctaccccgaggagcgctaggtgctcgcgcaggagcgcctgtcccgcatcgtccgcatggtgggggagaggggcacggccaccgtgtccgagctggcccaggccacgggtgcgtcggagtccaccatccgtcgcgacctcgaccgcctgcacgaggcaaaccggctggtcaaggtgcacggtggcgccatggccatggaggccgcccacctcacgcgcgacctcaccctcgcggagcgccatggcctccacgcaggggagaagctcgcgattgcccggcgcgcggcgtctctcgtcggccccgacgacttcgtgtacctggactgcggctccacggtagagcggctggtggaccagctccccacctcgtgcggggcgaccttcgccaccaactcggtggagcacgccatgaggcttgcggcgaaggggctcgcggtcatcgtccttggtggcaggcttacgagcgcgacggcggcgctgaccggcctcgacaccctggaggcggtcgcgcgctaccacttcacgctcggcttctggggctccaacggcatcacggaggagagtggctacaccgtgcaggaccggggcgaggctgccgtgaagtccgccgcgctcgcccactgcgcccgcggcttcgtcctggcggacgccagcaagctgggccgcacgagcctgatcacctacgcccccctctcctccgcgacgctcgtcacctcgggcgacgtcccggacgagtgggcgcggcgcgacgacgtcgtggtcgtgcccaaggagcctggcgagtaggtcgggaccgcgagggtctgcgcccgtggggcgccgagtcgtttgtgcgggagttggtgcctgctcaggggccctgctcgtgcgggtcctgagccgtggcgcttaatcctcttcggcccccgcacgaattcatcgctgcctgctgagcgtccctcggcctcgcaccgctccttggccgttccggttgcgcgaggcctagcctcgctaggcaccagggcccagaatccgtgcgaggcctagccttgccaggaacccggaacagccgcggctccagttgcctgcccccaacgcgcgccgcccgcggcatgccgacccacccgcaacattgcccctctcgccttcccaggggagaggggtgtcccccgttgccggggtcgctcgcggcggccgcgggctcccctcccgccggggcctcgtaagacttcgcgcgtttacgggcgcctaaccgcgtcaattcttacgagactcgaagccccgtaagactacgcgcgtttacggggccctaaccgcgtgcatccttgcgatgccggttcgccggtggccaacgcccctccgtcgggcggcagctccgtgcgcccggggccagggaggtggggcgcatcctcgccgcagggggcggggcactccgcccctccgcccacgggagggcccctggtcaaagaaggggagaggggccgccccctcgactgtctgggccgtcgcatggcgtggaatatactgaggtattgggttgacgccaacaggggagggacatgacgacccaaagcagcaaccagagcatgaggctcgcggcacaggacgaccgcattcccgacatcgtggtgatcacgggcatgtcgggcagcggccgcacgcaggccatgcacgtcttcgaggacatgggctactactgcatcgacaacctcccgccccgcctgatctacgacctcgccaaggtcgtgggcatcaactcaaacgtggggcgccacctcgcggtcacctgcgacctcaggagccagggattgttcgacgagatgagcgacgccatccagcagctcaaggaccacgagctcacggtgaagatcctcttcctcgacgcctcggacgacgtcctgcgccgccgctacgacgagacgcgccgccgccaccccatcgcgcactccggcgagtcgctgcccgacgccatcgcgcgcgagcgccgcatcctggcgccggtgcgcgaccatgccgacctggtcatcgacaccagccgcctgcgcaccaacgccctgcgcagccgcatccgccgcagcttctcggagctttcggaccagcagctcatggacgtcaacgtgttcagcttcggcttcaagcacggcatgccggtcgaggccgacctcatgatcgacgtgcggtttctccccaacccgttctacgaccccgagatgcgcaccctcacgggcaacgaccccaaggtgcgcgactacgtgctgggcaacaaggtcaccgtcgagttcctcaaggcatggtacgacctgctcgacatcgtgatgcccggctacatcgccgagggaaagtcgcagctctccatcgcagtgggctgcacgggcgggcagcaccgcagcgtcgcgatcgccaacgccacggcggagcgcctcaccaagcaggggtaccacgtgcacctttcgcaccgtgacctgccactcgccaacgtcacgaccggatagcggggggccatgtcgttcaccgcccaggtaaaggacgagctgtcgcgcgtcgagggggagtgcccgctctgcgcgtacgcccagctctcggccatcacccgcatctgcggcaccctctcgttcagggggccggggcgctactccatcaaggtctccaccgagacgggcgccgtggcgcgcaccatgatcaagctcacgcacgagctcttcgacctcgagacgccgctcaccgtacgccactcaaacctgcacaagacgcgcaactacctcatcgagatacccgagcaggacgagctcgaggccgacctcgtgaggctggggatcctcgttccgggccacgggctctcatcgggcatcccgcgcgagctgctgggcagggagtgctgccgtcgcgccttcgtccgcggtgcgttcatggcgggcggcttcatcgccgacccacggggcgacttccacctcgagatcgcggtcacgggggaggagtacgcccacggcctcatggacgtgcttgccgacatgggcgtctccgcccgcctcaaccgcagacgtgggaccttcgccatctacctcaagagctttgacgagatcgtgcggctcatccgcgcgatgggcggtcgccgctcggccctcgcggtcgagagcgtccggcgcatgaagtcgctcaagaacgacgtcaaccgcagggtcaacgccgagatggccaaccaggcgcgctccaccggcgcggcggcagaccagctcgcgctcatcgaccgggccgagcgcgagctcgggctccgctcgctgccgcctgcggtccgcgagttctgcgagcttcggcgtgcccatcccgaactctcgctctccgcgctgggcgagatgtgcgatcctcctgcgtccaagtcggcgatgtaccaccgggttctgcgtctcgaggcccttgtatcaagtcccagggacgaatagccagggagtgcgtcccggcatgcatccaaaggggccaaaacatcacgaatactgcagaaacgggggctcgaacctaccgtttgcggagaaaaccggtcatcccacagattgattagcgatggatgtacatctcccctccgcaaaacaaaatttgtcatgggacgccgttcatgcgtagcgaaggcataaatggggataatatgagtggtgtgtcgcttagtctttggtcgagctggggataggccctggtcggccacgcgaaaggagacagcatggcagtaaaggttgctatcaacggctttggtcgcatcggtcgtctggcgttccgccagatgttcgcccacgagggcaccgagatcgttgccatcaacgacctgacctccccggagatgctcgcttacctcctgaagtacgactccacgcagggcaactactcccgtgaccatgaggtcaccttcggtgaggactccatcaccgtcgacggcaagaagatcaccatctacaaggagcccgacgcctccaagcttccttggggcgagctcggcgttgacgtcgtcctcgagtgcaccggcttctatacctccaaggccaaggcccaggcgcacatcgacgccggcgccaagaaggtcgtcatctccgctcccgcgggcaaggaccttcccaccatcgtctacaacgtcaaccacgagacgctgacggccgatgacaacatcatctccgccgcctcctgcaccaccaactgcctcgcccccatggccaagggcctcaacgacttcgctcccatcgtctcgggcatcatgaccaccattcacgcctacaccggcgaccagatgatcctcgacggcccgcagcgcaagggcaacttccgtcgctcccgtgccggcgccgagaacatcgtccccaacaccaccggtgccgccaaggccatcggcctggtccttcccgagctcaacggcaagctgatcggcgccgcccagcgcgtcccgacgcccaccggctccctcaccaacctctacgcggtcgtcgacaaggtcgtcaccgctgacgaggtcaacgccgctatgaaggcctacgccgagaccatccccgagaccttcggctacaacgaggaccagatcgtctcccgcgacatcgtcggcgagacccacggctccatcttcgacgccacccagaccatggcccaggacctcggcaacggccagtccctcgtccaggtgacctcttggtacgacaacgagaactcctacacctcccagatggtccgcaccatcaagtacttcgagaagttcgttgcctaaggtgacgcttcccaggtaaccaggggcgcggttcgcagctttagggccgcggccgcgccccttttcttcggcaatgcaacgtgtcaacagaaggagtgagcatggcctttaccaagaagaccgttcgcgacatcgacgtggagggcaagcgcgtcctcatgcgcgtcgacttcaacgtccccctgaaggacggcgtcgtcaccgatgacacccgcgtccgcgctgccatccccaccatcaagtaccttaaggagcacggtgccggcatcgtgctcatgagccacctcggccgccccaagggcgacggccccgagcccgagctctcgctcaagcccgtcgcggccaagctcgccgagctcaccggctatgaggtcaagttcgtcgacgacacgtatggcgacaaggccaccgaggccgttgacgccgtcaagccgggcgacatcctcctgctcgagaacgtccgcttcgacaagcgcgagaagaagaacgaccccgagatcgccaagaagctcgcctcctacggcgacctcttcgtgctcgatgcctttggcaccgcgcaccgtgctcagggctccgtcgtgggcccggctgcctacatccccgcggtcgcaggcttcctgctcgagaaggaggtcgacaccctgacctccatcttcgccgaccccgagcgtcccttcgtcgccatcgtcggcggctccaaggtctccagcaagattggtgtcctcgaccacctcatcgactcctgcgacaccctgatcatcggtggtggtatggcctacaccttcttcttggcccagggtcacagcgtgggcacctccctcaaggaggaggactgggtcgaccgcgccaaggagatgctcgagaaggccgagaagaagggcgtcaaggtccttctccccatcgacaacatcgtcgccgaccactttggcgaggatgcgcagggcgaggccgtcgactccgacaacattcccgatgaccgcatgggcatggacatcggccccaagaccgagcagctcttcgccgacgccatcaagggcgccaagacggtgttctggaacggccccatgggcgtcttcgagtttgaccagttcgcgcatggcaccgaggccgtcgcgcgcgcggtcgccgaggtcaaggccaacggcggcacctccatcatcggcggtggcgactccgtcgcggccatcaacaagttcgatcttgccgagaagatgagctggatctccaccggtggtggcgcgtccatggagctcgtcgagggcaagaagctcccgggagtggaggcgcttctcgatgcgtaacaggatgattgcgggcaactggaagatgaacgagacctacaccgagggcgtcgccctcgccgagggtcttgccaaggagctcgagggcggcaccggcgacgtcgacgtcgtcgtgtgcacccccgccgtcgacctcaagggcgtctccgaggtcatcgagcagcatgacgctcccttcgccctgggcgcggagaacgtgtactgggaggagaagggcgccttcaccggcgagatctctcccagcatgctcaccaacgtcggtgccaagtactgcatcatcggtcactccgagcgtcgcggctacttccacgagaccgacgaggacgtgaacaagaaggccaaggcgctcatggcgcacggcatcgtgcccatcagctgctgcggcgagtcccttgaggtccgcgaagcgggcaagcacgtcgagttcgtcgtcgaccagatcaagaaggacaccgagggcctcaccatcgatgatccctccaagtacgtcatcgcctacgagcccatctgggccatcggtacgggcaagaccgccactgccgacgacgcgcaggaggtctgcggcgcaatccgcgagaccctcgcccagatctttggcaaggagaccgctgacggcatccgcgttctctacggcggctcggccaagcccaacaacgtggccggcttcctcgagaaggaggacgtggacggcgccctcgtgggcggtgcctccctcaaggcggacagcttcgccgccatggtcaaggctgcgatgtagcgatcccatcaaagggaatgcaccaggggcatccggttattccgggtgccccttctgcttttgcatgggatgtctgcctctggacgttttgtgtcaggatcccactgtgctaacctgttctgatgtctaactgagtcgcatatgcggcatgcccgaaggagccatacaagtgagcccactcaacgtcttcctgctggtcgtcatgaccatctccgcgatcctcaccatcctgctcatcctcgcccactccggcaagggcacgggtgtgtcggacatgatcgcgtcgtccatgtacaactccgcggctggctcgggcgtgtgggagaagaacctcgacaggctcaccgtcatcacggcggtcgtctttgtcgcgtgcatctgcatcatggcgctcacgtttccgctcggaaccatctaagtttgtcgcaagtgacgcgttgcgggcacccctccctaggggtgtccgtatttttttatccctaaaataggggaagggcagcaagttctattttcaccttgcgcgaaacattgatttaacaatgtgtcgtagcaggcgtttgcgcacgtgaggggcattacggaagcattacatctgccaatcggtggcattcagggcttaaatggaattgcattaatttgaatgcgggacgaaaatggatgaacgggttgggcgggggagccgcccaacgaggacgggcagccaggctggctgcaaaagtctacatgggaggcatgtatggcggataagctcatgatgggccgtcgcaccttcgtgaagggtgggctggccgcaagcgcgctcgccgctctcgcgggctgcggaaagaagagcaccagctcctccgactccagcgacagcgccgcaaagggtggtaccttcaagtactacatcggcaaccccgttgccatcgacccctacaacgcgcaggagtccgagggcacgcaggtcgagcacatcctgttcgacgcgcttaccgactacgactgggacaaggaggaggtcgtccccaaggccgccaagtcctgggacgtctctgacgatgggctcacctacaccttccacctggtggagggcgccaagttccacaacggcgacaccgtcgacgccaagagcttcaagcgtggctgggagcgcattgccaaccccaagatggcaactccgtcggacatcaactatcacctggctcccatcgagggctatgacgagatgaactccggcaaggcgaccgagatctctggtctgacctgcccggacgacaacaccttcgtcgtcaagctcaagtaccccatggccgactggccctacgtgtgcgctcaccccgcactcgcgcccgtgccgcaggcggccctggacgaccccgacagcttcctcgtttcccccatcggtaacggccccttcaagatggacggcaagtgggtctccgaccagtacatcaacgtcaagaggtttgacgactactatggcaccaaggccaacctggacgccatcaacttctccatccagaaggacccggacaccgcataccgcgagttcgaggccggcaaccttgacttctgccagattccctccggccgcatcaaggagatcgagggcgacaagggcacgtccgaggacggctacaccgtgaccccgggcaagcaggtcctgactggtgccgagaccgcaatctactacctctgcttcaacctccagaagaaggagctgcaggacctcaacgtccgcaaggcgatcaacctggccatcgaccgccagaagatctgcgacaccctcttcgagggctcccgcaagcctgccgacggcgccatccccaccatccttgacaaggacaacgacaactcgtgggagtacgccaagtacgacgccgacgccgcgaagaagctcgtctccgacaacaacctcggcaacatccagctcgagcttgactacaactccggcggtggccacgaggacatcatgagcatcatccaggacggcctggaggccgccggcttcaaggtgaagcagtcctcccaggagtgggccgcctacctctcctcgatgagcgatggctccttcttcatgggtcgtctgggctggatcgcagactatcccacgatggacaacttcatctaccccaacttctacacggggtctgacaacaactatggcaagtacagcaacaccgaggtcgacaaggccatcgatgaggctcgccagaccaaggacgacgacgagcgcaggtccaagtatcgcgagatcaacaagaagatcggcgaggacctgcccatcgcccccatcatgttctacgctcacaaccacgtgggcagcgatcgagtgcagaagatgtactacgatccgcagggcaaggccgacctcggcaacgcaagcgtcaccgcgtagcggggccttaccagaggaagagcgctaaaggggcggggtgtctacctggcatcccgcccctcccgttttttgggttgcctgaacaggttttactgtcaatacatattgacctgcaggtgcctggcctacgggaccgtgcccgttagcctataattcacccgtttgtatgtgaaaggaccacatcaaacgcagtgtaaacccgcggaaaggggagtccaccctatgggcagatacattgtcaaacgcgtcctccagttcatcccagtgttcctgggcgtgacgctgatcctgtttctcatggagaacgtggttcccggcgaccccatcaagctgattgccggcgagaagaagcttgatccccagacagagatcaaccttcgcatcaagtaccacctcatcgagtccgactcgaatggcaagcccatctacgacgagaatgggaacaccatcgagacccccatgtgggagcgatacgtggactacgtcggtggtctgctccatggtgacctgggctactcctaccagcagaacggcaagcccgtcgcagacatcctggcggagaagtacccctacaccatcaagctcgccgtggtcgccatcatcctggaggcgatcataggcataggggccggcatgatatccgccatcaagagatattcgttctgggacatcctggtgaccctcatcacctccatcaacgtgtccatccccgcgttctggctgggcatgctgctccagctgttctttggcatcgtgctcaagaacgccaccggcggtgcgttctacctgccaatctcgggtgcgggcggacccaccgcagagtttgacgactgggtgtactacatcctgcccgccgtcacgctgtccgccgtctcgtgcgcgtacgtcgcacgcatcatgaggtcgcagctcctcgaggtcctgggccaggactacattcgcaccgcgcgtgccaagggtctctccaagcacgacgtgatcgtgcaccacgcgctcaagaacgcgctcatccccgtcgtcacctacatcggcatggactttggtggcatgctcgccggcgccatcctcaccgagacggtcttcaactggcccggagtcggctacgagacctaccgagccatcaccaagcgcgactggcccatcgtcctgggttccgtcaccgtcatcgtcgtggtggtcatggtcatcaacctgatcgtcgacatcagctacgcctacctcgacccgcgcatcaggtacggcagccccaaggaacagggctaggaggctcgcacaatggctaagaagaagatcttcaacgagaagcccgtgggcgtggagacgcccgagcaggcgcgcgcgaacgccccggaggaggggagcgaggttcagacgaccgctcccgtcaggacgctctggagtgacgcctggaggcgccttcgccgcaacaagctcgccatcatctcggtgatctggatcgcgattgtcgtcctcatcgccctcaccgccgacctctgggtccccgcaaagctcggtggccccacgcagcagctctacgacgcccgtctcccgatgtcctgggcgcaccccttcggcaccgaccaggtgggccgtgacgttctgtcgcgcgtcatctacggctcgcgcatctcgcttgccgtcggcgtcatggcaaccgccatctcgaccgtgatcggactcgtcatgggtgccctcgccgcctattacggcgggctgtgggacaccatcatcatgcgcctggcagacatcttcctggcgttcccgtacatcctgttcgtcatcgtcatgctggcggtcatgggcagcggcatccagaacgtgttcatcgccatcggcgtactggggtggccgtccatcgcccgcgtgttccgctcggcgatcctgtcggtcaagtccaacgactacatcgatgccgcgcgctccatgggcgcatccgacttccgcatcatcacgcgccacatcttccctaactccgtcgcctcaatcgtcgtgtacgcgaccatgaacatcggtggcgccatcctcaccgaggcctcgctctcgttcctgggcatgggcgtcgtgccgcccgacccctcgtggggcatcctgatcgaggacggccagaagtacctcgccaccaacccgtggctcatgatcatgcccggcctcgcgatcctctccaccgttcttgccttcaccctgcttggtgacggccttcgcgatgcactcgacgtcaagatgaaggacgcataatgagaaagaagaatcaggaagagacctggacggagctcaaggagcagcccgttcccgagggccaccacctccttgaggtcaaggacctcaagatgtacttctacacgcaggacggcgtggtcaaggccgtcaatggcgtgtcgtacaacctcgacaggggagagaccctgggcgtcgtgggcgagtccggctccggcaagtccgtcacgtccctcaccatcatgggcctggtggacatgcctcccggaaagatcatgggcggagacgtgctgtaccgcggcaagtcgctcctcaagatgagcgagcgcgacatgcagcacgtgcgcggcaacgacatcgcgatgatcttccaggaccccatgacgtcgctgaaccccgtgtataccatcgggcgccagctgagcgagggtatgaggctccacctgggctacaccaaggagcaggcgtggaagcgctccatcgagctgctcgacatggtgggcatccccaaccccgagcagcgcgtaaaggactacccgcacgagttctcgggcggcatgcgccagcgcgtcatgatcgccatggcactggcctgcaaccccgacatcctcatcgccgacgagcccaccaccgcgctggacgtcaccatccaggcgcagatcatcgagctcatgcaggagatgcagcagaagaacggcaacgccatcatcatgatcacgcacgacctgggcgtcgtcgcggacgtcgccgacaagatcatggtcatgtacgccggctcccccgtggagtttggcacggcggacgagatcttctacggctcgctccacccgtacacctggggcctcacgcgctccatccccgacccggtcttcaccgagaagcacccgctcacgcccatcgagggcaaccagccctcgttggtcaacgtgcccaagggctgccccttctcgccccgctgtccctacgcgaccaagctgtgccacgagaagtaccccgacctctacgtcaccgagaccggccactactcccgttgccactacgcgggcgacccggagttcgtcaagaagaacgcacccgccaactcccgcaccaaggctgcggcgaaggcggccaaggaaggaggtgaggcgtaatggagcaggacaggactgggcaggagcccctgctgcacgtcgagcacctcaccaaggagttccccgtggagggcggcgtcttcaaccgctcgcgcaagaagtcggtccacgcggtcaacgacgtctcgtttgacatctatcccggcgagacctttggcttggtcggcgagtccggctgtggcaagtcgaccaccggccgctgcatcatgcgtctcaccacgcccacctcgggcaaggtcgtgttcgacggcaaggacgtctccaagatgagcaaggcggagctcaaggagatgcgccgcaacatgcagttcatcttccaggacccctacgcctcgctcaacccccgcatgaccatcggcgagatcgtctccgagccgctggtcatccacaaggtgatgcccgacaaggacgagcgcatggactacgtccgctcgctccttgacgtcgtgggcctcaaccccgagcacatcaaccgctacccgcacgagttctcgggtggccagcgccagcgtatcggcatcgcgcgcgccttcgccctgcgccccaagctcatcatctgcgacgagcccgtctcggcactcgacgtgtccattcaggcgcaggtgctcaacctgctgagcgacctgcagcaggagtacggcaccgcataccttttcatcgcgcacgacctcagcgtggtccagcacatctccgaccgtgttgccgtcatgtacctgggcaacatgatggagtactcggactggaagaccctctacgccgagccctaccacccgtacacgcagtcgctgctctccgccgtccccgttcccgacccggacgtccagcgcagccgaaagcgcatcatcctcaagggcgaccctccctcgcccatcaacccgccctcgggctgccgcttccacacgcgttgcccgattgcgcaggatatctgccgcaaggagcccatgcccgagctgcgcgaggtcgctcccggccacttctgccgctgccacttcgccgctcccaagcccatcaaggagtcctcggtggagctgtaggcgtctctcctcaatgtatttgactgccctggcgagaggggcctggccaatttggtcgggcccctctccctttcatggctttagcctgtgtcgcgccacgcgcgacacagagaaccacccgctcagcgggtggatgacactgacgctatgcaacaaaactccctcccctctaggatggcggttgttcaggtcggcggagaggaaggaagaacaccctggcacagaagggcgacacagcctcgcgcacaccagtggatgtgcaagtacacatcgtgttgttgcccaaaagtataggagaaggggccattacaaccacataccgcgacgggtacctcggcagatcctcaggagctatgccagtggaagggggtcgagatctcgggggacctcatgcccgaacacgtgccatgctgttgaggcatcccgcccaagatcagcgtgtcgagtcatgggtggtaacctgaagggaagagactccgctcctcatgttcgacaggcacggcgcgaacctcaagtacaagtcgtggacatgaagttctatggggcggagggctactagtgtccaccgtcgcactgaacaagccagcgatcgcgactatgtgacatccgggagcaggagcgggcggacatcgccctggaccggctgagcgtcaaaggagtatgagatacttcaagaggtgcccctggcacaagccgttgacgggcacggccccacggttgccacgagtcaagcggccatcgggcctgaacgaagtgaaggccagggacttgagtccctggccggcttttctgggttataccctaagagcaaaccacccgctatgcgggtggtaatgattggctgggtctcgtgcttgggggatggtcgaagagggggagaggggcatagcttccgggtggaagagcgtagccttcgggagggagcttgcctcccatgagccagcgtggccgcgccctaggcgtgtcatggcgcgcgaaccccgccgtggccccgacgccagttcggcacgccgcccgtcctggaatgagtctaggaatggggagggagggcgcccgacgcgccatgggcgtcgtcgcccctttcaggatttcacgggctcgttggatgtcatcaagaggcgaagcaaggcaacggaagcctcgcgtgagcacgttcgcgggagggctgtcggggggggaagtctgtgatgtcgtggcatctgtgcaggtacaaggctcgtggataaggagacgcccctgctcatggcagcaggcgcctcgcgtgagcactcacgcccggagtctgctgccaggtggttcccctttcaggtctgaatggcagccgcttcccgctatgagcactcacagggggagttctctgccgttgtcgtacggtcgacgaggagaacaactgggggagttcgatcttccgggacttccgtggcagtgggagccggatgtgagcgcacacatcgggagtctgctgccaaaagggcttccttccgggtctggatggcagccgcttgatggcgagcgaggagggagcgtcggcctcgtctccccggatgccggtggattatgcccggagccggatggaggatcttctcaccctgatagagggcaaatccgtcgacgagcgatgctggcgggtggggaagacgtgcagtcgtgtccgtgacctcgggcgtttctggcaggggaggggctcgtcccaactttctccaaaagtttggaattgacgcttgtcagagcgggacgttctgttaatattctttctgctgcaacgcagcaagccatgtcggagtggcggaattggcagacgcgctagcttgaggtgctagtgactgactaaaaggtcgtgcgggttcaagtcccgcctccgacaccacgaaggtgcagagaggctcccacgggagcctctcttcttatgtgtcgagcctctgccatgggagacgagacggctcgctccgcgtcgaccggcggtcatgtcgggtgagaccgaccaccctgctggcgtgtgccgctcgcctgggatgcgggggtaggctactggcgatacggcgaccctgagcctgttggcgggtgccgttcgcttgggatgcgggactccatgcggcagggagcccgtgcggggacgctgccatgcccctctcgcccggtgtggcatcccctgacagggcatccccctggagcgccttcggcccgcaagcccctgcgctgcgcccaaccgtccacaaaacgaaacccgcgcgcaaccaatcgggcgccccggcggcctaacatgcgataaaggtccccgcacgagaggtgggatgcacaatgattgaccaggtcaccgtgtttctccccaacgaacccggaacgctcgcaaacatgagcgacgtcctgggcaaggcaggcgtccagatcctcgccatcatggtcgcggactccacggacttctgcagcgttcggctgatcgtggacgacacgccgcgcgccctcgacgcgctccataaggcgggcctcagcgccgccacgaccaaggtcatcgccgtggacgtgcccgacgtcccgggcggcctcgcgtccgtggtcacgcgcatcgcgagcgcggacctcaacatccagtacgcctacagctgctccatccgcgaccgcgccgtggacgtgattcgcgtcacgggcgacccggttgccgtcaagctgcgcgagatcgacttccacgacctggcgctctcggacctcctgggctagcgcccctctcgcccggcgcaagcccgccccaaccggcgtccggacgcccgccctccgcagcctggcgcaagccccggcgtttacctgcgcgcatctgggtagaatctgccgtgacgcagtcgggcggcagggggatgcatggcacagggcggtatcgtccgcaggttggatggcataggggagaagagcgtgggaggcacgctggcgacgctcctctcgctcacgagtgacgcggtgatcgcgttcgacggccaaggaagggtgctcctctccaacgacaccgccgcgctggtgtttccccatccgcccgagggactcgtgggctgtgacgttcgctcgtgcttcccgctggcggacgacgcggaccccgacggtcccttctgcctggacgacctcccgtttcccacggatggcagctcgaagccgctggtgtgccaggcgggagacggcggcgcgctggagctgacggttcgctgtgaccgcgttccgtctgcgggcgagacgtacctcctcgtggccgtggcgagcgacgtggcggctcaggcggagcgcgagaacgaccggctggtccaggagctctccagggccaacaagcgcctttcgggcacgctgggcatcgtgctgggcacgctcgactccggtgacgtgatgacgctcttcagccgcgcgctggaggagatcaccgacaccatggaggcctctggtaccgtgttctacgtggccgagcaggacggctaccaccttcgcggcgtcagcaagtcgctcgcgggggtccgggtgccgcgctatctctcgtttggccagaccatcgacgccctggcaaagcgggcgggccgcgcgctcaggctgcgggtgctcccgcccaagggcgacgacctccgtcgcggcaggctcatcaaccgcgaggtcgtgaacgaggagacccaggaggtctatcgcctgcgtgccggcaaggtacccccgttcacgagcttcatcgcggtcccggtgtggtttggcggccacgtgatagcgctcatcgaggtgggctgggagcaggcgcgtcccatgcagcgcgaggacagcgagctgctggatgccgtcgcccagtacctctccgtgcagctggtcggcgcgttcagcgcgctcagggcccggcgcgacggcgagctgcgcgacagcgcgtcccaggtgcgggagaccctgatggaggccggcgacctcaccccgcaggcgcgtcacgacgtcgcgcgggaggtcgaggacgtgctggacgcggcctgcgttgaggtgcgcctgaaccagcggcagggcaacaccgcgctggtcacgacccctgcgggcgacgacctgagcctcccgctggactttgagcaggtccagcgcctgacgcaggaggacggcaccgcggtcatgcccctggagcccgacgacgccgcgtcccgggcgctcgcgggcgcgggcatgccggcgacgggcgcctacgtgggcctgggcaggatcggggacgaggccctgggggtcctggtgctccgcccgtctgacggcgagccgctcgacgagagcgagctgcgctacctcgggcgcgtcgcgagcgacctgcagggcctcgccaggggagaggagcgccgcaggcaggacaagcgcatctcccaggcgctccagacgggcatgcgcaacgagctccagcaggtcgacggcatcaccgcccggggaatctactcctccgcaaccgcgaccgcggtcatcggcggggacttctacgacctgatccggctcccggaccgccgcgcgtgcgtgatcatgggcgacgtgtccggcaagggcgtggaggccgcgtccgtctccgcggccgtcaagaccgccctgggggcctactcgtggcagggcctctcgcccgcccgcatggtgcggctgctcaacgagttcctgcttggtttctctcgcctggagacgtttgcgacgctgttcgtgggcatcgtggaccttgggtcgggcacgctctcgtactgctccgccggacatccgcccgcgatactcgtgagggccgccacgggcgagatagagaccctcgacgtgcagtcgggcgtggttggcgccttccacgagatgacgtaccgcaacggacgcgtgaggctgcgcaggggagacgtgctgctgctctacaccgacggcaccaccgaggcgcgcgcgacggatgggtcgttctttggcgaggacgggctgcgcgacgccgtgatgcgcgagatgccgcgcggctacgacggcctgctcgaccgactgctggcgacgctcgactcctttaccgagcggcacctggacgacgacgttgcgatggtctcgctccgctttgacctggtgggtccgtcggaggcgcctcacgatgcgggggaggtgagcggcgcatgacggggggtgtgggagagacccagggctccgtggctggtcccagcatcgcgctggtgccggcctttggcgacgtggacgtgaccaccgcgccgcgcctgaggagggccatcgacgccctgatagacggcgggtgcaagaggatcgtgctcaacatggcggaggcaacctacgtggactccgcgggtatggggatgatcttccacgagatccgccacatgcgcgagcatggcgggctgctctcgctcaccaacgtgtcgcccggcgtgatgcgtgcgctcaggatcgcgcgcgtcgtggacctggtgccggtctctgcccagggtgcgcggccccaggtgccggcgctggacccctctgccatgcctaagtggaggaccacggtgtggatcgacccggacgacctgggggccagccgcgagcgcgtggcgacgctcctctcccgcatggacctgtccccggacgacctgtttgacctcaacctcgccaccggcgaggcgatgggcaacgccatcgaccacacggacgaccggtgcgccctggtgaccgtggcgtgctatcccgatcgagccgtggtggacgtgacggactgcggctgcggctttgagctctcacccgacgacgacacgcccgaggtgggggaggcagacgagcgcggccgcggcatcaagctgatgcggctgcttgccgactcggtctcgatcgtgcgccgccagcagggcgggacctgcgtgcgcatcgtgaagctgtttcgcccgtagcggagcgacgggctgctgaggaaaacggagtattggcaatctgaggggcgttcgagctgaggaaagtcgagtattggcagcgaatgggcccttcgtattgccaacactcgacattcctcagtaccaagcggcttcggattgccaatactcgactttcctcagcatgggtccctcacgcggtgtacccgtgtgggtgcgcaccggctgcctggcggcgagagttgggttggagctggcagacagggggctcgaggaaaggcgagcgggtccgttccaggtcccaacgattgccaagggccgataggggcagtcacaagggagttctcagctggggagtgatttcgtgtgaggagcacgtcctgtggggtgacccatttccagctgagaagagctcaaagaaggggcatcagagactgacgtacgtgggggcgcccagcccggacgctgaactatccgctccgtcctaggtccattgccccatcacgagctgtttaacctggggtagaggaaccggacggcatggggcgggacgatccgcgctcggcggggaacgtgcttagcgtcgctagtgctcgtggggattttggctcgggccgcttaacgatgctagccatcttgcgggtttcgatgcccgatgctaaatccccctggccctcgtgcgggtcgggcagaggaaactggcacggaggactaggggcgctaagcacgcgggggccaaaacagcacgaggcctagcatcgctaagcatgcgactgccgaatcggcgcgggggctaggggtgctaagcatgggggggcggcaaacgtgcggcgcctggcgtggccaagcgcctcggagctaccgccatggggaagtggctaccacgaaaaagggcgccccgccagggacgcccgtcgatcgcttggaggcgagacccggattcgaaccggggataagggctttgcaggcccgcgccttaccacttggccatctcgccagatatgcggctatgaaaagggccggctgagaccggcccgcgaagctcatggagcgggctacgggattcgaacccgcgacctccaccttggcaaggtggcgcgctaccaactgcgccaagcccgcgacgcgaggaataagtatacgagggaggacctcagttcgcaaggggagagccgcgagggcgctgtcctcaacctaacgcacacaaatctgcacgcggcggccgatgtgcttagcaacgctagcgctcgcacggattttgactcgggccgcttagcggagccagcccctgcacggattgggtggcgggaatcggtgcggggcctaggggcgctgagcacgcgggtgccgggctcctcaggcgcgcccgcgtgaggggacacgccacgaaaaagggcgccccgccagggacgcccgtcgatcgcttggaggcgagacccggattcgaaccggggataagggctttgcaggcccgcgccttaccacttggccatctcgccagatatgcggctatgaaaagggccggctgagaccggcccgcgaagctcatggagcgggctacgggattcgaacccgcgacctccaccttggcaaggtggcgcgctaccaactgcgccaagcccgcgacgcgaagaagaatatacgtggcggagcccgattatgcaagcacgaatttcaaaaatcttggcagcttgttcctcgcgtggaagaaatcgcaggtgagaggcaccgcccacctggttgccatccatcccggcggcatggcgcgcgccccgactgcggtatgctaggcaaggcgcccgcatcccggcgcccgggaccgcaaggccgtacgcggcacattcgtcaggagaaccatgttcctcaacatcctcaccctgctgttcctcgccctggtcgtgatgggcttcgcgcgcgtgatcaggtacttcatcacctggctgggaaggggcaaggacctcaggaccgccgtggaccacaagcgcgtgagcgaggagaccgccctggcctacctcgaggagggccgccacctcacgcgcgaccagcgcgccgaggtcatgcgcgcccagctccaggatcgcgaggagtttctcgaccacctccacatcacctggtaccaggtggtcatcctgttcgtgtttggctccatggcgggcctgctgctcgaggagctgtggatgtttgtctcggcggggctcacccagagccgcgtggggctggtgtggggtcccttctcgcccctgtacgggtttggcacggtgttcctcacgctcatcgcgttccagatgaggaagcgcggcgccaagggctggcaggtgttcctggtctcggcgctggtggggggctgcctggagcagttcaccggctgggccatggagactctgttccaggcgcagtcgtggacctacctgtacctgcccgaccacatcacgcagtggatcgcatggcgcttcctggtgatgtggggcgtgctggggctggtgtggaccaagatgatcatgcccgagctgctgtaccgcatcggcgagcccaccaccaagcgccaggtcacgttcgtcgtcatcctggccgcctacctcgcgctcgacatcttcatgaccctggcgtgcttccagcgccgtaccgagcgcgacgcgggcatccccgcgtccaacgacttcgagcgctggatagacgaccactacaccgacgagttcatgagccagcggttccagaacctcgtgatcgggcaggacctgtgatgccgggtgcccccacccccggggacggcgaggaggcgtcgcgcgaggtctacctggactacgcggcggcgacgcccatggatcccggcgcggtgcgcgccatggagccgttcctctcgcatgagttctacaacccctccgccccctacgcccccgcgcgtcgcgcccatgcggcgctggaggacgcccgcgcctccctcgcccgcgtgatgggagcgcgtccggcgtcgatcacgctcaccgcgggggccaccgaggccaacaacctcgccttcgcgtgcgtggacggcgaggtcgtgaccgatgcggcggagcacgagagcgtcctcgccgtggcgcagtcgcgcggcgggcgcatcgtgggcgtgggccccgacgggctcgttgaccccgacgaggtcgcccgggcggtcacgccccagacggagctggtctcggtggaggcggcaaacggcgaggtgggtgccatccagcccgtccggcgcgtcgcggcggtcgtggctgaggagcgtgggcgccggctgagggcgggggagagtcgcccgatcctgcttcacgttgacgcctcgcaggcggccgggtacgtctcggtcgcggtgtcgtccctgggggccgacctggtcacgctcagcgccgccaaggtgtacgggcccaagcaggttgggctgctgtggtcgtccgaccgcgtgcggctccgtcccctcgtgctgggcggaggccaggagggcggcgtgcgctccggcaccgagaacgtggcaggcgccgtcgcctttgcccacgcgctggagctggcggagcggatgcgcccgcaggaggtccggaggctggccgccctgcgcgtcgacctggagggcagggtcaggcgagagttcccgtggtgcgtggtgagcggcccccgccagggcaggctgcgccttcccgggctgctgcacgtctcgttcccccggctcgacgcgcgcaggctcgtgatcctgctggagcgccgcggggtgtacgtgggcacgggctcggcgtgcgcggcgagcaggatgagaagctcgcacgtgctcgccgcgatgggcgtgccggacgtggtggcccaggggagcctgcgcatcacgctggggaggcagaccggtgcggaggacgtggcatacgcctcccggcagatcacggcctgcgtgcgcggcgagatggcgcgcctctcgcttacggacgacgacatgaggcaggccgcgggaggcgatgcgtgatgggcgagagggtcttcgtgggcctgagcggaggggtcgactcggcgcttgcggcggcactgctggtcgagcgcggctacgacgtcacggccgtgtacatgcgcaactggtcgcgcgacctcccggggttcaagtgcgcctgggcggacgacctggccgatgcggagcgcgtggccgtgacgctgggcatcgacctggaggtgtgggactgcgagcgcgagtacaaggagacggtcgtcgactacctggttgacgcctacgcccatggcctcacgcccaaccccgacgtcatgtgcaaccagacggtgaagtttggcacgtttgccgagcgcgccttcgcccgtggggccgactacgtggcgacggggcactacgcccgcgtgcggcacggctcaaacgggcatcccgcgcagctgctgcgctcctgcgacccgcacaaggaccagacgtacttcctctggcgtgtgcctgcgaacgtgctggaccggacgctcttccccattggcgactaccccagcaaggcacaggtgcgtcaggcgtgcgccgagcgcggcctgggggtggagcgcaagcccgactcggacggcatctgctttgtgggcgaggtgggcatccgcaccttcctgctcgacacgctggagaggcgcccgggcgacgtggtggagtgggagacgggccgggtgctggggcaccacgacggcgccttcctcttcaccgtggggcagcggcgcgggctcgacctgggcggtggccccgcccgctacgtggtgcgcacggacgtgggggagaacgtggtctacgtcacggcggaccgctcgtgccccgcgctgtggaccggctccctcgtgctcgacgactgccgctgggtggcgggggaggcgcccggcgcctgcgagcccgtggtgcgcatgcggcacacgggggcgctggtgcccgcgttgctcgagccggcgcgcgacgggaggtcggccacggtgcgcttctcccagccggtgcgcacggtcgcgcccggacagagcgtggtcgcctacgacggcgaggtgtgcctgggcggcgggatcgtctcgccccgctcgtacgagtcggtgcggcccccgttcgaggccgcggcgcaggggtaggggggcgggcgagacgggcgcggggcgcgggcccgttgcccgggatgccggcggggtgtgcctgggccccgtggcaggcgctactctccctcgccctcccggacctccgcgaccttggcgcgatacgcggcggcgatgacggcgacgcatccctcgcggccaaagcgcgagcggttgagcaccaggtccttgccgtcgtgcatctcgcacttgccggcggagtagcgatggcagtacagctcgcgccccttctgcatgtggcgcacgagcttcttggcctccttgcgggtcatgccgcgcttggtgcgcacggtctcgatgcggtcctcctcgggggcggtcaccagcaccgcgatgcggttggggttgtcgcgcaggatgtagtcggagagccgccccacgatgatgcaggggcccaccgaggcgaggtcgcgcaccacgctcgacacgcgctggaacagcttgtctgcggtggagcgggcgtcgatgcggtcggggagaaacgcgctcatctcggccgtgaggcgggcgtcgtaggccgccacctcgtccacgggggcgcctgcgcgcgcggacgcccgcaccaggacctcgttgtcgtagaacggaaggtcaagctcctgcgagagcatcttgccgatctcgtggccctcggcgccgaagtcgcgctcgatggtgatgaccacggggttgagcgcgggcgtggttggctcgccgccgtcgggtgcggcctcctgccgcagtgcgtcgctgtccttctcgctcatgggtgcctgcctttctggcttggtgggtgggtggccgttgcgctacgcggcgacgaggctgcgctggtagcggcgcaccgcgagcgagatgccaaagttgagggcaaagtacaacaggaagatgaagccgtacaccaggaggatttggtccaggctcgtggtggtggccatgatgaccttggaggtgtacatgaactccgccacgttgatgcccgccaggtaggacgagtccttgaccacggttgtgcactggccaaacagcgcggggatgatcagcttgaaggtctgcggcaggatgatgagccgcatggactggaagaagccaaagccctgcgactgcgccgcctcaaactggctcttggggatggagttgaggccgccgcgcacgatctcggccatgaccgccgaggtgaagagcgtgaacgccaggaccgagatcagcacgtcgttgcccttgaccgtgaagtacacgaagaggatccacagcaggttgggggtgcagcggaagagctcgatgtaggcgctggcgatgacggagagcacgcgcagcctgcccgtgcagtactgcttcaccatggcaagcacggtgcccagcgccacggagaggatgatggagagggccgatatctcgatggtcttgacgaagccgcccagcatgaaggcgacgttggtggcggtgaagacgcccattacgcctcacctcccgcggcctggccggcctgcgcggcgacggcgcgacggcgacggcgcggcgtgcgggacgagctgcgctcgaggtgctgcaccagtagcgccagcgggaagcagatgaggaagtacagcaggcagcacatgacgtagccctgcaggtagccgtaggtcgagacgaagttgtcggcgttgtacatgaggtcgccgccggcgatgagcgccagcaccgaggtgttcttgaccaggttgagcgcctggttgcatagcggaggcaggatgatgcggaacgtttggggcaggatcacgtagcggtaggcctgggcgcgcgagaagccctgcgacagcgcggcctccatctgcccgcggggcaccgactctatcccctggcgaatgacctcggagatgtaggcggcgtggtacagccccacgcccagcgtgcccagcgtgaacgacgcgatgcgcacggggtcggaggcgccggtgacgcgctgcaggatcagtgggccggccgcgtacatgaagaagacctgcacgggcagcggcgtgttctggtagaactccacgtagacgcggttgatcgcgtggagcaccttggagcgcgtggtcgagaagatcccgagcacggtgcccagcaccaacgccagggcaaggccggcgagcacgaccctgagcgtgaagccaaacccctcccagaacatgtccatgttggcaagcgtctgctgccagcgcatggggtcgaataggtccatccgttcctcctcacgcatgccggcgcgcgtgggcgcggtcgcggcatgccgtcgcatggtgcggtgctacagcaggttccagtccttgacctcctggtcgagccagccgttggacaggcactcggccacgacctggtcgcaggtggacgagaagtcgcagcccttcttggtcgcgatcccgtactcctgcttgccaaacttgacgtcgggctccaggagctcggtcgtgtcgtccttgtagccgcccaggatggagcggtccaccgagaacacgtcgatgttgcccgagtccagggcgatcttgagcgtggagtaatccgggaactgcaggaaggtgggggagacgtccagtcccttgtccttcagcatgtcctggatggcctgcttggtgctggagccctgggataccccgatgtacttgccgtccaggtcccggaggcccttgaacttgcccttcttcaccaggaggccgatgtagtcggagcggtacgcgcgggtgaagtcccagctctgcttgcgctcgtccgtgatggtgtaggtggcgcagatcatgtcgagctggtcgttgtcgatgagcggcccgcgggtcttgggcgtgacgtccgtgaaggccaccaggtcgtccgacttggcctgctcgtagctgcagccaaagactttggcggcaacctggtagcacaggtctatctccatgccccggtacttgccggtcgccgggtcaaggtagccgtagcccgggatgtccttcttgacgccgcagttgagcgtgccacggtccttgatggtcgcgagcttggacgactccgagccggaggtcgagcccgagcccgtcgactcgcaccccgccagggctcccgagcctgccagcccgagcgcgacggcccctgccgccctgacgaactgcctgcgagaaaggttcatgcgattctctcccctaagatggcgtcccatgcgggctcctagtggatgatcttgtcgaggaacgcctggacgcgggggttgtccgggtgcgtgaagaagtgctccggggtgcccgtctcgatgatcctgccgtcgtccatgaagacgatgcggtccgcgacctcgcgcgcgaagcccatctcgtgcgtcacgcagagcatggtgatgttctcgtgcgcgagctcgaccatcacgtcgaggacctcctggaccatctcggggtccagggcgctcgtgggctcgtcgaacaggatgatgggctgcttggtgcacatggcgcgggcgatggcgacgcgctgctgctggccgcccgagaggttctgcgggtactcgtctgccttctgggccaggcccacgcgcttgagggcggccatggcgttggcgttggcctcctccttgctcttgtgctgcagcttgatgggggcgatggtgaggttgcccagcacggtcatgttgggatacaggttgaactgctgaaacaccatggacgagtacttgcgcgccatctccaggtggttcttgcgggtgagcgtggtcccgtcgatcacgacctcgccggagctgggctcctccaagaagtcgacgcagcgtatgagcgtggacttgccggagccggagggacccaggatgacgaccttctcgccctcctggacctccaagttgacgtccttgagcacgtggaggtccccaaagtacttgttgaggttgcgaatctggatgaaggcgggcatcgcatgcctttctcgccgtgggtgtgcttgccgggccctcgctgcgccgatgcaccgagtgccccatggaactagacattcttaaggtagggtgtgtatgtcgtgtgtgcatccttaaagtttttacccgcgcgtcatacgagggcggtgctgcgcgcgtgcgggttggtcgtatgggggcgccttggctggcacctctcgtgcgttccggcgggtgacggagggggagatttcgcataaaatgcgcgcatggaccaggatgcccggcaacgggccggaccaagggagagccacatggcatgcttcatcgtgcccgccgccgagggcgcagtcgtgaaggtcatcgagcgcagggtcgagaggggcggtgccggcgaccccaaggccgtcgcgcgacgcgcgcagcggctgcgctggctgtcgggcatgctctggggcggcagcggactgctggcgttcgagcacgtttggcatggcgaggtggtcccgttcgcacccttcctcacggcgatggcgacgccgtctgacgccgttgcgatggtccgcgagatggcgagcgtcggggtcgggatggcacttgcggtcacggccgtgtggggcgtgatgtgcgccgtggccaacgcgatcgagcgccgcgccgacgagggcactgccgcagaggtccaggcgtgacgcttgcgatgaccgtcctcgcggcggtcgcgttcaccgtcgcgtggtactcgggcaggggagaggggatgctcctctccctcccgtgcctcatgtactggggtgcgtcgctcatgtggctcgtcgatgccgtcgcggagtacctgagcgagggtatcgcgatcttcaacccctcgggcgggcagcttgcgaacgatgccttcctcgggctgtgcgtcgtgacgctcggcctggtggtctgggttgtcgcgctgctggtgagggacccgcgcggtcgcgtccgcgaggcgattctccgccaccgctaggtggggttcgcggcaatgccatgggggatgccgagcgttcctagggctcgcacggatcctcgtcacctctcccgcacgagggctaggatcgctcagcatcgagtacggaaatccgtgcggggcctagcggaattaagcgcccgagcatccaagggggtgtttgctggggacgcccgctgaggaattgcgacctatggcaatccgagttccttttctgctgaggaaagtcgagtattggcagtggatgggaccgggatgggccgggtcggccgccaaaattcgacattcctcagcggtttcgttgcccggattgccaacgctcggtttttctcagcgcccctgtcgtggcggggcgatgcaagggcccctccgattgccacaactcaagattcctcagcagtgctgggagcccgtccgcggaacgccaggggaatcgagcccctccgcatgtggatgtggcgacgaccacggccaccccctccctgccgggtggttcgggtgcaccgctgcaggcagttttcgcattcggcaggatcgttcccgacaacccgtgcgtgggacggagggtacggcatctcctctctcacggaattgttttgcaggtcaaagaatgggttgggacgttttggggaacgcctggttggccatggggtggaaccgccttgtcggtgggctctgcatctcactctgggtctctccgtgccctttcccgagctctttttctcttcgaagggtgggtatcacctccgagcaagctccggcgtgttgctgatgcccagtctccccgacgatggaatgacggttgggaggcatcagaactcgaaccatggcaaccaaagcccgatatgagtgcctctcaggttcacccttagggggagagaacctgccctatcagagtaaccgcaggtagaatgggggagaggtatcctactcctccgacagatggcaaggacttcccgttgtgagcactcacatcgggagtctcttgccaatccgctccctttccgtgcacgtatggcagccgctgccgtatgtgggcactcacctcgggagcttcctgccaacgttgcaggatggttgccctcgacctcatcccaacgactaaccgcaaaaggcggctccacggccggtggaacgggtcggggagccgcaggcaaagcgtttctctcgcctggacgagaggaagccggactcgcagcgcctagatcagcccctcgctctgcaggagcttctcgacctcggtcccgcggaccatcttcagcacggtctggagcgccatgcgctgcttcaggtcaaggtccatctgggagagcttcttgccgtcggtcagcatgtacacgctccgcagcaggtcgcgcacgtcgaagacgctgctccacacctcggggacgccgcggtcgacgccgcacagcgtgtacaccgcctccatgccggtgcggatggagtactcggtggtgaacacggtgtcgcgcggggtctcggcgtactgcccgatgaacgccaggttcacggagccggcgggcaccacgtcgggacggtcgcccgcgcggcgcggctcgaagaacgacgtcacgtacggcatcatgcacggcgtggtgttgcactcctcctcggcgaggcgacgtatgtcctggcgcgggatcccgatgtggtacagccactcggcgcacagctcctcgcccgtgcactggtacatgggcttgtccacgaagtcgcccttgtcgtcccagcagttgaggccgtagacccagatgaggcagtggtcgtcgggctggtcggtgaactgtccctggcggttgatggtccagctgagaagccagctcgagtccttggcggtcacgatgccgccggtgaccacgcgacctgagagcgggtcgcggtggcagatcgcctcgatggcggagaggatctgcctgttggcggtgtcgacggtccaggactcccagctcgtctccttgatggacttgaagaacttctcggggtggccgaacgacaggtcctgcttggcgagcatcttccacaggtcgaccgagggacccgtcccgttctgaatgtccaccacgggcgcgtgggtctggtcgccgtacgccgatccgtcgccctgggcgccgttggtgacaaacaccaggtcgttctcggtcaggtgcagcgtgtggcgctgccccgcctgcgtgtacgagagctgccgggcaaccttgcggtcggtggtgcagtcgcacaccacgtcggtcacgcacgcctcgaactcgatcttggcccccgcgtccgtgatgtacttcaccatgggcttgatcatcgactcgtactggttgtagcgcgtgaagcgcagggccgagaggtccggcagcccgtcgatgtggtggatgtagcgctgcatgtagcgcttcatctcgatggcggagtgccacttctcgaaggcgaacatggtctgccagtagatccagaagttggtgttatagaacttgtcgtcgaacacgtcgtcgatggtcttgtcggccagctcctcgtcggtcgccaggaacagcttggtcagctcggcgagagcctccttgctcatgccgtacttcttgtcggtgtgggcgtcctgcccttggttctgggtcacgcggcagagcgagaagttggggtcatccttgttgagcttgtagtactcggagaagatcgtctcgcccgggttcacgatcgacgggatggagcggaacaggtcccacatgcactcgaagtggttgtccatctcgcggccgccgcgcatgatgaagcccttggactggtcgtggatgccgtcgcacgacccgccggcaagcggcaggttctcgaacagcgtgatgttctcgcccggcatctgcgcgtcgcggatgaggtagcatgcagcggagaggcccgccagccccgtccccacgatgtacgcgtgcttgcgctcgatcccatcaggcttctccggcgtcgcgaacgcctcgtagttcccgctcgagtagtacatgctggtggcctcctcagactcgcttcccacgatgcgcgacgaccagcgggacggccgacatccgccccgcgcgtcgtctctctcgctgataccagatggctacccgagggggagcttgcggcaaactcattgaatcgccgcgagtgataagaatctcatcacttgccccaatctgatgggcaggtgggcggaattgggtatccctactgggtgtgcgcgaatcgggcgcgcgaggcttgcggggaggtggccatgtcgcagataacggagcgggcgctctcggaggccctgcagcgcatcctgctgaccaagccgctcggcaaggtgacggtgaccgagatcgcggaggagtgcggcgtcaaccgtatgaccttctactaccactttcgcgacatctacgacctggtggagtggacctgccgcgacttcgcggagcgtgcgctgggcgagaacaagacctacgacacctggcagcaggggttcctggcgatctttggctcggtggggcagcacaaggcgttcgtgacgagcgtgtaccactccatgagccgcgagcagctggagcgctacctgtacgacgtgacgtacgacctgctcataggggtcgtggaggaggagtccgccggcctcgacgtgagcgatgacgagaaggcgttcatcgcggacttctacaagtacggcttcgttggcatgatgctcgcctggattcgcgacggcatgcgagaggacccggagcagatcgtggggcgcctctcgatcatggcgcagggcaacttccgcaaggccctgtgcgcgttcgctgcgaggggtggcgacggatcggcgggcgagacgagcgcgggcgcccgggacgaggccgcacccaccggcggcgggcagccagccgcgacggacgggggcgagggccgatgatctatctcaccgcagacctgcacctggggcaccggtccatcgtcaccatcggggaggggcggcccttccgctccattgacgagcacgaccgtgccatcatcgccaacatcaacgacaccgtgagcctggaggacgagctctggattctgggagacgtgacccgcgagcgcggtgccaggtccatcgcctgcgccatgcggcgcatcaactgccggcacgtccgcctggtgctgggcaaccacgaccgcgagcgggcctgcctggagagcggggcctttgagtcggtggcgcgctacgaggacaccggcgtgcgtctggcggacggcacctggcagaggctcgtgctgttccactacccggtgctggactgggacggcatgcaccgcggctcggtgatgctgcacgggcacatccactcgcgcgggcttgcggagggggaggagccccagggtcccgtcgccaccgagcacgtgcacgcgctccacggctacaacgagtggtgccgccgccagggtctgcgtcgctacgacgtgggcgtggacgccaacggataccgcccggtgagcctggcgcaggtcctctcgtccatgggggtcgagggatgctccgcgggactctcctgggacccctcccactggaggtagtggctgggggagagggacgcgggctgccggctggatgggcccggcgcatgggtgtgcgggcctctcgcctggcttgcgcgagacgggcgggccactcgccgtcgtaaccgtcgcgttgcgggccgcctgccgtggggcgggcggggcttacaatgccacgaggccccggtcgccgctgacgtccgacttgggcgcaaaatcgcaacgtggatcggaatcgcctggtggacagcctcatcttcagcgtcaacgctaccttccccatcttcctgaccatgctcgtgggcatgctgctgcgccggctggggatgatggaccaggcgttcacgggctacctcaatgggttcgtgttcaaggtcgcgctgccggtcctgctgttccaggacctcgccacgcaggacttcgccgccgcctgggacgggcgcttcgtgctgttctgcttcctggcgaccgccgccagcatggtggggatcgtgcttctcgcccgtgcgatggtgcgcgacgttgggcagcgcggcgagttcatccaggcgagctatcgcagttcggcggccatcctgggcatcgccttcatccagagcatctatgggagcgccccgtccagcatggcggcgctgatgatcctgggcagcgtgcccctgtacaacgtgttcgccgtggtggtgctcacgctcacggccgatggtggcggggagcgggcgtccgcgggtgagctggcgcgcagggccgtccgtggcgtggtcaccaacccgatcatcctcgggattgcggcgggcttcgcctggtcgctgctggggattcccatgccggtggtgctggggtcgacggtcaagaacgtcgccgtgctcgcgacgccgctcgggctcatcgcgatgggggcgtcgttcgacttccgcgcggcacgcggcagcgtcggaatcgcggcggtcgcgtctctgatcaagctcgtcgcgctggtcgcgatcttcatgcccgtggccatccacctgggcttccgcggccagcagctggtcgccctgctggtgatgctggggtccgcctccaccgtcagctgctacatcatggcgcgcaacatggggcacgacggcgtgctcacctccaccatcgtgatgatgaccacgctggggtgcgcgctcacgctcacggggtggctgtggatgctccgtgcgggcggcttcgtggggtaggggagagggacgcgcgcccagcgtggccgcccaacccgacgcatgtggcggtgtcgcctggaccgtgacagtgctgcctggggtccctggggctggcttgaaagcctgggctgcccgttctcgccctgaaaaagtcaaagaagggaggggggctaccgtcttaggtcatctggggtagcgaggccgtcagcctcatttccgctcagtgggaagacaaagaaggaggcggcttgtgaggtctcctctcaaagctcccgcttacaggtgagaggagtgctcgcatgtcccagtcggtcggcccttcccgctgtcagaaacctcatcttgcgtgtacacacgggacgcactttccgacagggccgtcggaagtaggcacataaccgctgttggagcagcctcgttgcacgtgtcatggtcagaaatcgccccgcgtgtgtacacacgggatggactttcagacagccgcacggcagcgagggtcccctctgtcaaaaacctcgtcccacgtgtacacgcgggacggcttttctggcacacgacctacctcccgagggtcggaaggctctcctctgtcggaaaacacgtcccgcgtgtacacacgggacgccgtttcttgcacaggacggcttccctcagcatccgaccgtccacgctccgagctacgacgaccacgacggagaatcagtgagctaagaatgggacgggcggcccaccttccgggcaagcagtccctccgtgtatgcaggtccctggattcccttctcggggttcttccctacggagagttgtatcgcggagtggacacctccgcgatcgtcccactggcagcgaactcccgatgtgtgcacttccgtctggcttctgcagctgtgcgacgcttcggcatcgcgttaccccagctggctattcattatttctgcaaccatggcagcagactcccgaagtgagtgctcatatcgggaggcggctgccatcggtggtaagagggacggctggcagaaactctccgcacgagtgctcacgcgcgcgagttgccgccatggttcgagctagtacgtccagccaactgggcggagctctaccggcggcgtcctggccccatccgaactcgtttgcgccaggggagacgagcggaaggagctcccccttgccggcagcccaccaatccaccctgttctcagacctgacctccgtacacgagagatgcggccagggctccacgttctcgttcgcggacaggtcttgcctaccatgaagcctcgcagctttgggggctggagcttgtcgggaagagaccatcgagcgtggccgttggggacggcctccctatccgggcatcctcccaaccccctccgttcttagacccggctcccgttcatgagcgaggggcttgaaccttcgcattcccgtccgcgaccggcccctccccgctaccccccggtgggcgcgtactgccagcatggtggagatgcccagctcgtgcaggcgtccctctccattggtgtcgtcgaacgcgtcgtccagcacgagacccgcgcgagccatgccgcccaggagctccccggcggtatgggagaactttgtctcggcgttcaaatcctgatagcgcttctcggccacaccactcacaacctgttcgcgtttttactggtgaaagactcggtaccaccaacttccacccagggacgaccgcgccaaccccaccaggcaagcccggttctgtctcctgctgacagcgatggcaaggaggcgtatcatccaccccatggcatgcgttgagcccaggggagaggagctcgccacggcagggtccaagccaaccgcatcgggttcgagcgaggctgcgccccgtctcgcccccttcgtccgccgcgagtggcggacgctcgtggtggtctccgtcacgggagtcgcgtacaacgtgggtatggtcgccggcccgtggctcgagggcctcctggcccagcgcctggccgacatcctcgcgggcagccttgcgccccagacgatggccccgctcgcctgctgctacgtcgccgccatcgcgggcgtgcagctgatgcgcttcctcaagcggctctacgtgcgaaagttcgctaacaacgtcaaccgtcgcatgaagcgccgcctgtaccagaacctgctggtcaccagcgaggaggcgctcgaggaggagggagccggcagcctgatgaccaaggccctctccgacgtggacgactgcgtggagggcgtgcgcaagttcacgaccgagatctttgacaccggcgtcgtgatggtcgcgtacctggtcacgatgctcgcgtacgactggcgcctgacgctcctggcgctgctgttcccgcccgtctcgtacgtgctcgcctcccgcatgcgccgcccggtcacccaggcgacggcggcggcgaaggagagcgtctcggcgatggcgtcggaggcgctcgaccgcgtggagggtgcgaccacctaccgggcctttggcctggagcgcgtgcgcgacgagtcctttgagcgccgtctggccgactacgagcgcaaggagacccgcgccaacgtgctgtccacggcactcatgcccatctaccaggccatatcgctcctgggtgccggcatcgtgatcgtgctgggcgcccgcgacgtgatgggctccggctgggcggcgtgggacatcgcggcgttcaccacgtacttctccgtattcggcaggctggcggtgaagtcgtcgcacgccggcaagctcttcaactccgtgcagcgcgcgcaggtatcgtgggagaggatccgtccctacatgggcgaggcggcgacccccgacggcggcagtcccatcgatcccggcgagctccgcgcgaccgacctggggttcgccttccccggggaggggccgctcctctcgcacgtctcgctccgcgcgatgccgggccaggtcatcgccgtcacgggcgaggtcgcaagcggcaagtccacgctcgggcggctactctgcggcgagcttgcggcgacctccggctcggtcaccctgggcgggcgagaggtgcgcgacctcgtgctcgcgcgccgccccgtcgcctcccggctgggccacgacccgcagctcatcgacgtgaccgtggccgacaacgtcctgctgggcgacgacggcgaccctcggcccgacctggatgccgcctgcctgctccgcgaggtcgacgccatgcccgacggctgcgacacccgcgtgggcgagggcggagccgcgctttcgggcgggcagcgcgcgcgtctggccctggcgcgcacctatcacttcgcccgcccgctcgtggtgctggacgaccccttcgccagcgtggacatggcgaccgaggcgcaagccgtgcgcaaccttgtcgccatcgcgcgcggccgcggcatcgtcgtagtggtcatctcccacaggctgctgcactttccgcaggctgacggcgtgctgtgcctgcatgacggcacggcggactttggcacgcacgaccggctgatggcggactgccccgcctacgccaggctgtaccggatgcaggcgaggggggtggacctggatgcgagcgcacggcgatgacgcaacccagccgcaagcctcgccggcgggggagaggggctccgcgacccggcccacgggcaaccgccaggtggcggcggtgttcgccgacgtggcccgcacccacctcgcgctgacggtggcgctcgttgtggcggtcgtggcgaccgtggtgacggcgcttctccccccgctcgtcctcgcgcgggtggttgacgggatcgcggcacgctcgctcgacgcgccgcgcctcgccgcagcgtacctcgcgctcgtggtgctgcaggggctggcgggtgccgggcaggaggccgcgatcgcggtgtttggccagaaggtcacgcacgagctccgctcgcggatggctgccaagctggaccggctgcccgcggggtacttcgtccgcaacgcggcgggggccatcacctctcgcctggtcaacgatgtcgacgccgtggaggccctgttcgcctcgggcgtggtgggcatggtcaccgacctgtgccaggtggtcggcatcgtcgccatcgtgatgtgggagagcgcgggcctgggggtcatgctgctggtggccctcccgctggtgttcctgttcacgcgccacgtgcagcgcgcgacgctggacgcccagacccagaaccgcgtcgccgtgggcgaggcaaacgagcagatccccgagacgctccgcaccatccgcaccatccgccagctgggccgcgaggcgttcatggggcggcgctacgcccgtgcgatcgaccgcgccttccaggcgcaggagcgctccaacttctacgacgccgtctactcgcccgtcgtgatcaccaccagctcggtggtcatcggcgtgtctctgtcgcttgccgcgcagggcggccccctcggctcgatgttcggcgtcacggtcggcggggccgtcgcggtcatctcgtacgtggagaaggtcttcaccccgctctcggacatcggcatggagatccagtccatccagcaggctgccgccggcgtgcggcgcatcggcgagctgctggccgaggcggaggagaggcccgtggccgccgacgccccgacaccctccgacggcagcttcggcgacgtcgtcgcgagcctctcccacgtgacctttggctacgagcccgcctcccccctgctgcgcgacttcagcctgcgggtggagaggggcgagcacgtcacgctcgtggggcgcaccggcgcgggcaagagcaccgtgctccgcctgctgctggggctgtaccagcctgactccggcgaggtgacggtcctgggcaggcgcgcggggtccatcccgcccgcagagcgccggcgctgctacggctacgtggagcaggcgttccgcgcggtgccggggagcgtcgcggatcaggtcacgctcggcgacccctccgtcacgggcgaccgggtctcgcgcgcgctgcagacggtggggctgagcgacgtggtcgccggccttccgcggggcgcgggcacgccgcttgccgacgcccgcctctcgcagggccagctgcagctcatcaacatcgctcgggcgattgcctgcgaccccgggctgctgatcctagacgaggtcacggccaacctggactccgccaccgagcgccaggtcatggaggccctcgccgtcgcggtgcgcgggcggacggtcatctcggtgtcgcaccggctcttcgagcgggagggcggccgcctcgtccgcgtgggggaggacgacccggaggttcgggagtaggggccggcccgtgcctgccggctctggtgccacgcgcggtggcggcctcctcgctgcggcgcgcgtgacggttgggacgattcccaggtcgggaagtcgtcccgcgggcggcgtcggcagatggcgcgcagcccgcgggccggcgcacgggtgctctccgcgatgctatcgtgggcggtggcggcaccgccatcggctgccatcgtgcgatcggaggcttccatggacgcttctctctcccagatgcgactggggcactggctcctcgccgcgtgctgcgccttgtacctggcgtggtgggtcatcttcttctggcccaaggtgagtgggggcgaggcccagggtgcgatcaggggcgtcggtgtcgcggcgatcctgggggccgtggcgtgcggactcctgggggcgctgcgcgcgtgcggtggcgcgtcctcgctggcgggtggggcgatggtcccggcgttcgtggttgggtccgtggtgctctacctcgtgatgctcgcggtcaccgccggggcgctcgggaggcagcccacaacggagctggtgctgttcgtggcctggctggggatggagctgttctgcgcatacgcgctggctggggcggggcggcagggcgttgccacgctcgccctggtcctggcgctggtcggatttgcggtgagcctggtctgctacgtgctgtactaccgccttccgccgatgagctcgttcgtcgacgggtgccttcccctcgcgctcatcggcgtcgtgagcgccgtcctcgccgtcgcgatgtagccgtggggtaccgcacctggtcgcgtccccaccgcacctgctgaggaatgtcgagtattggcaatacgcgcgccggttcagctgaggaatgtcgagtattggcagtgaggtggcgcccatggctgccaaaggtcgacattcctcagtagtttgggtgcctggattgccaatgctcgactttcctcagcaggtgttcccacccggacactcggttattgccactgaccggcatttccttgctgggtatggtggaggaatcgtctattgaggcgacacgctccaagtctcttggcaagcacatgggtttcggtttcgaccaatgtcaaattcgtgtctgcagaatggcgcgactaaagcacaagttggctgcgggaaaagtttcgtgactccgcccaagggcgaggcacctcccgtaccatctgttcatggacatcctcatctcacatctcaccgccctcagcgcaatgcgccgatgggagctacgccgcgacttcgaccccctctgccgaagcgccatgggggtaccggcctcgattccgtcttctgccgaggcgagccgaatcctctcgaccgcgcccttcctcgaggaccttccccaccctctccacgtttgcgcccaaggtgtccgggcgaggaggtctgacctgatcgcgcaccccgttgcgattccgcttccgcatgggtcggtgattggcttgggtcacgggctgctctgcgttagccccgagcacctcgtcgtccaggttgcgaggtatctcaccgacctcgagctcatgatgctccttgccgagctgatgggaacctacgcgatcgaccctgacagagagcgtggattcttcacgaggaacgcaccccttgcaacggttgagtcgattcgaatgcatctcgatgcgctcggcaggtttccggggacggcgagggttcgcaggcttcttggtatgacctgcgagaacgctgcctccccgcgcgaggcgaagctctatctcagaatcgccctcaaacccagccttggcggttaccaccttcccgtcgccgcagtaaaccaaccgattatggttccacgcctcggcaaacccacgcaccggggcatcaggaagcccgacctcctcctgctccctccggctttgtgcaaaggggggcgttttcgtggggtaacgatcgagtatgacgggagcgaccactatgacaggaggcagcacacggtagacaccacccgtcggagcgaactccaggcaatcggcttcatcgagtacggggtgaaccgagaccagtaccgtgaccttgcatacatggacggactggaccgttgcatccgccgtgacctgggaatgagggcaagcggactcaccatcgaggagcaaggacgccgtcgcaagctcagggagcgtctgttcattgacttggaacgcatcgacggcatgcactggagcaggggcgaggagatcggtggcccgagctgctgctgatgtgttgcgcaaggcggagccatggatcacccttcgtcgtgcctgctgaggaaagtggagtattggcaatacgcgcaccgtttcagctgaggaatgtcgagtattggcagtgaaggggctcccatggctgccaaaggtcgacattcctcagtagctcgggtgcccggattgccaatactccactttcctcagcagtcttgattcgggacccttccaaatacccttcgcgcaccgccaagctacgcttcgcgcgcgtgacaacgggtatcagttccgcggagtcacgtgccgggggaggggaggaagcatgcattcgctcgaactcgcgctggtagtcgtggttcccatcctgataatcgcaatcgccctcgtcgcaagcctgccgtacgacgagagcgtgagcgtctccgtcaacggcatcccgttccctggcggcaggggtggccgcgccgccgccatcgccgcgctggtcctggtggcggctgcgttcaccgccctcgtcgtcgcggcgaccaccgactcgccgcaggtcagccgctggtgcctcgtggcgttcgtcgcctgcgtcgccgggcagctcgcactgtccgccctctcgtcgcatccgcgtcacaacgttcggcggcgcggttccaaccccgatgccccagctcaggtccgtgccctcccgccggcgcccggagatgaggagacgagccgcaacggtcgtgccctgacctccgccgcggtcggaatcaccgcgttcgccctcgtcctgccgctggcccccgtccccagtgctggcgaccccgcgggcacggcgctggcgctcgcgctcgacctcgccgtccccgtccttgtcacgatcctcgtgctccggtggatgagaggcccccgccacgggtaggcgtaaggtactgtcagcccgatggcactgccaaccgaaaggaaccagcatgtcccacggcaagaagcatgcgaccggcgcggacggctcccgcgtggtctgcccctgcaagcacgtgaccgaggccgacgtccgagctgccgttgcatccggggcgacgaccctcaaggacgtctgccgcatgaccggcgccacctccaagtgcggtcactgcaagtcgcaggtcaaggcatgcctcagacaggcctttgccgagagggacgcaacggccactgccccaacgccctccgacggcctcgcgcctgccgccgcccccgcccccacccaggagctgcgcatccacggcgtgtaccgccacttcaagggagacttctacctggtcgaggacgtcgcacgccactccgagacgggcgaggagtacgtggtctaccgcaagctctacggtgacggctctctctgggtccgtcccaaggacatgttcctgtcgcccgtcgaccaccggaagcaccccgaggcgacgcaagagttccgcttccagctgcaggacatccccagcgtcgcaggccactagccgcacgcacgcccagcgtcggtgaccgcgcccggccatggggtgggggagaggggcgacccgccgcccacgcgcggcagccactccgtcgcgacctctcccgggtcccgccgcgcacaagaagagggggtgacggcatcgctgccgtcaccccctcgcgtgtcacgcactttcgtccaacgccgaacctcggcgcgaaggcgaccttctgctagcgcctgtcgccgtagcttccgcgggacccacggtcgccgccacggtcatcacgcccgccgcgatacccgccgcggtcgccgtagccgccgcgcgagccgccgcggtcgccgtacccgccacgggagtcgccacggtcgtcgcgcccgccgcgatacccgccgcggtcgctgccgtaacccccgcgcgagccgcctcggtcgccgtagccgccgcgaccaccgcggtcgccgccaaacccgccgcgcgagccgccgcggtcgccgccaaacccgccgcgcgagccgccgcggtcgccgtacccgccacgggagccgccacggtcgtcgcgcccgccgcgatacccgccgcggtcgccaccgcgcccgccacggtcgccgtagccgccgcgaccaccgcggtcaccgccaaacccaccgcgcgagccgccatcgcggtcaaagggcttgcggtcgtcgcgcttcttggaggcggccctgcgctcctcctcgcgctccttccagtccgcgccgatctcggcggtgatggcagtgtccatgcggttgaggtacgactcaaagatttccagctcgtcgtcggagaagcccgcaagcgccatgtcctccagcggctggaccttgggcttgtcctcggcgccctgctcggtgatgctcacggactcggcggtgccgtcctcgccctccacgagctggaccaggccgtcggcggacatggcgcccagcgtggtcgccagcgcctcggagtcaacgcccaggaccgtctccaggtccttgagcgccacgttgtccttcagtcggagcatcgccaggacgcggtccacgttggcgtcggccttggccgcctcctccttgcggttgtgacgggcgatgttgagcatgtgctgaacgacgccatacttgtcgatgatctctgccttgctggccattgactctcctgtcattggttgacgtgcatgctagttgcggatgggcttctgtccctctcgttctcggagaagcgctgagtgattgtctccgttcgaccttcgcaagctgccggctgccaaggggtaacacgcgcgggcgaccgcgccatccccgcaaggtggcaaacccgtgcgacacgccgccagttggagcggaggcaagtactcaacactgccccaggcttggcgttgccgcccatcccagacaccccattatgtcaggcccaagggggcacttctcccccgcgttggcacgaatacgcaaattgaccacgtgacgggggagaagagccttggccatcatcccgaccggctcccgctgggtgctgccgcatccgatcggacgcggcatgccggggtcgcccggccacctcggctgcgcgccgtcccgaccggacgcgccccctctccccatccgtcgcagccgacggagagccagatgcgggcctcgcacggatgtcctctcgcccgccttgcccagacgccttgaagcgtgacccgccagccacatgctagagtctgcatggatgcggccgcaggggaccgcacgcgagggggagggctcttggcacgtcacagcaagaaggtggaaggcggctcgggtcctcggcgcgggggcgagccggaacgcagcgtcctgcccgagcgtgtcgacgccgggggcggaacccggcccgaccccgacgcccggcccgctcgcggcgccacccaaccgggccccgacgcccagccccaagccggctcccacccggaagccgacgtccggcccgaccatggcactcaaccccaagcaggctcccaccccgcgcacggccgcaggtcccgccggggcgccgacggccgcaagccccgccgccgcaggctcccccgctgggcggatcgcctgatcacggccctggtcatcctggtgggcgtgggcctcatggtctggccctgggtgcttgaccgcatcgaggcgtccggcgtgttcaaccagatctcgcaggtctcccagaccatcgacgccctgagccccgaggacaagcagcgctacctgcagcaggcgcaggcttacaacgcccagctcgcgggcgagacgccgcagatcgacccctcccagatcctgccctacgacgagcagctcacctacgaccgcgaccccatgatgagctgggtcgagatcccctccatcaacgtgtcgatgcccatctaccacggcacgagcgacgccgtcctcatggcgggcgtcggccacctggagggctccagcctgcccgtgggcggctcgtccacgcactgcgtgctcacggcgcactccggcatgcagaacctgcgcatgttcgacgacatccgccagctgcagccaggtgacatcgtgctgctccacaccatgggcgacacccttgcgtaccaggtccagagctccgaggtcgtgtggcccgaccaggtctcgtcgcttgccatcgagcccggcaaggacctgctcacgctcgtgacctgcaccccctatggcatcaacgaccaccgcctgctggtccactgcgtgcgcacgacctacgacccccagcaggctgccgaccaggccagcgtcaccaagcggcactggggcgccagggagtgggccgtccttgtggtggcgctcgcggcggtgggcctgaccgccgacgtcgtcgtccaccgcgtgcgccgtcgcgggggagacaagccgcagcctcggtagcggccccatccgctggcgtcccggccccgtgacccccgatgccatggcgagtcggtggcgtgcgcgttgccaacgcccgtctcgcccaaggaacggcccccgtgggggtatcgtctgggtggctgagacaaccaggctacgaataccgacgtgtgaggagaccccatgttcgacgagttgcccgtccccgggcgcaacgatccctgctggtgcggcagcggcaggaagtacaagaagtgccactatgcctccgacgagcgcatggagggcctgttcctctcgggcgaggaggtcctgccccgctcgctgctcaagatgccggacgacatcgagggcatcaaggcgtccgccgaggtcaacatgggcgtgctcgactacgtgggcgagcacatctgcgcggggacctcgaccatggacatcaaccgctgggtcgaggagtacctgggcgcgcacgacgcggtgtcggccgacctcaacttcgagggctacccctacagcgtgtgcacctccatcaacgacgtggtgtgccacggcttccccgacgagggcgcggtccttcgggacggcgacatcatcaacgtggacatgtccacgatcaagggcggctacttctccgactcgtcgcgcatgtactgcatcggagacgtgagcgacgagcgccgccgcctggtggaggtctgccacgagtccgtgaaggctggcctggccgcggtgcgcccgtggggccacctgggcgacgtgggtgccgctgtgcacaaggtcgcggtcgacgccggctactccgtggtggaggagtacggcggccacggcatcggcaaggagttccacgaggagccgttcgtgagcttcgtcagcgaggagggcaccggcccaatcctggtgccggggatgtgcttcaccatcgagcccatggtcaacgcgggcgtggccgacatcaccaccgaccgggacaacggctggattgtgcgcaccgccgacggcagcgactccgcgcagtgggaggtccagctcgtggtgaccgacgacggctacgagctgctctcctggtaggcaggctcgccggcaggggagagggacgcggccaccgtgcccgggcccctctccccggcagccgcccgctggcctgccgcagcctcgcgcatggctggcaaggcgtaggatggtcctgacgcaatcgacctcggaggaggccccatggacgagaaggacctggcgcacgacctgaccatcatgctcatgtacctcacttcctggcgcgagaaggcgcttggcggcgaggtctgccgaacgtggaggggctacgactgggacatcctcgaccacctgcaggacgagggcctgatctcgttcacgcgcaaggcgaagtccgccaccctcacgcccgagggcgagcagaccgcgaagatgctggtcaacgtctatggcagcctgatcagcgactttcagcagcaggtcaaggcgcgcctggaggagacggcgccaaagagcaacgtccccgcgttccgcctcagggtcacgctcgagctgggggacgggctcgagtgctggcgcgagctggtggtgccccaggacttctcgttctcgcagctgcacgaggtcatccaggccgccttcctgtggtgggactaccacctgtacgacttccgcctcaccagcaggcgagagaagctcatgctcgtcgatcccacgtcgggtggcgtggactccatgttcgaccccggtgccagggacgcccgcatggtcgactccagggacgtccccctctcccaggtgtttccccgcacgcgcaccgcgacctactcctacgactacggtgacggctggcagcacaaggtcaagctggtggagactatcgcgtgctacgagggccagatgcccgtttgcaccgacggtgccggcgatgcgccacccgaggacgtgggaggtcccggtggcttcgagtacttcctcagggtgatggacgactccaacgaccccgaccacgaggatacggtggcgtgggcaaagtctcagttcttcgagcggtttagcctgggcgccgtgaacgagcgcatcaggaagtggcgtgacggaagcctcttcctcgagtggggccaggcccatccggaggatacctttggcggcgacggcacgggcatggctgggggagagaagggcgggaacccctcgctcaagctcgtcccataggccgtcgggtgctcgtggcttccgcccgtccggcggccatcggctccccgcccgcgtgggggtgctccctgcttagtctcccttgccctcatgctgatctcgtagcgtgatacttagccgcactagccctcgcgtcgttttcgggacaggatgcttagccgcactagccctcgtgggagtttgccacccgaaatccgcatgaggcctaggctcgctaagcacctctcggcagctcccctgaccggcaggttcccggtgcttaatcccgtcggtgcccgtacgcgtcgcggaccctggtgcttagcgctgccggtacctgcacgcctgatgtttcccccgcgcttagcctcgtcggggcttgcacggatttcgagacagaatgcttaactctctcggtgcccggatgggtcggaccctccgaaaaccgtacgcgccccgggatttctaagcatgtcccgttcgcaatcagtgcgggcaccggaatccctaagcacgccacgactgcgatccgtccgagccccggaaattctaagcaccctccgcctgtgacctacgcctgcaccggtcttttaaggcgcggcgtcgacgagagggggcgtgatggctggggaagggtgcgattgaagcccacgcggccaacgcagacggctggggggtcctcaacgagaacgacccatcttgccaggggtgcgctgctcgccttctttggcttgcgagggttcacaggttggaagtggtgcggagcctcccgattgcctccaggtggattccctcaagatgagtgctcgcgccttgcgactgctgccactccatgcatgaaccgcttcccctcgatgacaggagaccaggtgcggagccatggcgggaactcgctcgcgaaagcgctcacgcgagccgttctctgacaggtgggccgtgaggaggaatcgctgggggagacactccttcgtgagcgctcgcatcgtacgttcgctgccgctggggcaacgggggcggttccgttccccgctcaggggctcggcctcgggtctcaagccattacagctgatgtcccagaccctcgcccccttctccgagctcttctgagcggcatgcctgtgagttgctgccgcgttggcgggacgagccgacaggtgcgcccctcccacccacgcaggcagccccatgcaatgtgcgggggagtacattctccatatgaggaacagttcttcataatcagaaaagtgcatatcagaccacataatactttcagtcataccttcttgactttgggaccacaaagtgaattggacgcgaaaaattgcgattggaagacaatatcgggggtgtcaggtcacagaagcgcgttttcttacctcaaaatatgaacagaagtacaaaaaagtgttcacaaattccgttcacgacgtagcttgatagcggttagctgataaccagctgcagaaatcggagcactccgttagaatcggctgcaagggataaccatgtgggggttatccacttcagtcagtcataacctaagacgagggccgcctatgagaccagtactctcatccgcagcagccaccgccaagaggctcgctggaatcgccgtcgccatggcctccgttgccatgctccccatccttgccgcgtcgcccgtggtcgcgcttgccgagaccccgacgctcggggagcccgagcacgagaaggccgcaactctcaacgaggacgggaccgccaccgtgacgctgagcgtgacgggcaagaccgcctcgagccagtccaagtcgagcgccaacgtgatagtggtgctcgacacctcccgctccatggacgacgtcgtgagcaggcgggaggccacggagtgggagcaggtcggccggtgggagtgggaggacggcgccacctacggcctcgtcgatggcgagtacgtccttctcaccaggcaccggcggaacctatggaactactactacacctacgacgcccccgatggctcgcaggtccagtacaccggctcctggtaccaggagatcacgaggtacgaggacgtgacccgcctcgacgtcgcgaagggcgcgctctcgagccttgcggaccagctgattggcgacggcacgagcaccatcggcctctcgctcgagacgttctcgggctatggcgagggcaccggcccaagcgcgtactaccacgggggtcaggcggagagcttcaaggccctggtgaacggcctcgccgccgagggtggcaccaactggacggaggccctggacagggcgaagcagctcgcgatcagggacaccacgacccccacctacatcctgttcctctcggacggcaagcccacctacgggatggtcaacgggaggcagacgggcaacggcatgtcaagccagtccgccagcgcgctgcaggagttctttgaccaggcggtcacctcggcgaacacccgcccgggcaacgtcgtgggcctgtacaccatctacacgggcgcggatgcggcgaccagcatgcacgacttcgccaagcagaccaactccgcccccgatggcaccgccttcgacggcaccgactccgataagctcaacgccgccctcgccgacatcgcgcaggtcatagagacgggcgtggcctaccaggacgtcaccatcacggacgccctgtcgcacagcgtgagctacgtcctgcccgagggcgagaccgccccggagttcacctataccaggaacggcgagccctgggctgacgcccccgcggcaaccgtggacgcggacggcagggtcagctggagcctgggcgacggcaagacgctggagcacggcgtgacctatgccatcagcttcaaggtgcacgccacccaggaggagtttgacaacgcggcggagacggacggcgcccacgaggtcgcgaccaacgagaacggctccgtatcgtacaggacggtcaccagcgtgaccggcagcgacccggtcgtctcggacgtcgagtccgcctcgtacgacgtccccacgatcaccgtccccacctccacgatcacggtcttgaaggcgtgggagggcagcacgcacctgccccagaagctgaccgtgaccgtgaggcgggacggcgaggactacaagaccgttagcctctccgccgagaacggctggactgcagacgtcaccgtctccgcaggtcccacggggcacacctacaccgtggtggaggagacgcccgacggctggacctccagcaaccccgatggcatcgaggtctcgctcaagggcctcaccgcgcagtcgggcaccgcggcgctcaccaacacgtacgtgccgtttggcctgcgcgtgttcaagtacaccggcacgggtgacggccagaggccgctccagggggccacgttcacggtcgagggcaacggtgcgacctacaccctcaccacgggggaggacggctacgccaccaccggcgaggggcagaccctctcggacggcacctacaccatcaccgaggtctcggtccccgcgggctacgacaagctgcccggctccctctccctcacggtggacggcgagacggcaacgctctccgacggcacccagagcgcggaggtcggcaaatccccgcagggacgctacttccagatagccatcagcaacacgacgagcgccccgcagacgatcccgcagacgggcggcctgggcagcgtgcccctgtacgccctgggcatggcggcggttgcggggatcgtggcgctgtcggtacggcaccaccagtgacggcatcccccgcccggggacgttgggcccggggcggagcagatagcaccaagggcaggggtcaactgctgcgcgagcagcgaaggaaaggagaaggacatggttcgtaagctcaggagcctggtggcagtggcattttcggcgctgctcgcggctgcgctcctcccgagcgcggcactcgccctggacgcgaagggcggatcgctcaccgtgagcaacctgagggagggtgacacggtcaacctctaccaggtcgcgagtgtcacagttaaggacgacaacacgctcgacaaggagtgggtcgtcacgcccacaagcgggaagacggtcgacgactacgagaaggcggacgagaccggccgcaagtcgattgccaacgacctcgcgtccaaggtcttctccaccagcgtcacaccggtcgccacgcagaaggtcaccggcaccacctcggcgaccttctccggcctggacgcgggcctgtactatgtgagcgtctccaatgccgacgacgtttcgagggtatatgagaacaccctcgtcccggtgaacctcaaggccaattccgacggcagctggggttacgacgaggcgctgaccgtgccgctcaaggcatccaacgtgagcatcctcaagggcgccgccacgcacgagggcggggcatacgagacccagagacgcagacgggcgtctcgaccaacgggaccgtcttctacaagatcgacgtcgtggtgcccaactacaacggcgcctccaatcgcgacttcctggtgaaggacaagctccccgacggcatcgagtacatcgccggaacgatgaaggtcaacgggacggcgacggaccccgtggtctccactggcggcaacatcagcgtcgacctggcctcgtatctcgcaagctccgccgggcagaccgtgagcatcacctaccaggcaaagctcacgggcaccgcccccgttgagaacggtcgcaccaacaccgcgacgctgctcttctcggccaacagctacgacgccacccagaagaccgtgagcgacagcgtcaccgtcgccaatgccggcatcaagatccacaagaccgccgaggacggcaagaccgcccttcagggcgccgagttccagctgattgacaaggacggcacgaccgtgctcgacacccaggccaccgacgcggacggcaacctcacctttgcctatgctcttggctctggtacctacacgatcaaggagaccaaggcgccggcaggctacagcctcgtcgagaaccagtccgtctccgtcgaggcgagggacaacgcctacaagaccgtcgacatcatcgaccccaaggaccatgccgccggcctgctgcccaccaccggtggcaccggcaccatcgcgatcaccgtcctgggcgttgccgtgatcgccggcaccgccgccctcatcgtgcgcggtcgcaagcaggactagcgcacgctcgtctcgcgcaagccccctggcggggccatcgggcgcggtcggcatccagtcggccgcgccctgcgcgcaggaaggccaccccgtgaacaggaagctcaggatcctcctccaggcgcttgggatgctcgtgggcatcgcgttgattgcctatccctacgcgagcgactacctgcagaagcagtaccaggccaaggtcgtcgtcacgcaggagtcggcaaccgacggctcggaccccaaggtggacctggacgcagagcgcagggcggcgctggagtacaaccagcggctcgcggacggcagggtggaggtcacggacccctttgaccccaaggcagcacgccccaccgacgaggagtacctctccctcatgaacgttgccggggacggcgtgatgggcaccctggtcatccccaaggtcagcctcaaggtccccgtgtaccacaccgtggaggacgacgtgctgcagaggggtgcgggccacatgcccacgacctcgctgccgtatggcgggccgtcctcgcacgcggtgattgcggggcacaacggcctgccgtcggtcaggatcttcgacgacctgacccagctgcgggtgggggactactttgtgctgcaggtgctgggcgaggaccatgcgtatcgcgtgacctccatcgagaccgtgctgcccgaccagacggagagcctgcgcatacaggacgggaaggacctggtgacgctggtcacctgcacgccctatggcattaacacgcatcgcctgctggtccacgccgagcgctgcgagctgccaacgggatggaccgaggggacagacggcgacgtgggcaccacgcccacggtgcggcgggcgctgctgcccttcacgctgctggggttggccgtcgcgcttggcgtggtgctggggctcgcgatgaggcggcacgagcgccggaggagtgatgggggcgcgggtggctcgggcgacggcgcacctggcggaggcgtacgtgcggggacggggcaccacatacccggcaatccgtacgccccgggggcgaagggggcaggggagaggagcgccggcagcgggattggaagcggcgtggcgggggatggctcgcggcacgccgctggaggccgcaaacacaggcatcccggacgccaccttgggtaggtcacgggcggattggtggcacttctcgcctggcgaacttccctcggacaccttcactcgacacaaataaggtgccccgccgcacctgcgcgacggggcaccgcatggaccctattgggccgaagcctacgctgcggcttcttgggttggcctgagctcgacaaccgctagtcgattgctaccttggtgacgttgctcttctcctcctgcttggggacgttgaccgtgagcacgccgccgtccagcttggcggttaggccagcggtagcggcatccttcaggtacacgccacggcttgcctgccactccgaggtctccttctgcaggtagttcttgtccttctcctcgtcggactccttcttgtccaccgagatcgagaggcgaccctcgttgagctcgacgtcgacctcgtccttcttgacgcccgggagctctgccgtcaccacgtacttgtctcctgcgtcctcgacgttcatcttgaacgcgtcgtcagacccgattgccgcgagaggcgcgaagaagtcgtcgaaagcgccgaacggccaagtcctgcgaagtgccttctcgtagtcactgtaaggaaccatgcctgccatcgttaccactccttctatgtggtgggagccctttcttctggacccccttgggttcactctcttatgttcccggcaggggttgctttatacacgagaaggaagaatttctaagtcgattagacttagatgttatgcgttatggacactcatgaggaggcgttagaacttgacggtgccagcggggacggcggggtcgtgcgcggcgaacacccccgcgcagttaggctgacggcgcatgctcgcaacccactccaggctgcgtcgcatctggcccgcgtccgcgagcggccccggcagcctgaggtcgtcccacgagcgcgcgttgtagccgcagtctcccgcaaggaccgcgaacctgccgtcgctggggttggtggcaaccacgcacatcgacccctcggtgtgcccgggcgtcaggaccaggcacagcgacccgtcgccaaacaggtcgcaggactggccaaacggcgtggatgggtcgggcgagaggcgcgctggctccaggctgaccccgtcccacagcgtgcggcggtacctcgcgccgccgcggctcgcgcggtcaatctcctgcggggaggcgacgacgcggcgggctgcggtgaggtcggcgaggccgcttgcgtggtcgcagtccaggtgcgtgagcaccaccgcgtccaggtcggcgggggagagccccaggcgtgccagctgggggccgatgccctcgcccggcgcaagcaccggctccgaggcaaaccagagcgagaaccccaggtgagagagggggcttgtggcgcaggcctcgccccagcccgcgtccacgagcacgcggtggccggccacctgcaccaggaacgccttcaccggcacctggatgcgcgaggcgcggcgctgcagcaggcccgtgtaggccagcgggagcctgcgcgcggagcggtcggggacggcaggcgagacgagcgtggcgccggtctggatcgcggtcacccgggccgttggggtggccgcgctgccgtcgggatgggccggggagggcgttgtggcgcgcttctctcccctggcggcgggggttgggcgggatgccgcgtcgggaacttgcgaggtgttcgcgtctacgcccatgagaagctgtcccgtccggcacccagctcgaagtgcagcttggcgatgcccaggtcgaccttgctgtaggggccgccggtgctggttgccgtgacgcgcggggcgctgcctgcgggctgctccagctcgatgcggaagtgctgctggttgttggccgtgggcgcgaggagggcccactcgaccccgcgacggaaccacgcgggcgcatcggcggtgttgggcgtgacctcgacgggcgacttggacttgtgggggtggcccgcgtttgagccatggccgagcgccaccaccagcaccatacggtcgccgttctggaggagcgcacgcacgtgacggcgcttgaaggtgagggcgacccagcagctgtcgagacccagatgctgcgcgagaaggacgacccgctcgccccagtagccgccgcgctcgtccaggtcgtcggcaggggcgccggcgaccaggaggtagttggacacgcccgagaacttgccgtagtgcgccatcgcgctgtcgaaggcctgggggtcgtcccacaccagcctcatgtgcaggttacccgccgcgttgcaggccgcgacctcgcgctcgagggcgtcgcgcacgtccgctgtcacgggctggctcgtgaactgccggacggcatggcgctcgcgcaccgcgcgctccagctctccctgtgcccagtccgttgcgaagtctctctcgctcattttgatcctccctggatgttgtcgggatagccggctcggttggcacgcagcgcggtctggcgcagcgtgtccgagagcacccagaacctctgccatgcgaccgacgaggggtcgaggtagtagaagttcatcgtcccacgcttgcggaccgtcaccgcgcccgcctcgcggagcaccctcagatggtgcgagacggctggcctggacaggctggtgagctcggtgatctgtcccacgcggaggcctcgttcgccctcgtcgagcagggcggacacgatcgactgccgtgtggggtcgcccagcgcggcgatgagcggcccgcactgcgagaagagcctggagatctcctggcgcgcgcgggcacactcctcctggcgcgacgcggctgctcgctgggttggctcgtccattgcggctttccttcgttcgttggtgcgaaccattgaaccattgggcgtgcgcggagtcagcattgggaaagaaagtcgagacggacgggggcgctggcacgatgcccgtccaggtggtgggctggtgcttagccgcgctaggcctcttgtcgattccggggcttgatgcttagccgcgctagccctcttgtgagtttttcgccgcgaatccccaagaggcctagggtcgctaagcatgttgccgcccaaaccacacgaggcctagcatcgctaagcaccccgttgccaggcccgtgcagaggctaggctgtccaggcgtctccgcagcggcggcccgcaccggagccggctccctcggccccgggtccctctccgcctggcgcccgcacgcgcgactggtacgccgccacccgccggcctccgccgatggtctgacgccgctacccgcacgcgcgactggcacgttgccgtccgtggggcccgccgacccctgcggatggattgacgttggcgcccgcatgagcagtcggtacgggacgcttaacccccgctggggcctgcacacccgtcgcgtaatccgtgcttagccgcgccggggctcgtatcgctcgcgcacatcggatgcttagtcccgccggggcgagcacgggtttctccgccagatgcttaatcctcccggggcgtgcaccgttcggaacccccagaatccgttctcgccccgggattcctaagcgcgccacacccgcgacccgttctcgccccgggattcctaagcgcacggttcttactacctgttcacgcaccggcctctctaagcgctcttcccctggtgggtccccaacccgtgcgggcaccgaggctccaagctcgcaccgcccgtaacccgtgtgtaccaggctctttgagcgcacgctgcaagggggtctcgaggtggcgctggcacatgcccttctatgtgctcttgcccgttgggacgggagcgtggaggagggcggggcggtggaaccccgcgtgccgcaacggctctgacgcccgttccagattgccacaactcgattttctcagccttacagcagacgctgtgtcctcgggcacgggcgtgaccggtgccttccggagcctcgcgtgccctctcccttgggatgcccggcgacccgtgcgaagcgtccctgttgcgcccgggcgcggcactgggatacactggcgggtcgaatgcagcgggtcggcctttggcaagccggccgagagacgggagaggaccttgcgcaactaggacgcgcccaagcgagggcgaagcgcgcgagcagcgcggatggtgcccaaaatgccggcgcgatggcgcgtcggctgcgtccgagaggtcctctcatgcaacttaaccttacgaacatccgctacacctatgccggcagtgcgcacgaggtcctgtctggcgtcacgctctccttcccgcggggatggaccggcgtcgtgggcgacaacggctgcggcaagtccaccctcgcccggatagcggcggggatgatgacgcccgcgagcgggaacgtcgacccgtccactctggtgggagcctactgcgagcaggactcatccctcttgcccgagggtttggatgacttcgcctgcgcctgggaccgcgaggcgattgggctgcgcgaccagctgggtatcggcgacgactggccatggcgttacggggagctgtcatgcggccagcagaagcgccttcaggtggccgtcgccctgtggcgacacccggacgtcctggtcatggacgagccgaccaaccacgtggacgcccccacgcgcgggcgcatcctgcgggcgcttcggggcttcgacggcatcggcctgctcgtctcgcacgaccgggagctgttggacgagctcgtgctgcggtgcgtctcgttcgagacgggtggcgtcaggttgaggcgggggaacttctcccaggcgtttgagcagcatggcattgaggtatccgccgctgcggagaggcgcgagcgagcccgccgcgaggagcgtcgcctgagggaggaacggcagcgtcgggtggaggaggcgtcgcgctcaaagtcgctgcggagccgcaggggccttgcgccgggcgaccacgacgcgcgcgagaggatcgggcgggccatcgtctcgggcaaggacggcagggcgacacacctcacgaagacgctggacgcgcggattcgcggcgagcgcgatgcggtggacgctgccttcgtggagaggagctacgacggggacgttcccgagtttggcgagaggtcgcgccgttccgtggtggcgcatgtccccgcgggggtcgtcccgtttgcgggcgagaggggcggcgcccctggcggcggggctgcgacggcgggggaggcgcctctcgcctgcccgggcgtgcgcgttccggagctgttcctgggctccggcgaccacgttggcctggtggggccaaatgggtcgggcaagtcgacgctggtgagggagctcgtgcgcgcggttcttggcgacgtgcctatggtgtacgtgccgcaggagctctcggcggaggatgcagcgcgggtcgtcgggaggctccgtgagctcacggcgggggagaggggacgggtgctctcggtggtggcgcaacttaactcgaggcccgaggcgattctcgacggcggcatgcccagccccggcgagctgcggaagctcgtgctggccgaggcggcgctgctctccccgcagctcctggtgatggatgagcccgcgaatcatctggacctccactccgtgcaggcgctggagcggatgcttgctggattccccggggcggtggtgctggtctcgcacgacgcgaggatggtcaatgccgtctgcgggcgggtttgggagctggagctggattttgatggcgggggttcggtgctgcgggagcgctgaggtgttgggctggtgcttagccgcgctaggcctcttgtcgattcctgggcgggatgcttagccgcgctagccctcttgtgagtttttcgccgcgaatccccaagaggcctagggtcgctaagcatgttgccgcccaaaccacacgaggcctagcatcgctaagcatgtggcggtccaacgggatcccgggatccgctggcagctgagaaaagtcgacctgtggcaatgggaggggaccccgggatctgctggctgctgaggaaagtcgagtattggcaatggggggccgtccgctgctgaggaaagtcgagtattggcagacggaaggccccgtcccgggtagtgcgcacagaagtggtgtaagagctgtcggggagcggggccttgtgcccccgacccgacagcttgcggctcagggcagatgaggggcatcgcctacaatccgtcgttggttcggaagacggaagaaaggaagacgatgccccagacacagagtgtacccccgcttagccgggagcaggccgcggccgcgatggccgcctggaacgagtgcggggacgcgagggagttcgcgtgccgggtgctcgcggccgtgatgaacgcgatgatggaccgggaggcccaggaggcgtgcggggcgggccgcaacgagcgctccggctcgaggacaaacagcaggaacggccacgggtcgaggtcccccgagaccgccgtgggggacgtggagctcgagatccccaagctcagggagggaacctactaccccgaggggatgctcgagaggtggtcgagggtcgacctctcggtcgccgccatcgtgcaggagacgtgcgtctgcggcgtctccacgcgcaaggcggggagggtcgccgagaggctcgggatatcgtcgctgtcgagctcggaggtttcgaggctgtgcgactccctcgacggggaggtcgaggggatgcggtcgcgcgacctgtccggcacgccctgctgctacgtgtggctcgacgcgacctacatgagctgccgcgacggctcctcggtctcgtcccgcggcatggtcacggcgatagggctgggcgccgacggccgcaagcacctgctcggcgccgaggcggtggacaccgagagcgagcaggcctgggactccttcctggccggccccggggcccgcgggctcaccggggtgcgcctcgtcgtctcggacgaccacgcgggactcgtggccgcggtcgccaggcagttccaggggtgcgcctggcagaggtgcgtcacgcacctgcagcgcaacctcctctcggcgatggcgggcaggcccgaggactccaagcgggcggtcaccgagctcgtgcacgccgccgcctgccaggacgacccggacctgggccgcgcggtgtgggaggctgcggagccgtgggtctcgggggcgtgcccgagggccggggaggtcttctcggcggccgaggactccgccctcgccttccaggccttcccccgcgcccattgggcgaggatacgcaccaacaacgtgcaggagagggccaacagggagatcaagcggcgctaccgcgtcgtgcagaccttcccgtcggtgcactcgatggtgcgccccgcctgcgcctcaatcctcgaggaggagggccgctgggccacgcagagggtcttctcggaggagtccgcggccctcggcttcgcggagcccgagccgaggccgccgctgaccgaggggaggcgcagggcgctcgagaggagggccgaggagatcgtgaacgagatcgtggaacgccgcgggctcaagaaggcgtagcatgctgtcgaaggcggaagcgggcgaccgcccatctccctcttacaccacggatgcgcgcgcgatcccgtcccggccaatccattgccattactcggttttcctcagcagaattccccctcggattgccaaaggtcgactttcctaagcaggtgcgtccttgccagggggcaagatgccgttcccgacggcatcccgcatgtgttgagatgttgacgacgcaacaacttgtgcttgcggacagacaaaacagccttaagatgttgacgaatcaacaagtgggggaggcggacgagccaatccgacgcccgcacgtggatcgcgaaggcctgcgacccgtcgggcatcacgtgcccccacgacgcgcgtcacaaccccgccccgacggatgggagcaccatgaacgaccgctttgagaacttcgtgggcgtggtctacgccctcaacaaggaggtccagcgcatcaagtcggagaagatgggctccctcggcctgcgggggaccgacacgatggtcctgtactacctggggcagagcgacgccggcttctccgaggcggagctcgcacggctgattcaccaggaccgcgctgctgtgactcgcaccgtggcgaagctggagcgcgagggtctcgtgcatcgtgcgtcgggcggcgagacgggcgccggccgctatcgcgcgcccgttcgactgacggagctcgggcagggcatcgcgctcgagatggaccagatcatcgacgacgtggtccgccaggcgagcgcggacctcagccccgacgagcgcagccggctctacggctggctcgcccagatcctctcgcgtctggaggagattcggggctagcgtcagtccgcctgtgcccgcacggccggcgggaggggcgacaaccacaactaccaggcacttctcaactagctaccaccgggcttgccccgggggagggggacactcatgtccgttcgcgtcataaccgattccgcatccgacatcgtgggctttgaccacgcgagcctcaccgtgctgccactgaccgtggcgtttggcgataccgtgtaccgcgacggggtggacctgtcgagcaagcgcttctttgagctgctggtcgagtcggacgagatgccctcgaccggtgccgtcgcgcctggggcctttgcggaggcatttgaccgtgcgcacgaggcgggcgaggacgtggtggcggtgacgctttcgagcaggctctcggggacctggcagagcgcgatggtcgccgcggagggccgcccgtgggtgcatgtggtggactcgctcaacgtgtgcattggcgagcaggtcctggtggagtacgcgctcatgcaggtggagaggggcctcccggcggcggaggtggcgcgactgacgcaggaggctcgcggcgacgtccacgtgctggctctgctcgacacgctggagtatctgcggcgtggcggtcgcataagctcggcggcggcgggcgtcggcacgctgctcgcgatcaagccggtggtgaccgtgcgcgacggtcgcgttgagcttgtgggcaaggcgcgcggctccaagaacggtcgaaacctgctggttcagctggtgagggagcatcccgtggacttccaccggccgttcgcgcttgcctgcagcgagggaggcgagaggaccctgcacaagtacgtggaggactcccacgagctgtgggagggcatggtcgaggggcttcccatctgctcggtgggggcggcaatcggcacgcacgtggggccgggtgccatcgcggtggcgttcttctcgcagggggcgtaggcgagagggacgggcgtcgacggctgcggactcgctccgccgggtgctggctccgcgtgggtcgcggctgggcggctcgggacttgcggtcgcgagcggggcgcgggagttgcgcccggtgggacggcgtggcgggtgagagggacggtccgtctcgcccgcgaacccctccgcctgcagacgaagggaggccccgcgcgatgtggggcctccctggtgcgtcgcatgccacttgcgcgtggctgcgggccgcgtgcgtctgcagctgccgcctacctccggcgacgacgaagtcccagcgcagcggcgagggacgcgaacgccgccagcacgaacgggacggggctggtcgttgcgtcggacgtctgggggagtcgctccccaacgtgcttcgctgcggctttcgtctgggtgcgggtgacgcgcgtgacggtcacggacgccttgccggcgggctgtggggtcggcgtcggctccggcgtgggcgtcggggttggctcgggcgtgggctcggggttcggcgtgggcgtcggcgtggggacgacctcgtgcgacctcagcgtcagctggatcgccttcgcgtcgtttgcgcccagggtgctgtcggagccgctggcgtcgctggcaccgccccctacctcggggaagtcgccctgttcgcccgtccactcaaacgtgaacgggatggcgtacttgtacgtgtagtagctgccgtccttcgaccggccgcgcgagaacacggccgttgcgctcatggttccgccgacggttcccttgatcacgtggtcgccgtcctggttggcgacggtggcgtccatgtcgagcaccaggttcttgccaacgccgttgatggccgcgcgaagctcgtcgaagctcgcgtagctgcccgtgagcgtgatgggcacggtgaccgtggcgatgcccgtgctggggtcggtcgaggtcgtgatgcccgcctggtcgatggcgtagacggacgatcccgcaagcgtcccgccagtgagctcgcgcagcgtgtagcccgtggggttcgtgaggccgtcgagcgtgtacgagacggtgaacctgctggtgacctggcgcagcgtgaccgccgtggggttgggaaactccgcgaccgcgccggagatgtacgagagcgaggatcccgcgctggcgagctgcttcttcacgagcgtggtgtcgaggtacgagcgcagggtcacggtcgtgttgccgttggcgtcgatcaccgcgccgtgctgcgtgtcgaacgaggcggagtcggacgtcttcgcggcgatgtcgccagggagcgtgccagtctgcggcttgttgagcgagatgaagccgtagacggtcgccaccgcgtcggtcttggcccacagcgcgtggagcgtcccggcgctggccctgccgtagttgatcgactgcggatgctcgccgtccgctggagccgcgtcgccctcccaccagtcgacggtgaacttctcctttgcgttggagccctcgacgtcggccctctggtcaagggtccatcccaggaagacgtagccatcgcgggttgccgcgggcaggggagaaccagccgcaaccgttgccgcggaggtcccgccgttggcatccagcgtcaccgtgcctgtggccgtgggcgcctccgccggggtgggggaggcggagcgggccgccgtcgccgctggctgggaggtttccgtgggctgcgcgtcggatgtcgtctcgctcgccgtggtagctgcatcgccatccgtcggggtcgaggcagcgggctgcgatgtggttggggcggcgtctgccgcggagccagcggaggtggctgcgggcgcggtggcctcgctcgtctcgcccgcgtccgccgcctgctgcccggatgtgggctgcgcctggtcggttgcggctggctggccggtcgcgtcgacggcctcggcgagtgccggcgcaggcacgagcgacgcggtgagggcaagcgtggtcgccgcggcggtcgcccccgagaggattcggctcttctgcatgggtgtctccggtctgtgggatgtcgattgaatacttaatggaagcttatcgactcgcagacggggacaagggctgtctaatgccagaaaatggcaggtaaagctaattgccgtgatgcaatggggttgcgtgccaagaagtggcggcactgaaggctacgagaatgacattggatggggggagacctgtgccatgccatgggtgggcggaagcctctcttggcggcgaggacggcgggagccccaggcggcgaccctcgccggaggccatcgcgaacggtcacatggcgcaggaaccgctgcggccgcggccgccgtccccctgctcgtaggcgcgcgtggcccgggccatgttgagctcggacagctccatctggccctcgatgtacggcaggtagtacttgtcgatgccgcatgcgtcgagcgagcagtcgccgcagtcgtcgccccagctcagggcctcggcaacgatgcggatcctctcctcgcgcgtggtgtcgctgatgcggatgcttcccatgccgtctcccttccgaccgcgggcgtgatgccgggcagcattggctcgggctccatcgtaggcgagtggggcggtggtggcgccggtgattgccttcggaaggtgccgacgccggaggttgagagactccgctctcgtgggtcctgccttgccgcgttcggcgtttccgggcacgcgcgggagcgatggggctgcggcgtttggccttctcgtcgcccacacgagcttggcaggtccgtgcttaaggagcgcggggcgagaacggcgacgcctcctgccgtgcttaaagattccggggcgagaacggaggcgcctcctgccgtgcttacagatcccggggcgagaactgttttatgccccgcaaagtcgtgctagccccaacaagattaagcatatcgctccgaaatccgtgaccgccccggaaaggttaagcgggcgcttgggactgccgccgcccccactcccgcgcccgcctacccccgcagcggcgcgatgaactgcgggacgccgtccaccatcgcgggtcggtcctcgccgcggaccagcgggcgcgcgtacagctcgaagtcgcgcgtgagccccatgccgtcgggggtgatccagtggcgtggcacgcggcgcaccttgtcggcgaccttggagacgtccacgctcaccaggcgggtctggtacggcgtcgtggacgtgcgctccagagcgaccatcacgccagactggctgtcggtcgcggcaagcacgccggcggcacccagcgagcgggactcggacaggtcgaccgcgctcgccgtggtcgaggcgcagcgttgcagggtcgagagctccacgcatcgcgtcttgcagccgatgcgctcgcgggtgagcgcggccaggtacctgccggttccggagagctgcgccaggtgaccgaactcgtcggtccccaccccggaggaggcgcgctcgcacagcagcttgccgtccggggcgcgcaggccctcgctcacggcgacgatcacggtgttctggcgttccagcaggttggagatgcgatcgagcaacttgccctcgtcaaagctgacctccgggagcaggaccacgtcgggcgaggggccgccggcggaccccgcgagcgtggaggcggcggcaagccagccggcgtcgcgccccatgatctcgacgaaggtcacgctgctgaggtcgtacacgtcggagtcgcgctggatctcggcggtcgcggtcgcaacgaacttggcggagctgccgtagccgggcgtgtggtcgcagcccaggaggtcgttgtcaatcgtcttggggacgcccacaaagcggacgtcgctgccctgcgactcgccgtaggacgagaggcgcgcgatggtgtccatggagtcgtttccgccgatgtacagcacgtagccaacgcccaggcggttgaactcgtcgaacagctggcggtacgggcggtcgtccttctccgggtcaggcagcttgtagcggcaggatcccaggtagctggcgggggtgtggcgcagcagctcaagctcgagcttgccggggaggttggacgagaggtccacggtgcgaccgtccagcagccccttgatgccgtagcgcatgccgatggggcgaagccccagctcgcgcgaggcgtccatgactcccgcgaggctagcgttgatcgcggcggtcgggccgccggactgtcccaccagaatgttcctgacccttgccattgcggtcgctcctctcgcctcgccgtttagccgggacgttccgcgcgctcccatgggaggggtcgcgccatgctttcagggtactcgtgtttttgccgcgatgcgcccgtggcttgccgcctggggctggcagaggctgtgctgtgcggggagggggcttcgcgtttcccggggcccttgccggcagcttggacactgagggcggcgaggaccccgccgacgggacggtgcctgcgggcgagatggtttgcctctcctctgccggcggaggcggcgtggcagagggccgcatgaattccccaccgcgtctgccctccgcggcaggcggaggcccactcacctaatgggtattggataacaagggcagtttatctagcattcctgtacacggcgagccatgtctaggagaagcgatgcgcattctgtactacaccgaggtcaggggagagaagagcggccccaccaaggaggccaacctcgttgagcaggacggggagttccagatgatcggcgttcacaagacggtgccgctgggacgcgtgtcgtcggtcgagctgatgaagtccgaggccgagaaccccgtggtgcgtgttgtgacagagcagggcatttattgcatgagcgtcccttgggtcatccccggggcggagggcgtgtcgctgcgcaacaaggaggcgacgatccgcctggcccgcaccctgcgggagaaggcgcgcctggggtaggggcgtgagtgggtgagaggcgcctccccgcgcgcgacgggcgacggccgcgtggtcttgcaacggaatggggccgcggagccggccgtcggcgtcgcccgttgccgttcgattggcttctgggggttggcggagtgcctcggcgacggtcgcgccatcgtctcctccgtctccgcaggggaccgcggattggctgccgtcggacggccgcttgcccccacccatgcggcaggtccaccgtgccggcgcctggccaggggccggcagccccggacgtctgcacgccctagggctcgtcgcggacgaacgtgagtctcccctcgtccgagcgcgagcgatccagccgatagccacgctcgccgaagccggcgagctcgcccgtctcctccaccccctgctcggtgcaccaccgcacgaaggtgccgcgtgccgcctttgcctcggtcgcggcttgcaccagccttccgtccgacttgcgcgggctcaggaactcgcaggtgaggacgggtgttttcgccgcacgtgcgaacggcgtgaccgccttggcgtactcgtgcgacgccacgttcacgatgggcatgccggcggcgtcccgcgcgagcgcgtcgtggatcctctcgccccagaacccgtagaggtcgcggctggcgcccatggggaggcgcgcctgcatctcgagccggtagggcaccacgccgtcgagtgggcggagcacgccgtacatcccggagaggattcgcaggtgggcgcgcagccagtcgatctgccggtcgctcatgacctgcggggcaaggtgctggtactggatgcccacgtaggaggtgacggcgggggagaggagcgcggggtcggcgagcatgtcgtcgggcatcgtctggagctgggcccagcttcggcgcgcgattgcctcgctgcagcgccagacccggcgggcgccgtcgtaaccgagcgcgagcaggccgtgcgccagctgcgtggcgggctcgaggaactcgggacgcgagcacgccgagggagccccctcgaccacgtccatccgctttgccggcgagatgatgagcagcagcggcatgcctcttgtctcccttccacggtcgcgacatcgtcacccacggcaccatggtaggggagggagggcgacgttgccgcgttggagcgaggagccggaggatacggttccccggatggcgccagggctgcggggctgctgaggaatatggagttgtggcaatcgggggcgggctttggtgtcgtcgcggaggccacctgctgaggaaagtcgagtattggcaatccgggtcccgtttcagctgaggaaagccgagtattggcagtgaataatcccatgggagccccgtccggctgccaatactcgacattctcgagcacccaaagcctcccgattgccaatactcgatattcctaagcaccatcggcgcgcgattgcccatccgcgccaagaggtcgcgcgggaatcgaccttgacctagcttgtcggttgcctcgcacccctccctgcgctccccgaaaggtctcgcgtccacgctcgcggggctgataccattcccccagcgatgcctccggggggaggcggatgggagtggatcatggccaagagggtcttggtggtggagacgagcccccgcgtgagggggaactccaaccgcatggcagaggagttcgcccgcggcgcccgcgaggcgggcaacgacgtcgatgtcatctcgctggcggggaggaaggtctcgttctgcgttggatgctggggctgcaaggactcccaccgctgcgtgatccacgacgacgcggacgagatcgtgcagtgcattcgccagtcggacgtcgtcgcgtttgccacgcccatctactactacgagatgtgcggacagatgaaggtcctcctcgatagggcgaacgcgctctactttgccccgaacaaccgcttccacgacgtgtacctgctcgcgacggcggaatcggagaagcccgatgcggcggacaatgccatcaacggcttgcgcgggtggatctcgtgctttgagcaggcgaaactcgccggtacgctcctcatcggcggtaccaccacggacgggagcattgatggccgccccgagctcgaggaatgcgcgaagctcggcagggctgtgtagcggtatcgccagcactgttgtcgccgacgtgcagcacgtgatgaccgagtcgcgacgctcttggagagtctcgtacccgggagagtagccaaggaccggggtgcgggcggcctcgccagcgcgtggcccccaccccgccgcgtcctacccgcggtcgcggtgaaagcggtcgagcgcgtcctggtactccgcgcgcctcctgcggaacgccaccgtgaacgccagcgtgagaatggcgagaatcgcgaggtagaggctcgcgagccccgcccaggcaagcggctggccagccggcagccactgccccagcaccgcgcatcccgccagggcgacgaagtacgtgacgccaaaccctgcgacgcgccccccgtaccccaggcgcgacgtgggcctgaagttgaaccagagctgctgcagcacgccccccgccaggcaggcgaggacccagctcgacgcgccgcgagtggacgcgtccagcccgccggacgcgaccgcctccgacatgacccacgcgagaatcgccgccaccgcccaggagctccccacgaacacgcccatggtcaccgcgcgtcccgcgctctcgtgctcgtccccgtcaaggacgccgtacgcaaggtcccttttctggctgtccatcgtgtctcccctcgtccgccggcttccctacccaacgatcccaatcctcgacttcacctgcggcgcgtagctgcgcgagacgaccgcctcgcccccgcccctaagcccaagcaccagcctgctgccaaactccggcctgatgggctggacgttgtccaggttcacgacctcctgtcgcgaggtgcgcacgaactccgtctgccgcagcgtcgcctcgagctcgaacagccgcgatgggctgtggagcgccgttccgtcgaccagtcggacgagcgtatggtcaccgtcggagcggatgctcgcaacgctggcgagagggaccacgcggcgctcggtgcccgtctggctgacgtaagcggtgatcttgctgtcggcggtcctcagcctgtcggcgaggcgctccgcccgctggtctccgggggcgttcagcaccgtcacctcgatgccgcgctgaacctcgcgctgaatgagcctcaccatcatctggagccccctccctctgctggttcgaaggtagacgaggcacgggcgggggagaccagcaacccaccgagttgcgaaaggtcgggcccgagttgcatgggacatggggccgcctccggctccaccgctgcggccacctgctgaggaaacgcgacctgtggcagtccccggggatgccacgggccacgatgcttaatgcccctaggcctcgtgcggattcaagaaccggatgcttagcatcgctaggcctcgtgcggatttccgagccaaatgcttaatcttgctagccctcgtgggcagttgatcggcgaaaatccgcacgagtccggggaagattaagcacgacgtggtcggatccgcacgaggccggggaagattaagcatctccgctcgtccacctctcgtgaggtctcgcccatctgctgcggctcgcgattccccagcacacttgggatgcaagccggctgccgcctgcctgcgcgcgcgattccacggcgccacagcgcccgctccgacagttgacccccaaccgtgtcgctgctacggtagcaatgctccggcgagtccctcgtcgggcgccaacggcataggttccacgttcatcggaggtcgccggccgtagtcggcaatggccggataagatgtcgagtgcgttcggtgtcccctcggggtgccgggcgcctttttcatgagaggagacgccatgcagatccgccgcgcccagaggggcgacatccccgggatcgacaagctgctcaccgaggtcaaccgaattcaccacgacggccgacccgacctgtttgacctgggccgcaagtacacggacgaccagctcgccgcgatggtgggcgacgactcgcgccccatcttcgtcgccgccggcgacgcgggcgaggtcctgggctacgccttctgcgtgcaccagcagatcgtgggcgaccccatccgcaccgacgtcaagacgctctacatcgatgacctctgcgtggacgagtccacccgcggcatgggcgtcggtcgcgcgctgtttgaccacgtcgtcgcctacgcccgccagagcggctgccacgacgtcacgctcaacgtgtgggagctcaaccccggcgcccgcgcgttctacgagcgcatgggcatgcaccccctcaagacctgcatggagaccgtgctctagcccgtctccgcaccttgggtcggctgtccgccgccaggcgagaggcgcggcccaattccgtccaacccccgacccctgcctggtgacataaacgtgcttccctcaatcctgctgacgattctgggcggactcggcctgtccgtccaggtgcccaccaacgccgccctgtcgcggaagatcggcccgctccagaccacgctcacgtgcttcgtcctcgacatggtcgtcctcgccgtggtggtgctgctgaccggcggctggcccgcgctctcgcgcctggggaccgtccccgcctgggagctgctcggcggcctcgccggggtgtcgagcgtgtgcctcaccgtcgtcgccacgccggtcttgggggtcgccctcgagctcaccatgttcatgctgggccagctcctcatgggcatggtcgtggaccagctggggctcctgggcacgagctcgatcgccgtgggctcgctccgcatcgcgggttgcgcggtcgtggtcgtgggcatagccctcgtgtacgtggggaggcgcgatgccggagccgtcgacggcgagtcaggccgcctcggccgctacgcgggggtcgccttcgccgcgggcgtgctcagctcgattcagtcgccgatcaacgctaccctcgccggcgcggtgggcgtgttcggcgccagcctggtcaacttcgtcgtgggcagcgccgccctgctcgtggtggtgctcgtcacccagcgggggaggctgcgccccgtgcgcggcaccgctccctggaagatgatcggcggcctgtacgggatcgcctacaccgtggccaacgtggtcgccacgccggtcatcggcgtgggcatgatgatgtcgtgcgggatgctcggccagctcgcgggcggcatggcggtcgacagcctcggcctgctcgaggcgccccgcgtccgcgtggacggctggcgcatcgccggggtcgccgtcgtggccgccggcatcctcctcatcgccgtggctaaggcgctctccgccgcgtagcccggcccctcgccgaaagctctcctcaccgacctagacaatacgtatgggtacaatacctccaagcaatccctactttccctgctaataggaggaagccatgcagactacgttcgccgacaacgccaaggtcatgtccaagggccaggtcaccattcccaaggaagtacgcgaggtgctcggggtgcagtcaggtgacaaggtcacgttcatcgtggacggcagcaccgtgcgcgtcgtgaacgccgccgtctacgccatgaggctgcttcaggaggacatggccggcgaggcagagcgcgcaggcatcatgtccgaggaggacgccgatgccgtcatcgcccagatgcgccgggagggctagcatgcgcgtcttcgtggataccaacgtccttttctccgcctcgctctttccgtcgggtgtggccgctcgtgcctatgacagggcggtcgcggcccccaacgacgccatcgtgagcgattacgtcgtcgacgagctcaggagcgtgtacgcccgtaagttcccacgcagacaggccacgctggacgcgttcctggcggggatggcgagcgccgtggagatagtcctcacgcccgacgaggacctcgacggggagtcagaggtgcgcgaccccaaggacagacccgtgttgcgcgccgccgtttcggctggtgccgatgtgctgctcacgggcgacaaggacctgctcgagtcgggcgtggagccgccgcgcatcatggcgccgggagaattcctggcgatgtgaggccgtcctaaagaattgcaggtcgctaggaggaggccgcgaggtagccaggcatgtcgttggtgttgatgacggcgtagcccgtgctcgtgttagagctgccacaagccgtcctgttacaacccacgaggttcgtgcttccgcagaagtgctggttcttcgcgatggaagcgccagaatagaaacgtactacagcgcagtgccgagtaggagaggagacgggccccgggcacacggccatcgcgcccggggcccacgtccgcctcgcctgattcccccgacaggggctaatgcgccgtgtacccgccatccacgtagacgctggtgcccgtcacgaactcgttctcgaccaggaagaccacggcgtgtgcgatctcctcgggctttgcgaagcgtccgagcgggtgcatggccagcagctcgtcgtggcgctcctgcccgatgagctcggggctcaccagcggcgtgtccacgtagccggggttgaccgtgctcacgcggatgccgtccttggccagcgcgagcgcggccgacctggtgagcgcgttcacgcctccctttgcggcgcagtacgaggggatgagcgggtcgccgatggccgcctcaatggacgaggtgctcacgatggacccgccgtggccctgcttcttcatctggatggcggcgtacttcatgccgtagaacacgccggtgaggttgatgtccacgaccttgcgccactcctcgccggtcatctggtccaccgtcgccatggtgccggtgcccgcgttgttcaccatgatgtcgagcgatccaaaccgctcaacggcaaagtccaccagtgccctcacgctctgctcgtcggacgtgtccgtcttgcagaaggcgacgtcgggcgaggcctccctcaggccctccaccgcctttgccccgcgctcggggttgcgccctgccacaacgaccctggcgcccttctccaggagcgcccgcgcgcacgcgagcccaatgcccgaggtcccgccggtcacgacggcggtcttgccactgatctggaacatgcgaacctccatctctcttgcgtcggcgcacgcgtccgcgccatcgggcgcgccaccgacgactcccacgccaacgctatctgccgccgggcacggggtcgcgccgttctcctcccgcgcaagccccctttgcattccccgatggaatagagccatataatcagagccactacattccccgtgggattggaaatgcctggcatggacctctcttccatggaatccttcgtcctcctgtgcaggcagggaagctacacgcgcgcggcggagggcctgttcatatcgcagtcggcgctgagcaagcgcatcgctgcattggagagggagcttggcctctcgctcgtggagcgtcgcgacggcgtggtggtccccacgcgcgagggcgaggtcctcctcgcccgctgcgaggagatgctgcgccagagggacgagaccctgcgccagatgcgggggctgcgcgacggatcgtcggcgctgctgcgcgtgggatacctcgcgacgacaccgcttgcggtcatggcgccggcggttgcccgcatggcgcgcgagcacccgcagaccgagctcgcctttagggaggtccccgacggtgccgacccctgcgacgaggtccgccgcggcaggcaggacgcggtggtcagcctggaggagcgggcgcaccccacccccgacgcgcccgtgcggctgttccgccgcctgcgctactgcgtgctggcgggtgcggggacgccgttctcgcgtcgggcgtcctgcgcgccgggcgacctggtcggccatcccgtcgtgctctacacggggagcgaggcgcacggctaccacaccatggcgcgctacctggcctcggtgggctgcgacgcgcgccagatgacctacgccgaatcccacgcgcagatggtgctgctggtgagcacgggacgctacctctcgctcggtgcgctcgacgtgggcatgcccgaggagcaggtccccgaccaggtggtgcgcgtgcccctggtggggtgcgacctctcgggcggcaacatggtggtggcctatgacgcgcacaacgccgccgcctgcgccttcgcccgcatgctgtagccccgcgcgcttctcacccatgcccgcaggtcggttgccgtatcctatagttgtctgaacaagatgacgggaggcggccgcaccatgagcgaagcctatcgcagggcccaccggttgggcgagagggaccgtcacgaggcggtggccgcaagccactcgccgtacctgcacgcgctggacgagatgatctcgatggcagacgtctcggggcgagaggcgctgggcatcatggaggttccgctcgacctggtcgttggcaccaagaccaacgcccgccgcaacgccttctcgcgcaacttcatgccgctcctggacgacaacaccgagttcgcctccaagtggtcgcggctgtactccatccaggtgagcgagggcttccgcgacccggtcaaggtcttcgagttcatgcaccgcttctacgtgcaggagggcaacaagcgcgtctcggtgctcaagtacgtggactcgcccacgatccaggctgacgtgatccgcctgctccccagccactgggacggccgcgagtcgcgcctgtacggcgagttcctggagttctggcgcgccgtccccatctacgacgtggacttcacgcgcgagggctcgtaccgccgtctcgccgcctactacggccgcgacctctcgcagccctgggacgaggccgccgtcgaccgcctgcgggccgactgccagtacttcaccaccgtgtaccggcagcagggcggcagccacctggacatcacgcccgccgacgcgctgctggtgtacctctccatctacggcggggagcctctcatcagcacgcccgcccagctgctgtcgcagcggatcggcaagatctggtccgagctggtgctgtccaccgaggacgacaaggtggccgtggtcgacgagcccacgcccgccgaggccaaggcggcaggcaccgcggaggagagggccgaggccacgccgcccgcggcccgtcccgccggcagcgggggcgcccccgacccacaggcccaggaccaggccccgcgcgtgaccataggcccgttcgcgctgttcccgcgccgcccgcgcgcgggcgaggagccgctccgggtcgccttcctctaccgcggcaccctggcgtcgtcccgctgggccgtggcgcacgaggtgggccgccaggagctgcagcgcgactacgccccctacgtcgccaccagcaagtacgagggctgcgacaccgacgagagggtcctctccgccatagccgacgccgtctccgccggcgccagggtcgtcttcaccacctcgcccacgcagatgggcgcgaccctgaaggcgtcgctcgagcacccggaggtgtgctttctcaactgctcgctcaacctgccgcaccagagcgtgcgctcgtaccgcggccgcacgtacgaggccaagttcctgcttggggcgctcgccgcgtccatggcggagaaccacaaggtgggctaccgcgccgcctaccccatctatggctccatcgcggacatcaacgccttcgccatcggcgccgcgctggtggaccccaaggccgaggtgcacctcaagtgggccacgcgggaggggagcgactggcggcgcgagctggcggacgagggcgtgaccgtgctctcgggggccgactacgcacggccgctctcggacgacaacaagtacggcctgtaccgcatgcgagacggcgtggcgcagaacctggcgctgcccatcatgaactgggggcgctactacgagctgatcgtgcagagcctgctccagggcacctgggaggacgtccccaagacgagcgaggtccaggcggtcagttattggtacggaatgtccgccggggtcatcgacgtcgcgatctcccccgagatgccgtactactcgcgtaagatggtcgaggtcctgaggaatggcatcgtcaccgggaccagcggaccgttctacggcgaggtgcgccgccaggggggcgaggtcatcaagggacccggcagcccctgcctgtcgagcgaggagatcgtgcagatggattggctcaacgacaacgtcgtgggctcgctgccccgggcggacgagctcacccccgccgcgcgcgaggccgtgcgggtgagcggggtcatcggccgatgagggcgctcgtcgtctcggacgtggaggacaaggccctgtgggactactacaccccggggcgcgtgggggacgtggacctgatcctctccgcgggggacctggacgcggactacctggagttcctggtcaccatgaccaacaagccgctgttctacgtgcacggcaaccatgacacggcgtacctgcagaaccctcccgggggctgcatcgacgtggacggcggcctgtacgtgtaccgcggcctgcgcatcctggggctgggcggctccatgcggtacaaggacgcgccctttgagtacaccgagaaggagatgcgccggcgcatccgacgcctgacgcccaggatccggcgggcgggcgggttcgacgtgcttttgacccacagtcccgcagcgggcgtgggagacctgcccgaccacgtgcatcgcgggttcgagtgcctgggcgagctggtcgagcgctggaagcccgcactcatggtgtacgggcacgtgcacctctcgtacggggcaggcatggagcgcgagcacgagtttggctgcggcacccgcgcggtgaacgcgttttgcaagcactacctggacgtggagccggtgggcacgctgccgcacccgtggatggagcccatgatcaacgcacgctgcctgcgcgatggggagaagtccgcggaccacgggttcctgcccgggacctcgggcacggcgtttggctcgtacaaccagtggtagcgcctggggcaggcggggcggctcggtcgcaggtcgctcactggtctctgcagggcaagaccacttatgcagtattcaggaacatatgtcgggggcagacggcggacgcgggcgcaaggcacgcactggtctctgcaggtaataccactaatgcagtattcaggaacatataagaaaagttcgctcgaaagggtcgctcgggacctcttttatagcctgatgcatccttctgcatgctaccttgaatgaaggtgagcgtgtctcatatggctcccctcggggagggtgggatgccttgcctacgcggcttgtgggaagccgcgccatgagcaagaaggacatcgccatgagatctcccaaagggaaccagtcgccctcccggggcggcatcctgcggatcgtcgcaatcctcgcgatagcggtcgcagtgaccgtcctcgcgttcgtcccccgtggtgcgctcgcggttgccgagcagtcgggccagacgagcgattccgccgccgctgcagccctctccgatggcgtcgactcgtctgcgtccgacagtgcgacggactccgccacggatgcgtccacgacgtccgcgtcgtcctccgatgcggcggactcgtcggcgtccctcgcgaccgtgctggcagccagctcggggaccggcacggtgcagatccagtacgacgacacgaccgagatccattacgtgagcgaccccgacagcgccaacggtcgcatcatcctctactgcatgaacaacgcctcgcactggccgcacaccacgccgagcataccgaccgtcccctcctacgttcagggctatctcacgaagggcaagttcaattccgaggccgactacgaggcctgcatgaacaagctcctcgccatcctctatgccggctacccgtacaacggcctgaacatgtaccaggtcgtcgacacggtcaccggtatcaccgaggacgcgttcaacgagatgctcacggtgcccgacgtcctgcgcaccgactttcccgacaccatcggcaacgaggtgtattcctacgacgactacaccaccaacaacaccgatcacctcaacaggctcaacgagttcattcagtcggtgacgttgatgaagatccatggcacgacgtcggcttcggggctgacggcggaccagattcagtcgatgccgttctaccaggcagccctgtgcatggcatgggccagctcgtatggcacgacgccgctcggcatgtacgactcgctccataccggcgagtactacgtcaccgaggcgcaggcgtacgaggccacccagtacgccatctgggccgtgctcggcgactatggcatcgagtacaacacgctcacctcgaggagcggcgatgtgacgaacaagctgctcgccgtcaagctgctcaactatgccacggcagaccaggtcctgcgcagcgagcccagcgcggacgacgtctccatttccggagacgccaagttcgggctcttcgaacctttgggtgggtatcacgcctcgcaagactttgagccgaagccccccggcggtagcattcttcccatggaaggctgccgtctggaggcgcgcatggacgagatgatcgcgaggctctctcgagctgctacgatggggaccccggcagggagtgggagtcaccgacgtctggttcgaggagcgcgggggcgccccggacgagctgtgcactgagtgtcgcccacggcgagggcgaggccgtcggtgccccgtctcgccacaggcgctgcggcacctacgacgccagggagcgcacctggcgccaccgtggaatctggcagtacgagggacgatcgtccactgcgccgccgtccccagggccgactgcccgaggacggcgtccataccgtcaggatgccctggaggtgcggccgaactcccacttcacggaccgctcttcgagccgaggtcctcgtgatggccatgtcggggatgaccgtcacggagatagcgaagcgggtccgcgagcgcgacagaaggtgtgggcgatgctgggcccgcggcccgcgaggccagggaggccgccgaatactccggcgtcacgagggccggcatcgacgacacggcctgcaggcgcggccagagctactatccacgatggtggacctcgacggcgccagggtcgtggccgtctgcgaggggccgcgacaagggggcgcccgcgaggctcgcggcgcagctcgaggagcacgggggcgaccgcatggccatcgcgaggcacgcgtggacatcgtccgaggcctaccgcgctcggcgcggcggaggcgatgcccaacgccgccagaccggtgtaccgcttccacgtgatgcagctcttctgcaaggccacgacaaggtcccgctggccgcgagcgagtcctgcgaggagaagcggcgcctgtccggcggaccaagttattctggctgaagaggccggagaggctcacggagtggcagcgtgccagaaggagttccctcgcgtccgagcacatgctctgtgcccggcgtgcgccatgaccgaggcgatcgcgggccgtctacggcctgccccgacgggccttcgccgcctccgagctcgacaggctcacctcctggtgatgcactcaacgtggacgagatgaagtcgtggccaagaccgtgcgcaaggagcgcggagggcatcctcaactggttctacgaggaaacgccacaacgcgatcatggaggcctcaactccgtcatccgaatcaaatcaagagggcgcgaggggcttcagaaacacgtcctacttcgagaccatgatcttcctcaggctcggccgcctggacttctcggcgcagacgaccgtcgcatgcgctacccactagaaacgtcgaagagcccaagttcgcctacgaccccaacacgggcacgtggaagacgggcgccctcaagatcaccgagggcacgaactacaacggcaggtacacgctcacgctgcccgctggcgtgaccgcgcagacggccaacggcactgcggtcacgtcaatcgtggcgggaacgagcttctacctcgtctctcccacgaagcccacgtcgacggacatggaggtcaaggcggacgacacgctcacgtggctgcaggagtaccgccagtactctcccaaccccgagagcttcaccgcctccgacggcaagaacttccagcacatgatcggtgcggtcatcaagcagaagccggtgtcggcaaagctcgccctgtctcccgccaaggacggcggcctcagggtctccaagacggtgacgggcgaggactcctcctccacgagcttcgagttcaaggtgacgctgggcgacacgagcatcaacggcacctacggtggcatgaccttcaccaacggtgtggcgaccgtctcgctgaagtcgggcgagagcgcgaccgccgagcacctgcccgaggggacgacctacaccgtgaccgagaccaagaacgacgactacgcgtcgacctcccaaggcgccacgggcacgatctcggacgagacgacctccacggccgccttcaccaacgcgcgcctgtacaagctcaccgtgagcaagcaggtctcggggagctccgcgagcaagacgcaggcgttcccgatcaccatcacgctctccaactccgacggcagtcccatctccggcaagttcagctacaccgggggcaccgtgagcggcgtcgatggggccatcgcccccgcgaacggaacgctcacgttcacgaacggcacggcgacggtgagcctgtcccacggccagcagatcacgatccagggcattccctccggcgcaacctatacggtgaccgaggcggacggctcgcacgaccactacgacgtgacctactctgccaacggtgccgcctcgcaggactcggctcccacgggaaccctctcgggcgacgcgaccgtggccgtcaccaacaccatccgtaccggcagccttgaggtgtccaagcacgtggagggcgagttcggctccaagacgcagttcgagttcacggtgacgctcgacggaactggcaaggggctcactggcacctacggccacatggagttcacggacggcacggcgaccttccagctgggggacggcgagtcaaagaccgccaccgacctgcccgagggaaccacctacaccgtcgaggagggcgccaacatcaactactcgtcatcctccgagggcgcaactggcgagatccagaagggcgagacctcccaggccgtgttcaccaacaccaggcacggcctgacgctcccgctctcgggcagcacgggcatcggtgccacctacgtcgcgggcatcgccgtcctcgcgctcgcggcgctctggatgcacgcacgtcgcgctgccgccgggaagggaggtgaggaccgtgactaagcgcctctcctctcgcatggggcgtcgcccctgcctgctcgtgacgctggtcgtggcgctcctcgccctggccctcgtgccctccgcctcgtgggctagggccaagaccggctccctcacggtcaacgtggccgagggcagcgggtcgtcctcccagctcaaggcctaccagctgttctccgccgacgtcgccgacgacgacggcaccaacaaggtcacgtccaacctcgcctgggcgagcagctccgcccaggcggtcgtgacggcgcagatcaaggccagcgaccccacgttcaccgggaccaccgcgcaggagtgcgccgagtggctggacaagaacgtgccgagcgactcctcgtccgcctcgtccagccccgtggtcctggccatcgcgaaggcgatgatgacctccagcgccaccgccgcgagcgtgacggcgggggagacgaccgagctcgccgagggctactggctcctggtgagcgacgacacggccgtgggcaccggccagtcgggcacctcgcccatcctcgtggtggtgggcggcctgcccgtgaccgcgagcaccaagtcgtccgtccccaccgtggagaagaccgtgctggaggactccaccgacgcctggcagaagcaggcggacgccgccgtgggagacgagctcaactggaagctccaggcgaccatccccgccgggatcaaggggtacaccacctacgggatcacgttccacgacacgctgcccgcgggtctctccactccttccagcgtccacgtgtacgttgcggtggggacctcgggcgacgagtgggagaagggcgtctcggcacccgacggctggaccgagctggactcctccgagtacaccgtgagcagcgaggcacggtccgcgggctccacgctcgacgtgacggtgaccgacctcgtcaagagcgccgccgcccacggcatggacttctcgtccggcctccgcgtggtggtcacctacgacgcgccgctctcggcgggggcgggccgcggctttgacgcccccaacgtcaacaccgtgacgctgcgctacccgcgctcgccgtactcggacacgtatgccgagaccgaggagagcacggccgtcgcgtacacctgggacctgtcgctcaccaagcgcgactcgtccagtgacgccaagctggccggggcggtgctgcgcatcacggacgaccgcgggcgccacctgacgcaggacggtatctggaccacgcaggacgccaccgtcaccaccgacgccaacgggctggtcaccgtgagtggcgtggactccggcaccttcgacgtggaggaggtctccgcgccccagggctacgacgccttcgccgggtccaggcggatcacgctgtccgtcacgctcgaccccgaccagatcgtgagcggcaaggacaagacggcgaacgaggcgggcctcaaggcggtgtcgccgctgcgtgtggactccttcgacgcgtacgccggcacggcgcaggtgtccgtcctcgacgacgccacgcccaagacgccggcggggaaggtcgcgaaggggattgccaaggccgtctcgtcgatgctccccaagacgggggatcccacgtcgttcatccccgcggcgctcctggtggtggcgggcgtcgcggcaatcgtcgcgtcccgcaggctcagggggaggggtgacggcaagtgagaggaacgtacccccttggcccgcccggtgcaccgccggggcccgcgtgcggcgactcgtggtcgccggggccggagccctagcgcggacgagatgggaaccaacggccgacggggcgaccagcactgactttattaaagatgccaagcctaggagaaggggcagagcgcatgaagaaggggaagaacctggccaggatcgccgttacggcggggctgacgatggcgatgacgctgggaggcgtggcgcttccggcgacggcagcgttcgcggcgatcaccggcaacgtgaccatcgataagaacgccaacaacgacgcggacgcaaccaccacgttgggctaccagatcttcaagggtgacgtggtggacagcgggacgtccaagaccgtctcgaacatcgactgggcgagcgacgaggtcgggacggtggtcgtcaaccagatcaaggcgctggacagcacgtatgccggcaccacggcgcaggatgcggctgactacctgagcaagcacctgccggccgagggcagctccggcaccagcacgatcatcgagagcaacaagctctactcaaacatcgccaatgcgcttcgcgccgacacgaccctcacgccgaccaagctgaccgccggaacggcgagcaacctctccgccggctactggctcttcctgaccgacacgacgtcgaccgccaacactgactctgcgtccaaggtggaccaggtgggctccgcccccatttacgccgtggttggcgacggtgaccttacggtctcgcccaagtccaccctccccacggtggacaaggaagtgaagaacgacgccactggctccgattggggcaaggtcgccgactccgaggtgggccaggacctgcagtaccgtctgaccggcaccgtctccgacgccatcccgagctacgacacctactactacaagttcacggatacgctctccgccggcctcactgccgacacgtcgagcgtcgcggtgacggtcgtgacgaacggtaccacctacacggtcgcatcgggttcgtatgccactaccctgacgagcaacactgacggtacgagcacgctcggagtggagttcagcgacctcaagacgatcaaggattccaacggtgccacgattccggtcaccggtgcctcgaaggtgtacgtgacgtacaacgccaagctcgacgcgagcaaggcgttcaaggtggcaagcgagcgcaacgacaacaccgtcaagctcacctactccaacaacccgggcaccgacagcaagggcgactccacgccctcgaccgtgggtgactacaccttcaagctcaagatggacaaggtcgacagctccgataagtcgaagaccctcaagggggcaaagttcaccatccaggcgacgggtgccgacgagggtgccggcaagctgtacgtccagaaggacggtacgctgggctccaatccctatgagttcacgacgacgaccgacgccgatgggtacgcctccatctccgtgtccggcctcgacgtgggcaagtacacggtggtcgagacccatgcgccgagcggctacaacaccgtggggtcgttcgacttcgagatcaaggccacgtacgacagcactggcaagctcaccaaggtcgaggcgagcaccaccaacgccaacgccgccgatgcgtcgaccgacaccaccgggttggtcaccgtcacggtgaaggacaaggcgggcatgtccctgcccctcaccggccaggcgggcgtgactgccacctggattgccggcggcatcgtcctcgccatcggcgtgacccacctcgtccgctcccgcagggagaacggctccgaggagtagccgacagcgcctctcgcccggagggggttccggagtaccgggaccccctccttttgcgtgggtgctgccgctacagcgtgatgctcacgttgagcgaggcggcggggtcgctcgcgcacccgagcgcctcggcaatccgctccagggggaacacgtgcgtgacgatcgaggcgatgtcccagcggcgcgaccccatatcgccatcacgtcgcggacgtcctcggggaagtagccgcccgagcccacgagctcctgctgggcgtaggtcatgcgcagcaggtcgacgctgcggctctgccttcccaccgcgaccgcgaccatgcgactcccgatctttccgtgcgcgaggaagtcgtccagcacggagtctgcgcccgccgcgtcaatccacacgtcgacgttggcggtctggccgtcgagcccgcgggccgctccaaactccttgcgggcgcgcgccatcgcgtcctcgcaagcggggtttcacgtggggaagccgagcgctgcggccttctgcaggcgcaggtcggagaggtcgcacaccagcgggggctcggcgccaaaccacgtgagcgcgatggcggcggggatcccgatggtgccggcgccaaacacgatggcgtgcgtgccctcggagggacggccacgcctcgccgcgcggcatcccactgtgaacggctcgatgaggcaggcgacctcgtcggggatgctatcgggcaccgcccagagcgacacgttgcgccgcgggctggggcacagcacgtactggctgaatgccccgagcgtccccgcgcgccgcgggtcgccgcgggcgaggagcgggtaggggtacacgcgctcgccgacggtgaagtcgcggacgttctcgccgaccttcgccaccaccgaggtggtctcgtggccgaactcgcctcccacggtcaccctgtggcccgtgttggggccgtgcgtccacaccgctgcgtcggtgccgcacacgctcgacctgacgttgcggatcaggacgtcatccggcccgcaggtgggaatgggcacctcccgcacctcgacgtcgtgcctgccctggtatatcgccgagagcatcgtcgcgccctcgttcctctcgcccgtgttcatggtggcccccatctggtcggcttccgtttgctggggtcatgttcctctccgcgatgactcggtacaatcagcaaaacaccgataagtatcgtgttaatgggaggccccgtgaacaggcggaacaacgcgaggtatcgcgcgaacgagacgcgcatggaggcggcggcgctcgagttgatgcgcgctcgtgacaaggtcaacgtgcggaccgtgtgcgagcgggcgggtgtcaaccggtcgacgttctacgcgcactttcgcgacgtgtccgacatgctcgcgaagatggaggcgacccttcacggggagctgatggagtcgtatgggggcctggggaccgagccgctgagcgaggagtcgtttgtcccgctgctggagcacgtgcgcgagcacgcgtacttctacggcgtggcgctggagcgtcgggtcgacttccccatcgaggaggggtacgagggcctgatggaggcggtcgtgcggcctcgctgcgagcgggcggggatcgacgaccctgaggagatggcgcgcatgctcgtcttcttccaggcggggtttacgatggtgctgaggcggtgggtgtcccgcgggtgcagggacgatgtgcgttccgttgcgcggacgcttgcggcgtgtgtgccagcggcgtggacggtagacggcacgcgtgcggtgggggagcgggcgcttgcgggcggtccgggtggggtcccgggtgggggctgctgaggaaagtggagtattggcaatccgagggtggctcccgctgaggaaaagcgagtattggcagcggatgggcctttcgtgggccctttaggcagccaaaggtcgcgattcccagacttccgacgggtccggattgccacaactcgatattccgcagcagccatcgccctccggggtccagttcggggttgttgttgtcggcatttcctcggcgggactccggctgggcgaccgtcgccagccgaggccaaagaaggggcgggctggtagggacacatgcccgggcgatcccgtgccgcgttcggtggttgtcacgttcgtcctccgacccagcacggcggcgaaggccgtcgtcagcagtcgagccatggcagcgagctcctgatgtgagcggcctgcgttcacggaccccggccgactgcctggagtttccccagttgtccggctgccaaggcggtgatcctggcagcaagctcccgacgtgagcactcatatcgggattcccttgccatttgggctagagacggggtcgggatggcagcaagctcccgacatgagtgctcatatcaggctccccttgccaccggaggggtcagccatggacgggcgactgacctacctgggcaaacgtgcggacaccctgggggcacgccgactgccggtaactcgagaccgctcacatcgggagttcgctgccatccccgggggtcgaagggccgcgagaagggggctggccaccgagggcgccccgccctcttctctgcctttggagcggcagcccccatgccggcgatcgcgtcccagggactgtagctgccacctttcaatgagcccatctcccgaatggccttgggcaagtctcccgtccgtctcgcccagccggcatcgcaaacggtgccacgcctatacttagtggcgcccaacgtgaccggcgaagtgagggggagggccatgccgaaggcgaacgccacgacggagctggaacccgagcgcctgaccgaggagctgctcgagcggctgctctccagtaccagcatcgagtcgtacctggatggacccggcgtcgtggaccgtaccctcgtgtcgtacctctcgcagctgctggcgagccacggcctcacgtgtgcgcaggtcgcccgcgcctcgggcatcaacgccacggtggtgtacgacgtgttctccggtaagagccgccccggccgcgaccatgccatcatgctcgcgctcggcctggggtgcgacctgcgcgagacccagcgcctgctgcgccttgccggcgtctcggagctgtggtgcaaggtccgcagggacgcgattctcatctggtgcgtggagcacggcctttcgcgcgtgcaggcagacgacgagctgtggcgcttcggcgagcggaccctgcttggcacaggaccgctccgcgcccgatagcgccgccgactcagctgccaactgaggaacggggacccgctgctagtatcatctgggactgggcgcgcgtccccggcgggaccgcagccctcccttgacccctgcgcaggcggaactcttggacccgaggacaggcgttggacgacgagcaggtgcttcatgccatgggcttggacgacagctatcgcgtggagcgcgtgcttgccgaccacccctcgggcgtcacggagcttgtgaccctggacggcgccggcccgttcgtgcgccgccgcatcccgctcaagatcgcacgtcgcgacgtgtgggcgcgcctgggcagctgcgacagcccccggctcccgcgcgtgcaggcgacctacgagctgcccgacaccttcgtggtggtgtgcgactacgttcccggccccactctggagcagctggtgggctcgtcgggcccgctcgacccgcaccgcgcgtgcgaggtcgcgctcgacgtgtgcgaggccgccggagagctgcacgcccacggcatcgtccaccgcgacatctcgccgggcaacgttatcgtggcggccgacggggcgcacctcatcgacctgggcatcgcccgcctcgtggtggagggcgccagccatgacacgacagccctgggaacctgggggttcgcctctcccgagcagtacggctttgcgcagacggacgcccgatccgacgtgtactccatcggacggctcctgggctacatggtcacgggtctcacgccggggtcggacgactacgaggcggcgcttgccgacggggagagggtcccggccaacgtgcgcgcggtcgtctcgcatgcctgtgcgttcgagccgagcgcgcgctaccagacggcgggcgagctctcgggggcgttgcgggccctcctgcgcggggaggacgtggcccaggctgccggcggggagcgcccggggcgggtggacgcgagcctctcgcccgaggctgacgtggcggaatccgagcagtcgccgggtgcccccgtgccgcctggtgcaggggagagggacggaggctccggtgccccgagcccccaccgccggcgcatcgtgggggtcgtggccgcggtcgcggtggcggcggccgcagcgacggcgtacgcggtcctctcgccccggacgttggatggcggcgcctcggggtctgcgtcgtccgtctcctcgtccggcacgtccgcgtcggggtccgatgcctccgccgcgccttccgtaggcggggccgactcggcgtccgggacggcggcgagtgcgggctcgtcctccccgacgtcgacgacgggcaagagcatcctcgagtctgacggcgacgtccaggtgaccgaggccggctggtacctggcggacggcaacgtggtcaacgtggcctatggggtccgcaacgcggggtccaagaccatcctgtatccctcggtcagcatcacctgcctggatgcggatggcaaggcgatcgcgacgacgcagaccgcgctcatggccgtggcaccgggccagacgctgtactttgcgaccttcgtggacggcacggacgaggcggggagcatcgcctcggtggagtttgctgccgacacccagggcatgggcgccagcgtctccagcctcgtcccgtcgcggtacgccaccgcggacgtgcgcgagcgctcggactcctcgggtgccaccatcgtgaccggcacggtgaccctggacagccaggggacggacgagacggcccagggctcggcggtgtgcgcggtctatcgtgccgcggacggctcaatcgtgggcggcgacgtggtcttcgtgggcatgcccacggcatccgaccccgcgcgcttccagatcgaggactacggggtgcccgcgcatgcgtctgtggacgtgcaggcgtacccctggtaggagcgcagggcttgagccggggcgtcccctgtgggcgcgggttgttcgcttgaggtgcgagttcgcgcgtagccgacagccgcgtggcatcgcgcgtgggcgcgagagccgcggtggggtcggcgcggcttccgctcggggtgagtttggctcagctgcccccatgggggacacgtgggtacaggtgtcgcacgcaggggagacgtgccacggccctacaggcccagcacgtctcgcttcttggcgtcgaactcgtcctgcgtcaggattccggcgtccagcagctccttgagcttcttgaccatctccacgcgctggtcgaaggagggaccatccgtggtcgagggggaggcggccgactccgacgctgccggcatcccgccttctaccggcgccgggtccgcagcccgctggtcgcccgctgccggcacgccgcccgcgcccgtctcgcctgccgcctgcgcgctgcccacagtcggaatcggcgccgcctggccgcccgtcgggacccctgccgtgcgcgggtcaagccccgacgccaggttcatgccaaacagcatgccgcccgcgtctcccaggccgttctcgcgcacgccctcggcgatgagctgctgggcggagatgtctgccgcctgctgcgacacgccctcgtaggcgcggacgcccatcttgcgctcggagaagccgcgcaccagctcgcgcgactcgtcggtgaactccacgtcctcgatgcccaccgacaccagccggaggccaaagcgctcctcccaggtgcccgcgttcctgtcgtccgtcaccacctggtctgcgatgcgcgtggactcgcccggcagctgcgagatgcgcacggacgccgagagcctgttgatcgcggtgagaaacgactgcaggaactcgctggtcagctgcccgcgggccttggggttgtccaggctgtacgacgtggcgttggcgggcacgaacgaccgcacgagccgctcggggtccaccacctgcacgctgaacgtgccgtaggcgtagacctccaggtcgcagccgtagaaggcgtcgttgtaggccaggggcccgtgggtcccgaacttgatgccgcggatctcgcggaggttgacgaaggcgacgcgcttgctttggggcgacatgcccgagaagcccacgcgctcggcggcctggtccaggatgatcttgcccaggcccctctccgcgcggtccttggcgtcgaagacggtcgcctcgccgtcgcggtactcgtagccgcccggctgggagatgacccgctcgatgcccgactggctgaacacgaacgccgccgtgccctcgggcacgtagatcacggagccgttagtgagaatgtcctcggccccccggtttgcgcccctgccgttctgggaggcgcgcctcacggctggggcgaccaccgtgtgctcgtcgaagtggccggcggtgatgacgtccttccactggtcggacagcacgccgcccagcgagtcaaacgcggcatcgatgattcccatggcagttcctctcgcctagagcgtctgtttggtgtcgcagtacgggcacgtgaccacctggccagcgcggcccgtgagcggggcgtggcagcccatgcagcggatcgtgaccatctgcgggcgcgttggctccgccttcgccctgtcgcgcctggggcggatgcccagcgcctctctcgcctggtcgatcatgccgacggctgactcccggcccaccgcgttggtgtcgatgcccgcgaggtcgcccgtcgccgccatggagatggcttccgcccagcgctgggcctccacgcgggggacgccgcgcatgaccaggcggaccggctcgccgccgaacatcgcgttgaggaggaagtcgcttcccgacttggacacgatcacctgcggcacgccgttgtcgtccggcagctggtcgagggggcagcgcttgaccatccggtgcttgccgtggaacaggccctggtccacctcggccaccaggatcaggttcttgttggtgaggacgacctcgcgcaggtcgtccgtgccgctgccgctcagcaggctcgcgcggttggtccccatgatcacgaactcgtccggcgtcaggttgtatgcgtccactggcgtgcctcccatgcttggtccaagggccatgctagctgggacgaaggcgatttcctcagttgccagctgagacgcccgccgaattcagttgccagctgaggaatcggcttcacccccttttcagaatgtgtctcgtcaacaggcataagctgcggaaaggagcccacatggactgggaggtagctggaaagccgggggagcaggggacttccgacggcggggtgcccaagccccgcaagggtgggaagggcagggtcgtgctcatcgtggtggtggcgctggtggcggtgttcgccgtcatgaggtgcacccggccgtccaacgacgcgtcgtccaagagcctggactggccgacctctgggctcgccacccggctgcccagccccgacaccaacaagggcgaggtcaccacggacagcgacacgatgctcagcgcgacgctcgcggggtacgacgacggcaagtacgacagctacgtcaaggcatgccaggacaagggcttcacggtcgacgagaagaaggacagcgcgtcgttcgaggcgtacgacggcgacgggtatcacctgcagctctcgcacttctcgagcaaggaggagctgtcgctgacccttcaggcacccgaggagcttgggacgctgacctggcccaagtcgggagcgggttcgcaggtgccggcgcccaagtccaccaaggggaagatccagaacgactcgtccacgtacttcacggcgacggtgggcgacaccccgaaggacgactacgcggcgtacgtggagtcgctcgtctccgccgggttcaccgtggactactccaagtccgacgcggtgtttacggggaagaactcttcgggagtgaaggtcagggccgagtacgcgggcaacgagctcatgcacgtgaccgtctcggtaccggatgacgccgctgccaccgacagttcggcgggcggctccgcgaacgcctcggccacgtcgagcgcggactcctccgctgtgaccgccagcttcaaggagacgatggactcctacgaggcgttcatgaacgagtacatcgacttcgtcgcgaagtacaactctgccagcgccgccgaccaggcgtcgatggccgccgactataccagcctgctggccaaggaggcggactgggtgacgaaggtgtccaacctggacgacgggtccctctccgcggccgacgcggcctactacgcggaggtcacggcgcgcgtgtccaagagggccgccgagctgagcgtgtcggtgcagtagcgaggttgccaggctcgcacgagccgcccgtccgcgtccccggggtcgtggatgggcggcttttcgctgtgcgcgatcgggtttggagcggtctgcgacgaaggctgctgaggaaagtagagtattggcaatccgagggtcgcttccgctgaggaaaggcgagtattggcagcggacaccccctctcggctgccaaaggtcgcgattcctaagcttccgaccggctcggattgccaatactcgacattcctcagcagccacttcgtccgagttccgtccggggccgccgcggctcacgtttcctcgacggggatcccccacagttggccgatggcttgggcgcaaggccgcgctccccgcgggacctttcctgccggccaaggtcagagaaggggagtgggttggtaggagaacgcacacgcgagtgctcacgcgtggtgcctgctgccacgggctggggaggggagctgtccaccatccccttcgcttacgcaaactcagtaacgctcttgattggctcgtgtggatagctcccaacatcactcccgtgaggcccctctgccagccgaggccaaagagggagagtgggctggtagggggggcagatgctcgggagatcccgtgccgcgtacggcggccgtcacgttcgtccgccggaccgaccccggcagcgatgacgcatcagcaatcgaaccatggcggcgaattcccgaagtgtgtactcccaggcccctaatcccgccgatggcctggcatttcaccggctgcctgactgagacggccccagcgatggcagcaaactcccgacgtgagtactcatatcgggagtcccctgccatttgggccagagaagaggtcgggatggcagagaactcctgaggtgagcactcacatcaggagtttgctgccactggagggaacatcctcggtcggacgattatcctacctgggcaaacgtgagggcatcccggggtcgaccggcagccgccttcccagaccgctcacatcgggactttgccgccagggacggatcgttcccaaggacccggggaggggggagggcgtggttgccgagggcgcccttcccttctctgcccaccgatggccttcgctccgccttggtagcggaacgtcgggctgcctgtcgggtgggcggcggcaagggggctcgccggacaatgcgcgctgaacgggtggtttcgcggcggcatggcaccatgatggaggcacattgggcccgctccatgtctgaaaccccgtcccgcgtgtacacatgggacgcgctttctggcggcagccagtcctccgtgggtctctctgtctaaaacctcgtctcgtgtgtgcacgtgggacgaggttttagacagagggccggcaagaaggacggcagccggccgagagggcgccgaccgccgtccttccatgagctcttgaacgtggccaggctgcgcggggcgtgcgggcgcgtgggagcggaaggcccgtgagccccagtgccgccatccccacggctggccgcaaccgcccccacctcgcgcctaatccagctcccgcttgcccgtgtacagctgccagtactccccgtgctgggcgaggagctcctcgtgcgtgccgcgctcgacgatgcgcccgtgctccagcaccatgatggcgttggcgttgcgcacagtcgagagacggtgggcgatcacgaacaccgtccgcccgcgcatgagcgcgtccatcccgcgctcgatgagcgcctcggtgcgcgtgtcgatggaggacgtcgcctcgtccaggatgaggacgggcggatccgacaccgcggcgcgcgcgatcgcgatgagctgccgctgcccctgcgagaggttggccccgtccgacgtgatctgcgtgtcgtagccgtgcgggagcctccggatgaacgagtcggcgttggcgatgcgggcggcgtggcgcacctcctcgtccgtggcgtccagcttgccaaagcggatgttgtccgccacggtgccgctgaacaggtgcgtgtcctgcagcacgatgcccagcgtggagcgcaggtcagccttgcggatgtcgcgcacgtcgatcccgtcgtaggtgatggaccccgaccgcacgtcgtagaagcggttgatgaggttggtgatggtggtcttgcccgcgcccgtggagcccacgaaggcgatcttctgccccggctttgcgtagagcgtgaggttcgcgagcaccgtctgcccctcctcgtagccaaaggtcacgtcgttcaggcgcacgtctccggcgagaggtacggtgccgcctccgggcaggacccaccgccagccggcggcaccggccgccatgcgccgtgccccgtccctctcgcccgcctcgtccatgcgctgcaccactgctttgccctggtcgacctcgggtggcagctccatcacgcggaacacgcgctcggccccggcaagcgccgtgagcacgaagttgcccagctgcgtgagctggttgatgggcatggccgcctgtcgcacgaagaccaggtacgaggccaggctgcccacgtcggtctgcccgttgatcgccatgaccgcccccagcacggcgaccgccgcgtagttgacgtagccgatcacgacggtgctggggaccatggtgagcgcgtaggcctgggcgctcgttcccgtgcggcggaggtcctcgttgagccgacggaatcccgcgaggttctgcccctcgtggttgaaggccttcacgaccttctggcccgagatcatctcctccacgtagccgtccagcgcgcccagggtggtctgctgcgcggcgaagtagcgcttggagcgcgcgcccgagaagcgcgtgtacagcacgacgatggcgtcgcaggcaagcgtcaccagggtcaggcgccagttgagcaccagcagcagcgcgagcgtccccacggtctggatcgccgcctgcatcatgttggcgaagctgttgttgagcgcctcgctgatggtgtcgacgtcgttggtgaagtagctcatgacgtcgccgttgcgcgtgcggtcgaagtacgagagcggcagccgcatgatgtggccaaacaggtcgcggcggatgtcgaacacgatgtgctgcgcggcatgcaccatcacctgcgtgtacgcgagcgcggagaggaccgcgaccccgtagatcgcggcagtgatcgccacgtcggcagagaagcccgccatgtcccccgcggcgatgcggttgaccaccggcttgatcatgtacgttcccgccaggttgcccacgcccgcgagcgtcaccagcacggcgacggcgagcatgtggaacttggcgtgccccatgtaggagacgaacctcctcagggtgtggcgcatgttctgcgggcgcgccccgcccgatgccttactctgcgccattgccgtcctcctgggtcgcggtctgcgagtagtagagctcctggtagatggggtcgctggcgagaagctcctcgtgcgtccccgtggcgtgcacgtggccgtcgtccaggaccacgatctggtcgctgtcgcgcaccgagctcacgcgctgggcgatgataaccttggtcatgtcgcgcacctgtgccaggcccgcgcggatgcgggcgtcggtggcggtgtcgacggcgctcgtggagtcgtcgaacaccatgaccttgggatgcgagaggagcgtgcgcgcgatgcacaggcgctgcttctgcccgcccgagacgttgccgccgccgtggcccaggtccgcgtcgagcccgccgatgcggtcgaggaactcgtccacgcacgccagccggcaggcgtccaggatctcttggtccgtggcgtccgggttgccccagcgcaggttgtcgcgcacggtgccggagaacagcacgttcttctggagcaccatgccaacgccggcgcgcagggcgtgaacgtcgtagtcgcgcacgtctcgcccgcccaccaggacggcgccctcggtggcgtcgtacaggcgcggcacaagctgcacgagcgacgacttgcccgagcccgtgccgcccaggatgcccacggtggagccgggggcaaagcgaagggtcacgtgctcaaggacgttcctctccgccgcggggttgtacttgaacgagacgtcgcggaactcaacggagccgtccgccagctccttggcgcccgcggggttggggtccatggcgggctcctcgcgcagcacctcgcacacgcgcccgatgctggtgatggcgcgtgcgagcagcaggaacacgctcgagatcatgttgagcgagttcatgatcagcagcacgtagctcatgaagccggttagcgtgcccacgcctatctcgcccgacgcgaccatctggccgccaaaccagaggaggccgacgttggcgatggccatggcggtctggaacacgggcatgttgaggacggccccgccaaaggtgtgggtcgccgtgtccgccagcgctgtgttgacctgctcgaagcggtcggccacgtggccctcgcgcacgtacgccttgatggcgcggatggccacgaggtcctcctggagggtctcgttcaggcggtccatcacgccctgcagcaccgcgtagagcggcgccacgtggcgcacgatcagggccagcgccaccgccaggaacggtaggaccacgaagaagaccagtgccagcctggcgctcatggtgcaggcaaggaccaggcccgccactagcatgaccgggctgcgcaggagcggtcggatgcccatcacgaaggcgttctggatcaccgtgatgtcggtggtgaggcgcgtgaccagcgaggacgagtcaaactcgtccaggtttgagaacgagtagtcctgcaggtgggcgtactcggcctcgcgcaggttggcgccaaagcccatggcggcagcggcggagaagcgcgagtaggcaaagccgcagacgcccgcgaccgcggcgaccaccaccatctggcggccagtcgccagcaccagcgagaggtcgccggaggcgatgcccacgtccacgatgcgtgccatgaggaaggggatcaccagctcggcgatggtctccacgaagatgagaagcgccgccaccagcaggtgcaggcggtatccgcgcaggtagcgcgacacgtagcggaggtcgtccatcacagcgcctccctgtcgggcgcggtgccggtgttggcgcggcgcaggttggcgtggatgcgggtgaggtagtcctggaggcgggcgacctcgtcgggggagaagcccgcgagcatgatggcgctctcctcgtcgcagcagcggtcccaggcggcgagggcctccctgccggcgggtgtgagctccgcgagccgggtgcgacggtcctctccctgcgtcatgcgcacgaagccgctggagctgagcgacgccagcatgcggctgacggcggcggggtcgagctcgaagtactcggccagtgtgcgctggctgcaggggccgttgacccagaggtagcccaggatcttgggctggccgggacccaggccgatcctggccatgcgcggccggaggtagttggtctgcgcgtggagcgcgcggtagagcatcatgtgcgtgtcgctgagggagcgtccctccgccggcgcgctgtcttggttatgcatagctcatccccttgacatgtcaactgtttgtcggtggttagcctacgccaatcggttgacgtgtcaaggttgatatgtcaatgaaattggggacgcgcacgtggggcgtcggcgggggagtgccgcggcggagtgctgaggaaatgcgagttgtggcagcgcgggcgccgtctggacgccgtcccgggcggatgggcgcctaggaacgtggggtattggcaatcggagggcggtttccgccgaggaatgtcgggtgttggcgggcggaggaccccctcccattgccacaggtcgcatttcctcagcagccgacgggctacgattgccacaggtcgcatttcctcagcagcaccgcgcgccgacgggcaaagggagcatggggggaacggtgtccgagcggcgcgggtcgcggagggtgcagggcgtttggggtttcgatacccgcgcgctaggtgccacgccggacgaggggtgcttagaaaggtcggtgccagcacgggctgccgccggcgtgtgcttagggatcccggcaccgggcgggctttggcatcccggcgggtgtgggcactccggaggccaaggccatgcgcgagaagcgccgcgaatataagtacggcaaggcgtgcccgtactgcggcgatacgtgaccgtgagggacatccacgtggtccaggggagggggcgctggctttcgggagctcgggccgctggtgccgcgccgtgtcagaagccttgtcccccgtgtacacacgggttgggttctctgatggtagccttccttgagttccctccgagcagttcacctgcccggtggctcgaggctctggggtcgattcggggaaagggccctcgatgggcaaagaaggggagagggacgtcaccccgcaggtcacggtcgtcccacggctggttcgttttcgcatcagcctcagctcgcttggcagaccgtggagcgggggcgctccacggtcccgtccgtgcgcgggcgtccttgccgagatgtccacccagccttacgttttcccaaccataatatcaagagctgaaccatggcagcaggagcccgatgtgagcgcccttgcggcgggcgtcccgacgcgaggggtatcggacacgacatcgtcgcaggtagattgggcgagagggtctgccgcccgtaaccggtggcagcggatgcccgatgtgagcactcacatcgggattcctctgccagtcgccctccattccggccccaaatggcggcaaactcccgatgtgcgcacacacctcgggagtctgctgccaacgcttcgatcatttatggcctatcagctgggcgaacgtggtgtcggccggtccccgcggcggcgggctcgcgatgtggcactcacttcgggcacttgctgcaaaggttgcgatattgatgacaattccgacgaagccccgccccgccggggtgtatcggggctgaggatggcgaacaggtgcggccgcggggccagggccggcgaaccggtgcggccgcggggccagggtcgactgcccgcccccgcacggccccgaccgaggtgcccccacgcgtcccctccgccagccccccatgcggtggctcgcctcccacgccgatgccgactctcgtctcaccagccatgcacccagcgcatgcagcctttacgacctcgaatcgtctgcgcacctctcgcccccatagaatctaggtcgacggcgcaagacgaaaggaagcaacatgatcgacttcaagatgaacgacgggcacaccatccccgccatcggctacggcgtgttccagatgacctccgccgaggtcgaggagcacctgccccaggccatcgacgccggctaccgccacatcgacacggccaacgcctactacaacgaggtcgccgtgggcaaggccatcaaggcgtccggcgtcgcgcgcgaggacctgttcgtgaccagcaagctctttccgcaggactacccgtacgagaagtgcaagcgtgccatcgacgacaccctccagcgcttgggcctcgactaccttgacctgctgctcttccaccagccctacggcgagtacgtgagcggctggcgcgccatggaggaggccgtgcgcgagtgcatggtgcgtagcatcggactctccaacttcaccaacctggacaagctgcaccaggtcaccgacgtcgcgaccatccagcccgcggtgatgcagatcctcatcaacccgcactggaacgcgcacgagtacaaggctgccaccaaggacctgggcatggtgttcgagggctggtacccgctgggccacggcgacaagggccttctcgccgagccggtgatccaagagctggcggagaggtacggcaagtcggccgcccaggtcatcctccgctggcacgtgcaggagggcaacgtcgtgttccccaagacgctcaaccccgtgcacatgcgcgacaacatcgacgtcttcgacttcgagctcgcagacgacgagatggcccgcatcaacgcgctgccgcagaactgcccctacgtggtgcccgacgaggcccccgcgtgggtctggggccccaacgactactccaagcaggcataacgcaagctgcttgccacgcaggcaggtgagaggagcgtagccttccgcttgcggcccgccccccctggcgtggcgggccgcctcgcttgccgtgcgttgcgggggggtgcgccccgtcgcgttgccgttgacgggtgcgtcccgtcgcgttgccgctggcggttgcgcccaaaggtcggcctgcttgtcggtggcggtgcctactctccgtcgcccgagcggtgctttcccgttcgtccgtctgcggacacgtttgcgccctccatccgcaggagccgctccttgcggtcgatgcccgccgcgtaacccgtcaggctccccgacgcgcccacgaccctgtggcagggaaccatcaccaggatggggtttctccccaccgtggagcccacggcgcggggcgactccgtgcggccggttcgggcggagaggcgtcgtgcgacctccccgtacgtggtcgtgctcccataggggatggtgagaagctcgtcccacaccgcctgttggaagggggtgccgacgggtgcgagcgcgggcggctcgccagggttgacgccggagaagtaggcgtccagccaggctgccgcagcctcgagtgccggcgactccccgggttgtgcgggtcgcgagtcgcccaggtgggcccggtcgtgcctctgcccgtcgaaccacgcgccgacgatgcggccgtcacgctcggcaagggtcatgtgacccagcggggattcgaatccacaggtcagggtggtgatggaatcgtcgctcgcgcgttgtgccgccctcggggctaagacgtctcttcccggtccgtttggctttcccgaagccgtgtcagggctctgccccggcatgaacggaattccctccgcctcgttcatggtgacgcctccgctcgtcccatgtttcctggtggtcccatggaaccacgctgggagaccgaattctagccagaatcggacacccacaatgtcacgcacggcagacgggaccaccctagctggatgagctgctgagaaatctcgagttgtggcaatctgaaagccgattccgcctaggaaagcggagcattggcggcccagggtccgtcccaggggcccgcaacggttccattaccccacccagacccgtcacttagcgtgcattcgagcgccccgattgccacaactcgcatttcctcagcaccctgtgactgtcaggactactggcgcgcctggcactcatcctgccccctccttggctttggtccaccggcgcgacgatgtgaccacctacctattggagacgatgctcaaaatattgcaagaatgctcatacacgagccgtttaatgcacacttaacggagtgagagccatctccgaaacaatcaggttgaacaatactcatagagatgacgtctgcatacgtctcaacatgtggtaagacgtctccattattgggcggcattcatgttggccaaacactacaaccgaacggaggaagcatgaacgacctatccagaaggggcttcatcaggcttgcggggctgggcgtcgtttccgtcgccggaatgggtcttgtgggctgcggctcaacgagcggcggcagcacggactcaagctcctcgtcgtcgggcgagaagtatggcaagggcttcgttctccgctatggcaccgactgcgattacccgccctacgactgggtccagagcgacgattccaacggcgccgttcccatccaggatggcagcgggtactgcaacggctacgacaccaaggtcgcgaagctcatcgccgacaagtacggatggacggtcgaggtcgtgaaggtcgacttcgatggcctcatcgaggcgctcaaggccggcaagtgcgactgcgtcattgacggcatgggcgtgaccgaggagcgcaagaagtccgtcgacttctcccactactactggacgagtagccagggcatcctctgcctcaagacatctaagtatgccaaggccacgagcctggaggacctctctggtgccaaggtcgtcgcacagctgggctccatgtgggagtcgatggtcgaccagatccccggcgtcgacaagcaggacgcgattgcggacgaggcgacgattctcgcggcgctccaggcgaacaaggtcgacgcgaccatcatgggcgagaccgaggcgaagtccgccatcaagacgaaccccgacctcacgttcgtgagcttcgaggacggcaagggcttcaccgtggacgagtccgactgctctgctggcatcgccgtcgcaaagggcaacaccgagctcctcgacaagatcaacgccgtggtcgacacgctgaccgacgaacagaaggagaagctcatgaacgaggccttcgaccagcagcctgcctcgactgtctcggcgagctagcgacgggggagaggggcgcccgccccgctgccaatacgcaagatagggagaggaacacatggatagcactcccacaacgttctttggctgggtggcgtacctgctcaacgagttctggccgcgcttccttgccggtaccgtcaacacgctcgagattgccctcgtgggtacggtgcttggctgcgccctcggctttgtggtgggcatcgtccagagcatcaaggtcgactcgcatgcctcgcccgtctcgcgtgccctggtcggcctgctcaaggccatcgtggcaatctacgtcgagatattccgtgggacgcccatgatggtccaggcgatggtcatctactacggttctgccgagatgtacggcctggacatgaacacgttcttcgccggcatcctggtgctcaccctcaacacgggtgcgtacatggccgagtcggtccgcggcgccatcacgggcatcgaccccggccagctggagggggcctacgccatcgggttcacccacttccaggccatgaccagggtggttatcccccaggcgttccgcaacctcatcccgcagatagggaacatgttcatctcgtccattaaggacacgtcggtcctcaacgtgatctcggtcaccgagctctactacgtgggccgcagcgtcgcgagctcctactacaggttcttcgagacctacttcatcatcagcatcatctacctggtgctcacctttgtgatctccaggctcctgcgactcatggagaggaagctcgacggtgcgcgtgactacgagctcgtgatcgacgaaggggcggaggtggcataggtgtcagataccccgattctcaaggtggagcaccttggcaagagctttggcacccacgaggtgctgcgggacatcgacttctccgtgaacaggggagaggtgatcagcgtcattggcccatccggctccggcaagtcgacgctcctccgctgcatcaacatgctggaggaccccagtgcggggaccatctactttgaggggaaggccctctcgtatgcgccaaaggaccagagcgccttccgggcccgcgtggggatggtgttccagagcttcaacctgttcaacaacatgaccgtgctgcagaactgcatggtgggcgttcaggtcgtgaagcatgggagcaagtcggaggcggaggggctggcgaagaagtacctgcgcgaggtgggcatgtatgcctaccagaacgcgaggccggctcagctctcgggcggacagaagcagcgcgtcgccatcgcgcgagagctgtgcatgcagcccgacgccatcctgttcgacgagccgacgagtgcccttgacccagagatggtgggcgaggtcctcgaggtcatcaaacggcttgcggagcaggggatgaccatggtgatcgtgacccacgagatgctctttgcacgcgacatctcgacccgcgtggtcttcatggaccagggcgtgattgtcgaggaggggacgcccgatcagctgttcaaccatccccagcataagcgcacggctgacttcctcagtcggtaccggcaggtctgattcaattttagatatggtctgcgaggaaggcgggggtccggtgctgtcgcacccccgcctggtgagactcgcgttctgagtgcgtggcacaaagagtctttggagagaggagacattgcccatggatgcacgggaggcggtcgagggggctcttgcgacgagaggccacattgaccaggtctattgggtcggctgcgggggttcgctcatcgacctcatgccagcggactacatgctgcacgccgaatccggtacggttgagagcagggcttatacggcaagggagttcaccgtggcgccgccccgcaaacttggggagcacagcttggtcgtggcgctgagccattccggaaagacgcccgaggtgctcgatgcatgtcacctcgccgttgagcgtggtgcgtacgtgttcaccctcacctctgaggaaggctcgcccatcgatgatcctgcgtggggcacgttcgtgtacgtgtgggatgacaagactccgcaggcggagctatcggcaggacaggcccttctcgtggcggcggagctgatgaggagccaggagggttacgaggggtatggtgccgtgcgcgacggcttggcgagtctcgacacgatcatccctgctgccaggaagaaggttaacgaggagctttgcgggcgcttctctcagctgtgcaaagagcacgacttcctctacgttctggggtcgggggcgacgttctcgcagacgtatgggttcgcaatctgctcgctgatggagatgcagtggcagaactgctgctacatccattcggccgagtactttcacgggccgttcgagtgcaccgagccgggcgtcttctacttcctgcagatgagctccggtccatcccgcatcgaggacgagcgggcgctcgccttcatccgtcagcacaccgatacgtacctggtactcgatgccagggagtacgggatggacgcggtggacgagagcgtgcggggctacctggagccgctcatgatgtactacatgaacgtcgagctgcgcgccgcccgcggacgtgtgttcgaccatgacccgtcctatcgccgctatatggggaaggtcgagtactagagcagccagcgccaaaggtgcgggtgtgggcgaaaccgccccggcaaccccaatgggtgttgtcggggcgtttttatgtgttgggttctcgcgtgcaattcagtgagaacgtttacgctcttgcggctgtggggctcgggatggcggtggtggggagcccgcgcggacgagccgccaccattgttcaaggttgcataattcaaagattgcatgagtatgtggaagcaggttccaagccccaaacggcagaagctctgtgcaagcatccgtgttgggagctggctccatttgattaagattgaaggcatcaatggtaacgccacacactcacagattgcgcttcagaacactcgagctcgatggccgggcgtcaatatccactgatctatctgacgagcaggcgttcggcatttatgcgtatgaattcactgatggaatgtggtatgtaggtaagtccattgacgtgcgcaagcgacatgtagagcacatgcacgaataccgtcatgagaatccgccccgcattccgaaaaagatgctgtgggcagaagtccacggcaacgagcgacagctcgactacgctgagacagaagctattgcgtggttcgagcaaagggggtacccgcttctcaatgtgatgaagacggggaggcctcgtgggggcgctgacgtcatcgttgacaccggagcgggttggggagtaccaatcccctggcagcgccataatctcccgaagagtacgcatcagttccaattcgagcccaatgagaagaagcttgatcgatttcataagctaaaaaatataggctgctatggggagctcatcgcactactgcgctattacgtgggcgaaacgataccggcacctaaagatacagctggcacgctttgggtcgccactgcacttccaagcacgaacaagtgctcgcgcctctgcgcaatatcctgccagaacgcagaaacgctcgtcatactcaagggagacgatgaaaatcccgtgccgtttggcttcgtaaacatgaagtgcccagaggacggaagacttcccgaatggcgggaacgatgcccaaacgattacgggacccttccgaatgccgttgccatgttcttcgacagtattgaggagggtgatcggttgttgcatgagcagtattctctcgatggctgctatcgtgccaatgccgagctcatgcgacgtggagcttcgatgtatcgccgcttcaataatccctaccttgtagaggacatcttgaggtcgatgtagatagccgatgctagaaagcgcattacgatacaaattatcctagtgaactggctgagatccttcgacacgaacgagcgttggctagcgaaagcccatgcctgatggtgtccctatcgtagtccttc

SEQ ID NO: 417 - DNA, 250124 bp, Unknown
  Metagenome-assembled genome
cgagtaccccattcgcaggtctgggcctcgaagcatcgcggcccgaggagtaagagagaatagcatgatagagccactgaaaccgcacaggtaaacatgccaagcctctggtcgagacgccgtgggaaactggcgaggaatgccctcagctcgagtgcagggctttaccatgacggagatcgtcccggttcgcctcgcgctcgagtgtattgtggtggggaagacacgcacaggacgcaagagggcgttatgtatgagcagagcatgtcccgtcgagacctcggcgcccgagagtcgacgaccaggatcgacccaagcaccccatccgcgacggtcttccctcgaacaccgccacgccagcagaagacgaagcagagtgcgcaggagggcgctcttcgccgagccccaccccttctgggactactgggaggggaagcggccggtggtggacgtcgagtccctctacccgcccgaggtcatatcagggctggtttaacagcgggtcaagggatattggaattggggtgttgtaattatcaaaattataacttccaactttgctgtcattcacgtacacgtcaaagctcatcgtattgtcgccctcaacgttgaagatgaacttcgagcccttctttacataccgggaaccatcggaagagctatcaaggtttaccgttgggaaccaaccggagtttgacccattgccctcacccgtaacggtgaccttcacggcatcgctcgagtccatcttctttgtggaacggtacagctgcagcctcacactcgacccgctgggcgcgcttgcctccgacccatccgcgttcgcccagttcttttgcacggtcacgcgcgtgtactcgttggtgacgtacatcttgccaccgtcgcttccgaagaacttgatggcagagcgatcaacccgtgcgttcgccgccccagacgtggagtacgcagcgtcgtcagtggacgagccatccttccagatgaagtagcgcaccgcgtttgcagcgtacccgtcctttgccttggtctccctcagcctatagagaacgtcgttctctagttggtcaacgttgtcctccaggtcgtagtcgatcttgccatagtcatccgtcttaagggtattctcggtcgtcttctgcttccacgaattggtttccgtgtcccagtagtccatctcaaagtaggtgtcagagaggacgttggagaagtcgtcctcatccaccttgtagatgacgatttgcttctgcgtggcggtagcgctggaggtcacctcgcggaggttgacagaaccgctggtggagtactgcccgtccagcgatgcgctgtttgagacggacatgttatcggagaagttgtcgttgagctgatactcatacaccagaacgcacgcagtcttgtccgggagcgtcaccgtgatcttgtgcgttgcctcgtcgtactttgccttgtagcccttgatctccttcgaagtgtcgagcccgttctcctttgcggggtcgtatgcgtaaagcttaatggaggtggggtcaatcgtcggttcaagggtgttaggcgccccaaacgtgtccgtcagctccagctcgtccgagttggggttgaggtccttcgcccctgtgttgatctgcacgtagtaacggagcttgcccgtagggttgattgcctttccatccgagccggtctgcactggcttgccatccttgtccagctgcacgcccgtcttggagaggaccttgaactcgcgcttcacggtcgtgttggtgctggcgttgtgggagttccagctcgcgttgttggaataggtcttttcctcccccttcgcccacgacggatcctgcgcgacggagaggctgtagtacaccgccacggtaggatactgggacgaatacgtgtacttgggaatcgtgatggtcagaacggtcctgccgtccttctgggagctcgtgacctgcggcttgttggcacccgtaaagtcagtcccgctgtagttggtatcgtgcttgtcgtattcgctcttgaagaacttcgcatagagcgaaccatccacatacgtcgcgccctctggcagcgtgtcggtaatgatgatgtccttgttgttgtcattcgccgacgtcgtaagcatcaggcgataggtcagggttccgttgacgtcgtcgtagttcacgttcgcgttcccgctcttgaaaatatcggctccgtccttgctgcccatcttgaccatcttgtcaaaggtcttggggttggtgaacgtgtacgtatccgtagatgacttgccccccaccgtccctgtattggaaacggtccaggttgagccctcctctgcacccgttgtatcgatgtgcgtcttgtacggagactgctccgttccgatggtcatgctctgggcggtgatcgaggcaccacccgtgggcgtgacggtgaccttgaagctcttcacgcgtgtggtggagttggtggcgggaacctccttcccgtccgcatcgtagtaggtgaccttgatgccgaggttcttggtaaagccatcttcgttctcgtaatacgagtcgtaataggcctgctggccagcaccggcgtacaggtacttgttgtagttatcgacgttgattgccaggcagcccgcctgcgtcaccttattgtcgacgatggtgctcttgaacgcctgctccagttcgctcgcagtggcgtaatggctatccgaacccaggtcaacgccctcggaggtctgcgcattaccaatggtgtcgacgtactcgtacgacttgatgctgccctcgggcagcgtgatggtggagtgccaggtctctgtatggagcttgccgctctcaatctggtcggcgccgtgcttcttcaccacatcggtcgtgcggtgcaccacgtctgtggtgccggtatcctcggcgtagccactcccaggattgccccactcctttgcggtgttggacacgcttacgtcgccactgggggcattggtgtaaacggtaatcctgaacttgctgtgcttccgcacgtcagtaagctgcgaggcgatgctcgagaacctgaagtcaaggaaggtcgggcttggggaatcaaagtactgggaataacttccgtcctcggtctcgacaatgaactgctggaccatcttgcatccgtcgaagcacttgctcaggtcgtcctggaccacccaattggagatgtccgccccgtttgggttaacccagatggaccagatgatgtgcccgtccttgtcgtaggtgccggacttctggatgtccttcgtccaacccacgctcttccaatctgaactgctgttgttgccagattttgcatacgcaccgttctcgacctttgccgtctgcgccaccgaggtggcgttgacgttcccgcggtacgtgaccacgtacttctcgcctgcgttcagctgggggaggccggagatcttgaagtggggaccatcgctggcgctggtatcccatgtgacctggtcgctcgagtagcctacggaatacgtgtttccgctggcatcgaccttcttcacgctgagcgagttcgtgtcataggaggggttggcattgctcgaattgttcttgtcgagatggtccccaatggtcacggtgccctccgtgcccttggtggtcgacgctgtgacggtgtagtcgacatagctgcgatcgctgctcagcgtcgccgtcttgttgacgttgatgtcatgggtgtcggtctgggggttgtccttcttcttgttgaccgtgatgtccgtggcactgccgccaaaatgaatcttggtcgagtccccaccgctcgcgttgctcaccttgcccatgaacataagggttccggagacgccattccccagctgcatcgcgttctggttgaacttgatcctcaccttgccgtcggtcccaatggtgtagtcgccgatgtccttcccgtacatcgtgacatcgccagactcagggctttcgggtctaataccgtcgggaagctgataggtagcattggggatgtcggtggtaatcgtcccctttgcgaggtggtacttgagcttgaccctcacttcgtcaccatcagtgaatttggtcgactcggtccaggtgccgttgacgagcttctctacctttgagtccgccgtaaggtgatccgtaaggtccacggagtcggagccagcgcgggcggcgacacgtgcgacgggagccgccgcggaggtcccatcagcctgcgcgtctgcgtcctgcggcgcggagtcgtccgtctcgcccgcgccatccgtcgtggcgtcggcaacggcgctctggtccttctcctccgccgccctcgtgaccttgagggtgacggcgtcgttcagcttgatggtcgcaaggccgctgtcgtcgcaggtcagctggtcaaagcccaggtcgatgtccacgtagccggagaggtcgctccccgcctgcgcctgctccgcagcggcgctgtcactcgcgtctcccgcgggggtaccggcgttcgccttggtcacgtcgtcgttgaaggtgagggtcagaaccccgtccttaatctggtagctgccgatcttggtggcattggcgttggtggggtccgcgacggtgacgccagagatcacgtcgccggagacgggagccttgctcgtgtcgatgctcacgccctcgggcagctggtactgcagcaccgagccgttggccagcgtgccagcgggcagcttgaaggccacgcgcagccgcagggacgagtccgcgctcaccggggtggcggggtccatcgcctgccacgcgtcgtcactcgtgccagccgcctttgagaagatggcggactggtccgtgatggcgttgcggaggctgtccccgccggtaagggcgtgggcgggatacatcagcagcacgccgcagacaacggcgaccaccgcgcctgcaaccgccgcgatcccgcgccagtcgcgcctcctccggttgtcccggagcatcctgctgaccttgcgaatgaagagtcggtccatcgtatcctcgaatcgtcgtcttgacccgcgtgcgctgcttgcaagcctcccgtcaggaggactgtgagcaacccacccagtgcttgctcccaaactgcccctcgtagtagacaaggaggtcaaagtggtcgtcgaactcctggctcgtctcgccggagtccgccaccctgtacgtcctcgtggcgccgtccacctgggtgaaggtgacctcgtcgcccttggcgagggagccaagagcggaagcgccctggtgccagggctggcagcgcacaaccagctcgtttccgttgccctgctccaggcacgggaccgtgaccgagtccgtgccaagcgccgcgaccggcaggtcgagcgagatgcccttggccgtgagcctgcccactacgtccacgcccctcagctggagcacggggagcgatgccgggtcgtcctccgccgactcgcccgacgcgggcaccagctggtcgagcgatcccaggatcgcctcgcacgtggcggtgccctcgctccgctccgtcgccacctgcgccacgccgcgcgcgcagaccaggagcccgcaggcgagaagcgtcaggcctgccagcagggcgagcctccagcgagggatgcggctcctctcgcctcccacctgtgccagcttgccggacactagcgctccccctccctgcgacggccgcgcaggcccaccagcacgagcgccgcgcccgcgcaaaggaggaccgccggcagcacgagcgaggtctggtcgcccgtcttgggcaggcgggacgtgccgctcttggggctgcccttggggttctgcccgcccttggagttggtgacctggaaggcgctcccggccgccttatccgagcccgccttggccttggcgaccgcgacggtggaggtgtagccactgggcacgcccacctcgcgcacggaccaacttccgctgccgtcccacgagaacgtccagttgttgtccgcgctcagcgtgacctcgcggtagagcgtggtcccgttgtagatgcgaaccttcaccgacgcggggcggccctgcgccgtgtcgcccctccacagcttggtgacgctgttgtggggggtctccaccggcgtgacctcgaactttgcgtccaccgtgcagtctgtggcgtaggtccagccgtcgatgcgcggcacgatcaccaggttgggcagcgcggtgtaggttgagccgcccaccgttaccacgtcggcgcacagcaggtacatgcccggctccagggcctggtagcgggccgtgccgccggacgcggtggcgaccctctcgccaaacgccttggggcttgcgaccacgtagccctgcaggctctgcgccgccttggcgagcgtggtggcgtcggtcttctcgtcaaacgtggtggggtcgatccccgtctggctcacggcgtccgccagctgcgagtcaagggtcaggctgccgtcccccgccatggtcgccaggcggtacaggcggaaggtctgcccgtccgcggggcacttctccaccgtgagcgagcaggtggtgccgtcggcgatccgctgcaccgcccatgcctgggtcgcgggcgccaccgcaagcgtggcgactatcgcgacgatggcgagaagggccagccccagcgccccatgccgtctaccctgtgtgcgtgtcacttctccgctccctcttccaggcccgaccttccgagcgacctgccatctccgcgcctcccggcacgggcgaccgcccgcaccagcagcgccaccgccagcaccaccacggtgatgaccgcggcgacgatcgccgggctcacctgcaccatatcgccgtccgcgaccgccgccccctggttggggacgcggtgcccgcgcacgagcagccgatgggtgttgaccccatacggcgtgcacgtgaccagcgtgcagtagtcctggccgtcgtctatggcaaggtcgtccagctcgtcgggcagcacgacccgtatctggtccacctgatacgtcagcgtctttccaaggacattgagcatgaagaggtctccctcgcgcagctggtcaatgtctgtgaaaaggcgcgcggacggaagcccgcggtggccgcttatcacgcagtgggtgcccttgccgcccaccggcagggacgacccggggatgtgaccgatggcgatctgcagcaccgtcgcgtccgtcccgtgatagatggggagcgagacgctgatcttgggtatctccacgtagcccatgatcccggtgccggtcacgtccagggtctgctcgtacttggcgcgctcctcgtccgaaaggttgaagcggccctcgtcgtgggggagagacgcgttgtacgcgaccgcgtcgtcccacagctgcttgttgcgctccgccgagttgtcgctcacggccttctcgtacgtggcgatggcctgcgtctggtgcatggagttccaccagtcgctcacggacgggtagagcatcatccccaagccagcgaggaggacgcagacgagaaggatctcgggcacgtgcgtcctgagccaccttcccatgctgcgcctcctcccctgtgcctgcggggcggcccggggaggaccgcccctgatgcgtgattcctacctggtgctatgcgttctgacgcttgttgtggcgaatcgcgaggccaacgcacgcgaccaccgcgaggactgcgccgcccacatagagcaccgtggtgcccatgccacccgtggagggcaggacggagccggagttgttctggatggtggttttaagggagccgtcggcaacacttgcttcgaactgggcagtcccgtccttcgcgctcccagacagtccaatgagcgtctgggcgtcgtcgttggttgtgctctgaatcgtgaacaggacgtcagccatcttgttgtagcccttgggggtcgtggtctccacgagcttgtaggcaccctcgtcgagtcccttgaaggtgaacgtggtcccgtcctcgctcacggtcttgagatccttgccatccatcgaggttggaaccgccttgtacgcaccatcgctcttgtcgagcttgtacagggtgaagttggcgcccgagaggggattctgggcctcgttgaccttgttcaccacgagcttgtaggtgaagaccttggtggtgtggtcgggagtcttgcccttggagtccttgttgttggggttgttggagaacgtaatgtggctggtattcacgttacccgcagagccgatgttggctcccgtgagaagctcggcggtgtactcgacggagatgtcatcgcccgggtgcacgatgggggtaccgtcctcgtccacgatcttcttcaggtcgttgagggcgaccgtgaaggagccttcgttctgcgtcagcttgtagccagcagcggtaagctgcgcctcggtgagctgggtccccttcacgaagaccttgacgtccttggcctcgccaagctggtccttgttgtaggtatcgtcgaactcgaagtagtaggtgtcgtagtcgccgtagtcagcagcaacctggccaacgagctggaagggaacctggtcgcccatgtcgtagtcggcgacgctcctccagccagccttctcctctgcggtgttcgcgacggagtcgttggtctccttcacgtgcttgttcgaggtcgtggtggagtccttggcggtaatcgtcacgtccccgccggcgacctcgagcatgaacttggagtaggtgtccccgttggagagactctccgtcacgtccttgatgaagtagtagccatcggcgtcgacggtgatcttgtcggtcttctggccattctccaccgtgctgtacttggtggtcgtgaggtgctttgccacgaccttggcaagggcctccgcatcggccgacctgctcgtgatgtccgccatggcggcagccgccgtgggggcatcggtcgccttgctgaagtacttgccgatggtggagtctgccttgagatccgtgaggagggcgtctccgtcgacgccaaagccccaggtgatgccggtgagctgcttgctgttgctgtcgtacgtgcccttgaagacctgatatgcctcgtaggtgtggcttgcctgctggccatcgggctcgttgatggtgatggtgtgcgacgtcgccgcaagcgcggcgggggcgagcgcaaacgccatcgcgaccgacgcaagtaccgcgacgatccccgtgagcatcttgcccaggtgtttcattgctgcttcctttctctcctaatccctgcggctctcatccgccgccctttttcctccgagacccgcgctatgggtcgggacctctgggacaccacatggggaacctccatttcgtatgacgcactcgcttgcattcggctcttaattggtcgccggcggctgccggctgggtcaggcgaccgaccccacgtttgtgaggggccacacgcgcacggcgagcctccccacgatctggtcctgcggtatgcagcccacttgggagaggcgcgagtcgaccgagatcgagcgcttgtctcccatgacgaagtaggttccttctggcacctggtacggaaggctgatgtcgcactgccccaggctcttggcaccgggctggaggtagggctcgtccagcgcctccccgttgatgctcacgttgccgtcggagtcgatgtccacccagtcgccgggaagcccgatgacgcgcttggtgagcagcttgttgttgtacgagaaggcaatgaggtcgccgcggccgtaggagcccaccttggtggcgaccacgatgtcgccctcgttgagcgtgggggtcatggacgagccgtagatcctgaaggtgggcagcacaaaggtggagaccagcaccgatgcggcaaacacggcggcaaccgcaaacacggcgttgcgcctgagcgtgtggctgtgccggatgccctgggagcgctggagctcgcggtcaacctcgtcgacggtgggaagccgcacgtgccgcggctcctccgctgaccccgcaccccgaggattgtcgtgcctctccccgctcaacgcaggtctcccctctcgtcctgattcgaacaatcgtcttggcttttgcctgaactctgaatttggaggggctttacgcacgcgtccgggctagccgaacgtgcgtttgcttgcatggcttcttggtgggactgagccgtgggccaagccgcttccgcgctcggccccggggcaacccctccgggctgcccctccggctcacctgtgttgttgtggtttggttgacggtctcggtcgtcttggctgaagtgcctaggccctgctgagaggaaccccattacagtcaagctgaagccagagcggtagccccgagaacccaagggaacgcctggcctacgattgcgtcatgtcctgatggactgccgatcgggcgcccgcgcacggccttctgcccctgcccctcgagggcccggggggtgttgccggcgcgggcgccgctgcctcagacgactgataggaaactgccgggctcctccgaccaaggtcttgccacggccaggtaatgtgggtgtcgcaggaagcagctttccgatcgaccgacgattggaaggatagcatcatggtcaaggaagcgctcggctgcaccgcggtactggggctcgacgtcgggaagtcgtcgcactgggcgtgcctcgtgacgcgggccggggaggtcgcgctgaacgggcccgtcgcgaacgccgaggccgacctcgacgccctgttctcccgggcgcccgagggcgcgctcgtggtcgtcgaccaggcgcgcaacatcggctcgctcgccatccggagggccaggctcgccgggctgccggtagcctacctgcccggaatcgcggcccacagggccgcggggctgttcgccggcgacgccaagaccgacgagcgcgacgcgatggtcatcgccaagacggcgctcgggataccggactcgctgctgcccgtcgccgagcccgacgaggcgctcgacgcggcccgcatgctggcctcccagcgcgaccacatggtgacctgcgccacgcgggacaagaaccggctcaggagcatcctgctggagtcctgcccggcattcgaggcgctcgtcgatctctccgacgcccgctggctctccgcgctcgagaggctgggcggcccgtgggggatcgccgacgcgggcaaggcgtcgttcggggccgtcacgcgcggcgccgacagggcgcgaatggacgccgcctgggccgcgatcgcgggctcgaccaggccctcgggggcgcgcgtcgccgccgagaacccgatggtggcgatgctcgcgcgtaggataagggaggccgtcgaggaggcgtcgcggctcgacggggagatttcgaagctcctcgccggggacgacacctacaggtgcctgaccacggtccccggcataggcccgaggaccgcctccgagctcgtgataggcgtcgacatctccaggttccccgaccacgaccacctcgcgtcctactgcggcgtcgcgccgcggaaccggcagtcgggctcctccatatcgtcggtcagcgcgtccaggcagggcaacaagaggctcaagaacctgctcatattctcgtgcaactcgctggtcaggagcgacaaccgcttcggcgagtactaccgccgctgcagggaccggggcatgtgccacggggaggcgctcaaggccgtggcgaggaagagggtcaaggtgatctacgccatcatgcgggacagggtcccgtactcggcctaggacgggtcgaacggcatagagcgaaggcgcggctccctaagggggccggcgtcagcatgccctcttccgggctcgatcccctcgggaaacccgctccgaagggttgacgaaactataggaacaccccccgagacctcgttcatcgcgacgttatagccgtacaggtcgatggcgcgctgcgcgtccacgaacacgccggcgagcctgagggacgcctcggcgagcgactcggagtcctcgacctggatgcgacggtcctgcagctggcgctctgcctgctccgcccgctcggtcgcctcgtccagccgggcgtgcaggcgctcgttctcctccatggcgtcacgcaggagctggagcagctgcacgcggtcgagtttgcggaggtcgaggtcgtcgccggacgcgacgtcggcggagccggcctcggcacccttgcgggccttgcgcttgccctttgccttgagcttggacatgggtaccttgtcggtggcatcaggcttgcccatgtccacgccctcccccaggttcgtggcagaggtcttcggttcctcggcggcatgggacaccccgtccgaggcagcagacccattggcgtcatatttcgcaaccctgccgacggatggacgtggcacgaggacgaggagggctccgatgccgaagccagcggcaaacagcccgagaacggcggggctcatgcctaggggcatgtctcctccctcccccgtcactcctaaacgtgcgtaccgtctccaaagcggcaaatcctgcgagtcccaagtggttggacaaatagaccagcaccccttgtagccaagcaggtttggttactgttcctgaagaataacccagtcatttctgaaaaggaacccaccatctttttacacgtttgtaaaaatgtgtggcacatattgacttttaattgctagtgcgatgtggtaattatcgaatttagacacatcgtttccaatatgtcgtagctaacggcgaacgattcctttagatgttttgtttgaacatgtgctaggaccatagcgattttcctgcgaaaacccttgtacacatctaaggcgccctggtcgttttcatgacattttgacgatagcgtgatcttcgcgaacaaccttatccctaggtgagggacttatttcaataataaattttgagattgtggatggggatcccaggggatccttcccctgtcccaacgacgggtttggccttggggaaagcgacctccgacagatacgggcacagaagcagcctcataagcatgcatctgtgcgagggttgtcgccaatacaggaccattgctcgggatgcgactaagccgggacggaatgttccacctgaaaatcgccagatttggctaattaacggccttaaaatgaccaatcttggctaaaatcaggtggtaaccagttctgggcgaatctggagggaaacagtggatcgcgacttgatggataacctcatagcctggaagagctctcccaggaggaagccgctcgtcctcaatggagcccgccaggtgggaaagacttggcttctaaaggagttcggacgactccacttcgctaacgttgcctacgtgagctttgacaacaacccacagatggcagcccagttcgacggggactttgacacgtcgcgcatcctcacggcattgcaggcagaagcgcgacagcgcatcacgcctggagagactctcgtcatatttgatgagattcaagaatgccccaaggctctgacgtctctgaagtacttctgcgaggacgctcccgagtatgttattgccgccgcagggtcgcttcttggcatcacgctccactccggcactgggtaccccgtgggaaaggtcaacaccctcgagctacaccccctgacgttttgtgagtacctcgatgctatcggagagggtttgcttcgcgaggtgatcgaccagggcgacgagaaggcgatcgattcattctcggcaaggttgacctcactcctgaagagctactactttgtgggcggaatgcctgaggcggtggaggtcttcgccgatacgaggagacttgccgacgcccgggacgtgcagaacgagatccttcttggctacgagcgcgacacctcaaagcaccttgacctacgcgagactgaatttaccctagcggcctggaactcgatcccggctcacctgggcagggagaacaagaagttcgttttcggtcacatacgcgatggtgcgagggcacgcgactaccgctctgccatcacgtggctgtgcgaggctggcattacaacgagggtgccgcgtgttgccaagcccggaattccactctcggcttatgcggacgagagcgccttcaagctcttctccgtggatgttggccttcttgccgccatgtcgcagcttgatgagtcgagtgtggtcaacggcaacgcgctgttcacagagttcaagggctccctcaccgagcagtacgtgtgccaggagctcgtggcgacgggcttctctccctgctactggtcagcggagaactcgtctggcgagattgacttcatggtgcagcacggaggatacgtctatcccatcgaggtcaaggctgaggagaaccttagggcaaagagtctcgccgccttcaacaggacgcatgaggggatgcggtgcaggcgcttctcgctctcgggatttcgcgacgagggttggatgcgcaacgtccctttgtactccatcggcaacgtcaggaattggacgtgctgagtcctggttggcttctgaggcttatggtaccaataatcgaagttccgcctgaaaatcgccagaactggctaaagtacggccttaaaatgaccattcctggctaaaatcaggcgatgactggtttggacagacctcatgggacgagccaacctcaccagtagcgggcttcgcgagcgggtgccagcggatatgccctgggatgcacgacccgcgcggccgcgcgctagcgcgacgggtgccgctcggcgaaccgctccgccgtcacggggagctcggtgagcgtgaagttgttactctcccctactatcacggcgattcccgcattgggggtcttgatggtctcgctcatgagcttgcggcgcggatggctcacgggatagtactcgagcagcacgtacctaaagaacgccccatggcacaccacgagcacgttgtcgccgtccgccgcctggtcgaacattctcccgaacgcgctgcggacccgaccgcgcacctgctcacccgtctcccctccgtagggggagaaatcctgccgaacgaagcagcgcgcgaacttgagcctgttaccggcgtacggcttgccgtcgaggtcgccaaagtcgaactcgtgcaggtcgtcgaggggctcaatctccatgccgcgccccgcggtcacgatgcgggcggtctccatcgcgcggcccagcggggagctgtagcagcgggaaagggggatgggggcgagggcgcgcgcggtggcctcgatcgcggggatggactcgcggaccaggggcgcgtcgacgcggccgccctggatgattccgtcgcggttgaactcggtccgcccgtgccggacgtagtagaacgtgacccgcttcatgacttgctcgcacctcttccccaccgttagccgagacaagactatacggcacactgtcgtgactgacgaggctggtcacgtctgcggcaggggctgggtgcgcggctttgaggcttgcgatggggtcgtagtcaggtacctgctgaggaaagtcgagtattggcaatcgtgggggagtttcagctgaggaaagccgagtattggcaatggatggggtggtccaaggcgctctggctgccaatactcgacattcctcagcgcttaacgactcccaattgccaatactcgactttcctcagcacccttcgcgtcagaggcgtgcggtgattgccacaactcaggttttctaagcaccccgcgtgcgaaggggcaccacggattgccacaactcaagttttctgagcacctgcgtcaccgcactggagacacagcgagcgctccgattgggaacggtactctacgaccgttgcgtcggtcgcacacggagattttcgtccgcaaaacggccgcattgatttgcggttgctcttacggacgtgagtcagattctccgtgaatgcgggagtagccgagagagaaggagcccgggctggtttcccaacccgggctccgacgagctatgggattacccctagcggcgacgcctgcgggcgcgcacgccgagcgcgaccgagccggcacccagtcctgccagcgcgacgcaagccgtcaggctggtgggatcggaggtcttgggcagaaggccagtgcccttggccgcctgccccttctttgcggaggcggcgacgttcgtctcgtcctccgctcctccctcgttgtggttggggttgttgttgatgttggggtcattggtggcgccaccgttgttggtgttgccgccgttgttgtctccggagttcccgttgtcgggcttgcccgaggtgggcagatagctcgcggtgaggctgccatcgaacccgttggtcgggatgctcgcgctgaccgaggcggcgttgatgtcaaacgtgtaggtgccgtcgtggctcacatactcctgatcgtagggaaggagaacgagcgcaaggcggtgaccctgcgccacggtgtagacgttgggctgcaggtacagggtgtagctgttgtacttgcccttctcgagcttgatggagccgctggcggtctggctctcgaacccgctctgggggttggcgaggtcgacccagccgcgctcgatcaccttggccttggtgggggtggcggagaactgcttcacgtcgatgatgtccagcccgcacgccatgaagtagtcgttggccttgagcgtctggacgggcaccttgccccagcggctgctggtggagtcgtaggcgccaaagtcctggtcggacacgtccaggagcattgcggtcaccggcatgttgtcggattcgggcgtgatggcggaactgcggggagaggcgtcgtccttctcgcccgtggcctcaccaaacgcgacgtcgaacttaacgctcacggtgcccttgatggtcacgtcctggtcgaacgccggggtgacgaaggtggcgtttgaggagctggaggcgttggcgatcttctcgtggaaggggcgccaggagtcaggcgaggacgcgtccagggtcatgcccgcaccggcgtagtcggaactgagcgagatggtgtccctgtccgccgaggagcccaacttgagcgccgtgtttgtggagtagctgtcgtaagcgttccacacgttggcgtcgaggttgctctgggccaggacctcgggcatgtcctgggcaccgttgtcgacgtcgtacaggtagtgcgagaaccagcggttgaggacgtcgtcgtagctctggtcaccggtcatgaccaggtagctgttgttggagttgggggtcatgtgcgcgccctggtgcaggaggagcttggtgttgacccccgctgccttgaggctgcgatacatcatctcgaagtgcttggtggtcacgttctggtcgttgaggccgtggacgacgagggcggggcacttgaagttgttgttgcccaccgtgtagtcgcggtttgcccacacgtccgagtagtccgacccgccgcgcagcgtgtcgtcctggagctggtgcaggtagttgccgtagcccttctcgatggtgccccagtcgtcccggtctatgtagcggccggcgcagtagacggcgagcgagctcagctggtcaccggggaagtcggaggtcctggtgccctggcagttgtagtagtcgtaccagctggcgatgcccgagacggggacgatggtcttgaggccctcgacgccggtctgcgcgaggccgaagtcggtggtgccaccgtaggagcggccggtcatgcccacgttgccgtttgaccagtcggcaggaagctggcaggtgccctcgcggtcggcaaatccctgcctgtcaccgtggagccactcgatgatgcacttgaaggcgtcgatctcgacgtccgagccgcaggtctcgaagccgtcggaaccacgggtgcccaggccagccgcctcgacgaccgcatagccgcggcagaggtagtagtcgtaccagtcgagcgtctcgtagtccatgaacggatcggtgaggttgccctggtcgtcgtagccggactcgtaggggctcacgtagtaccactcggaggactttgccttggcggccgcccccatggtggtggtggagctgctcggcacatggacctgccccttgctgtggagcttggccatgtcgtagccctcgccgccggggacctcagaaatgtcgccaaacggggtgcagccggagatgtagggacgtgcctcgaagatggtcgcagccttgtagtccccgcgggcggccgcgcgcggaagctggaccaccgccttcaccatgtcctgcttgccgtcgccgtccgtgtcgtagtttgtctcgacccacacgctgtagcggatgatgtcagagtcctcgttggagtacttgtcctcctccaccgcgccagtcgtgaaggggaagatgggctgcgccatgccgttgaggaagaggggctgcttcatctgggcatgggcggcggccttgaacgtgttgaccgtctccctcatcttgaggaacgcgttgcccgtgcaaggggcggagaggtccgtgtcatagcccacgatgcccatgttgatggcgaggccacggttgtcctcgggcttgtagccggtgaggtcctcgcccaggttaacgctgccgatgacggcatcgatcgccgcggcgagggtcgcctgctgctggtcgtcgccctcggcgggctgctgaccaagcgctgccttgagctgtgcgacggtgatggggtcatcggttgccgcgacgtcagaggcgggcgcctcggcttccgcctcggactcgctggcgtcggcggcgggctggctgccggcggaatcggcctggggctgggatgcgtcgttgctctcccccgtcgcctcggactccggtgcggtcgagccgttgtcggcctgcccctgctgggccccctgctccgccaggatggcttgcgtctcggcgattgcctggacgggcattcccgcgaggccaaggctcaggctcagcacgacgctgagcaagagacgtgcctgcgcggcgaacttcttgcgcattctctcctcctaaaacgttgacgaaatagtacggaaacacacaggctggactctagcaaaggcgcgtgtattgccatttcaaagccagttttaattcgatgaacggtaagcgtatggagaatgttttcctgtaatctgtatgcatgcttatgattgtttccgccattttcccaacatttatgtaattgaatgtttggttgtctccccgcatcactttgggcaagcggttggctgcctccaagcggccacgtcgcgcgctctggcaccagggttcgcgcacggcaccatcgagtcctgctgcagggacatcgccacgctcccgggcgtgcgggggcagggggacggggaaccaagtactccgcgtaggtctgggtgagaggggcgctcggcgccatgggaacccgtcgcgatgtcgtagggggttcttctcccctgtgtgcgcggacgcgttgcgttcgtttacccgaggaatgggtgggctcccctgctgggacgataccgatgccgtcgtcctccagccaccagaatggcaacctgaaaatgtagggagatggtcgatttccaagacgatccacccccctggcccaacgcgaaacgtacgatttgattggtgatgggacggagcgatccttcccccgcttcgtccctcgccgctttccttgccgctgtggcaaatctcgcctgattccgagttatgtaagggttgtcacggcaccggccgccatacttggccgtaccccagccgtggcaagtctcgtcgggcagtcaacccaggcgagtccccgaggaggggtgacaccccgtgtcgagtcgctggtgcgcgctcgggcacgcgcattggggagcctcgtaaggattgacgcggttaggcaggtctaaacgcgtcaaatcttattgggttcgaagttccgtaaagattcacgcggttaggcgggtctaaccgcgtgaattcttacgagatgccagttttgttgtgattacaatagttcaccgcagctaatctcgctaggattcttgccaaacagggggcgcagtcgagccagggctggtaaatcaaggccacccgacctggccttgtcccgcccggacgcaccccaaccgcaagcaccgcgggcacgcagcccgtcacgacagaacagggaggctcacatgccgcaagaactcgacctcagcaggagcgtccacgacctcgccgtccaaaaccccggcttcactcgggtgatggccagcatcggcttcaccgacatcaccaagcccgccgcgctcgagaccgtcgggcgggtcatgaccgttcccaggggctgcgccatcaagggcatcagcctggacgacgccgtgagggcgtttgaggacgccggcttcgtggtggtgaacgcgggcgggcgtgacgacaagacgccggccaccccctccaccgcaggcgagaggaacgctgccacctcggcgggggccgcccccgacggcagcgcggctgacgagcccgagcccgcgcccctctcccccagccagccctccggcaccaccccccacgacgcctccgcctcgggcgagaagatcgagggcctggacgaggccggtcgcgccaagctgctggagagctatgtggccaggctctcggcaggcgagcagctggaggccgtgcgcgcggactttgtggcaaacttcgcggacgtcgacgccggcgagatcgcacgcgcggagcagtcgctgatcgagggcggcgccaagatcgacgacgtgcagcgcctgtgcgacgtccactccgccctgttccacggggccacgcgagaggagcgcatcgcaaacgccgaggaggccgtgatggggtcgctcgccagcggatcgggcgcggacgactttaagaccaaggtcctctccgccatccccggccatcccgtccacgtgctcgcggcggagaacgaggcgatcgcaagccagtcggcacgcacccgcaaggcacttgggaccgatgccgccacggacgagctgcgcacgctctgtgccctgggcatccactacgccaagaagggcgacctgatctaccccatcctcaagctgcgccacggctactccggcccctccgacgtcatgtggggcgtggacgacgagatccgcgcggagctgggctggctgctcgccgccagccagcgcgacgcaagctggctcgagcgcgcgaacgcgctgctcacgcgcatcgacgagatgacctacaaggaggcgaacatcctgctcccgctgtgcgcccagaacctcacggacaacgagtggctgcaaatgtacgtcgacatgagggggtacgacctgtgcctgatccaggacgcgggaacctggcagacgggtgagaggtacctggcacagtggtcggaggcggccgatggtggcatgggtgtctcgcctgccagcgactccgacggtgccgcgacgcccggcgaggtccgcctggcgtcgggaagcctgaccgtggcgcagctggacgcgatgctcaacacgctgccgctcgaggtcacctttgtggacggcgacgacatcaaccgctactggaacgacgacggcgagaagaaactcttcaagcgcccgccctcggcgctgggccgcgaggtctggtcgtgccacccgcccaaggtccagccgatggtgcgctcggtgattcaaacgctccggagcgggagccaggactcggtggacgtgtggatgcagaaggagggcgagcccgtgctggtgcgatatatggccgtgcgcgaccgctcgggcgcctacctcgggaccctggaggttgtccagcgcatgggctttgcgagggaccactttggggcataaccgccaacgatagcgtgcggcaagccaggtgagaggagaaacggcgatggaggagcaggaggcccccgaccaggggcaggagtttgcggacgtgtttcaggcaatccgcgacgacgagcagaaccgcgactacacggagcggggcatcgacccgctgttcacggcgggctcgcacgcgcgtatcgtgatcgtggggcaggcacctgggcgcatcgcccaggacacgcgcattccctggaacgacaagagcggcgaccggctgcgcgactggctgggcatcaatcgcaagaccttctacgacccgcagcgcgtctcaatcatgcccatggacttctacttccccggcgcggggaagtcgggagacctgccgccgcgcaaggggtttgccgagaagtggcatcccgtccttctcgcccgcatgcccgaggtgcgcctgacggtgctggtgggcaactacgccacgcgcaggtacctgcacctgaacagcaaggatcgcctcaccgacgtcgtccatggctacaaggagtatctgccggagtacttcccccttgtgcatccgtcgccgcgcaaccagatctggctgcgcaagaacccctggtttgaggaggacgtgctccccgacctgcgagaccgcgtcgccgacgcgctgcgataggggcggaacgcccgtttggggtgcgctcgtctgcggaatgacggctagactaagatctggaccgtcgggtatggtgtgagtacaccagcggtgcccgtcctctgttaaggctgatgcgggcggcgcaggtgtaccgattcgaaaagcccggttgcgccccgggcttttctcatcttcctacgcgcgtctcgcatgcgtccgcattgccgcgttggcctgaggtctcgccgccaagtcaactccatcatctgcaggggggctcgccatgcacgaacgaatcatcaccctcccctgcggtcataccacctgctatctggtagttggcgcgacgggcgccctcctggtggacaccggtttcgcgggtacgcttgacttgcttggccgaggcctcaaggctaatggcctcggcatccaagacgtgaggtacctgctggtgacgcactttcatcccgaccacatgggaatcgcccaagacctcgcagacttgggcgtgaccctcctgctccccacctgccagctgccctacgtccacactcccgatcacatgtatgcccgtgaccacaacgacgccttccaacccatcgacgaaaccgccgcgctccacgcagagcctcctgaaatccgaaggctcctgcacgaccgttgcggcatcgacggcatggtggtgcagactccgggccacagccccgactcgataagcctggtgctcgatcagggagacgccttcgtcggcgacctctgtccctccgaccaggtctgtctctacgcggatggagcgatggaggcgagctgggaggcaatcctctcccttggcgcccacaccatccactttgcccattggccaggcgagactatctagcccaagggtcttgcagcccaacttggccttggttcatcggcccagcaaaatagctcggccatcaggcaacaagcccagacaagcagcgcattccacacctcgaggggctggactaggagtccggccgtcgggtatgatgtgagtacaccagcggtgcccgtcctctgttaaggcttatgcgggcggcgcaggtgtactgattcgaaaagcccggttgcgccccgggcttttctcatcttcctgcgctatccgttatcgtgcttatgctcccttgccatggacctcaccaccctggctatgccgaggacggcttggacgattctcgcaacgttcgcgagggcgttcaggacttcaaggacaaaccgcatgtccataggcattacctccgtctccgaaggcgccgcccgcacacggacaccgctggcgcatcgtcaatgctacctgagctaaataaataagtctagcaacttatttttactgttttactttctgttcttcaatgtacttgatagataaacgccatattctcgaagtaattattccaacgttggtaccacttgaggtggcgtggcgcaacaccaaacgtattgaaggcgcttcccagtgccgcagaatgtcgacggatgtctcgcgcctccacagcggccaacgtgatacccatcgcgatacccgcaagccggttttaagagttgagacgaccaatgtcgtttggactggaagtcatcccattgggtatgatgtaagtgcaccagcggtgcccgtcctttcttaactgtactgcgggcgcgctaggtgtttcgatttggaaagcccggttgcctccgggctttcttcatctccttgcgctatccgttgccgtgcttatgctcccttgccatctccctcacctccctggcgatgccgagggcggattgggtgatgctcgcgacgagcgcgagggcttgcaggacttcgaggattgtatccataggcattgcctccgtctccgaaggcgccgcccgcacacggacaccgctgatgcataagtaattgtacctgggccaaccaacgcaactcatggccaacccgccccatacccgcacgaaaccgtgcccgtctaccacctggcaggcgggcacgtctcacatgcatatcgttcctaaccggcctcgtccggcatccctgaatcgtcacccggcgagcggaccgtcctccaaacgccgacgctactcacgcctacgccggcgcacccacgccaccgcagacacagccatcaccgcacacccaacggcagccagcccggcaaatccgcccgcaccggcaatacggctcggggttcctcggcgcccactgcacgaaacgacccggagatgtcgtccctcagctcaatggacgtggcgggagcgaagtcgggttcccgggactgccagtgagatggtccacgagcacgatggcgcgcttctcccaaaaatacgatattaatctcatcttattgcatattcctaaggcatgaagctctatccaaaatgagatatgaccagacgttgctctcaacctgaaactaatctatatacggtattacaggaatcctaaccaattcaggagctaggaacctgctgtcagacaatccgtcttaacaggctattcttgcggacgtagcagcgttttacagacgagataaccaacttttccgccaacggtagccatacggttacctgcaggtatcctgcattaacattaagttaaccagaattaaacccattgaacccaaaaaatcccaatcgcaaaatatgcatgtgttgttttgtccatattatccgtacggagagaggagactgaaagggctatgaggcacttcagactcgggggcgccaagagggcgttcctcaactttgggaaggcggtgaccgtcgccgcatccatcatggtggcaatgcccacggcggccctcgcctgcacccagatctacatgggtccgcagaccaccgcttctggcgacacctacgtgggccgctcggaggactactccgaccgtcactccaaggtgtttggcatcaagcagccccagaccaaccccaccttcagctcttacgagaactggaatgacggtgactttgtctggacctaccagggcaccacgtaccgctacacgttcgtgcgcgacagccccaccggctgggacaaccacacggacgcctacggcgaggccggcaccaacgagaagggcgtgagcgtctccgccaccgacaccggagactacaacgacaaggtcaaggccgttgaccccactggcgccgacaagggcaccaacaccggcctgggcgagtacaacgccgccgacatcgtgctgagctgcgcctcccccgctcgcgagggcgtggagctgcttggcaagatcatcgacgagaagggcgcctacgactgcaactccatcatcatcgccgacgccaacgagacctgggacttcttcatggtctctggcacccagtggtgcgcagtcaacatgaccaaggccgcccccgacaaggtctcggtcgaccccaacatgggcaacctcaagtacgacgtcgatctgagcgacaccagcgtgtgcctgcactccgccaacctggaggagaccgccaagaccgccggcagcgcaacgtactttgacgacgggcagctggacgtgggcacctcctacggcctggccgaccccggcgctgcacagtactcccgctacgtgcaggctcacctgtactttggcgactcgctgaccgagggcaccgactacaccctgggcaagggctccgacggctggtctggcgtcgccacgctgaccgacccgcagctgttcttcacccccagcggcgacaagatcagcctgttcaccgcgcttcgctcctacgcaacccgcggcgagaacgtctctggcctcaactccaacgagaacgccagcatctggcccgtgggtaacgaccacaccgtcgagacccacatgttcgacatccgctccgggcttgactcctccatcgccaccgtgcagtgggaggccctgagccgcgccgagttcagcgtcgcgctgcccagctactccgcgctcctgacccaggtcgacaccaccatcttccccgaggacgacgcgagcacctggaacacgctcgactccacctacaacgccaacaacgactacgagcgggatcttgtctcgtccgccctcgcaggcgacgtcaacggcatgccgctcgactacgtgctgatggacatcaacacgctggcgttccagaaccgctccaccatggcctccggcacccgcgcctacctggacgcgctgcagaaggagatcatcgcccagcaggaggtcgtggacgccaagatgcaggcgaccgacgcctccggccgcaccgacctggccaacaaggcgtttgacgtcgtgagcaaggccacctacgccaagctgcagacgctcctgaccgagatgcgcgacttctacaacaacggccagaagaacgcagacggctccaccaccttcaccccgagcgactacgacgcgaccaacaagaccctcaaggacccgctgcagtacgcctccaaggtcgtcgcgcccaccatcaccacccagcccgcgagcgccagctacgtgcagaaggacgccgcgaccgcactgtccgtccaggcgaccgaccccgccggcacgagcctctcgtaccagtggatgaagtccaccgacggcggcaagacctggaagaaggtctcgacgtctgacacctacacccccgccaccaccgacgagggcgaggcccagtacaaggtcgtcgtgaccaacgagggcggcctctccaccgagtccgacgtggcgacgatcagcgtgtccaagcccgtcgagcccgagcctgccggctccatgtaccgcctgtacaaccccaactccggcgagcacttctacaccgccagctcctacgaggcgggctcgctcgtgaaggccggctggaggtacgaggacatcggctggatggcgcccaccagctccagcacccccgtgtaccgcctgtacaaccccaacgcgggcgaccaccactacaccaccagcgcggccgagaaggactcgctggtcaaggccggctggaggtacgagggcattggctggtactccgacgacgccaagggcgagccggtctaccgcgagtacaaccccaacgccaaggccggcgcgcacaacttcacgaccaacaaggcagaggacgagatgctcgccaacgccggttggaaccaggagggcatcgcctggtacggcgtgaagcagtagcgagggtcacggcgtaggccacgaacccgagcggcaggagccccgcaggccagacggccggcggggctcctattttgtgaggggtcgattggggcggcaaggcgaggtccgtgtccgagggtgctgaggaaatgcgacccgtggcaatcccaaggccgctccgactgagaaacgtcggctttcgggctgcggaagcaaccgaatcgctgccacaactcatgattcatcggcaggcagaccccttgggaccccgctgattgccacaggtcgcatttcctcagcaggtaacgccacgaggagcgactcgaagacaccttcagccatcaccgacgcgcttccgtgacgcgcagcaggaactttcccaagcctgttccctcccccttccaaaggttgcggctcgccttccgacgcatttctcgctcctacgatttcgacgcacctctcactcagcgacggttgtcgtatcccgcctcctggcgaacgaaggttcccgcgtcgatgtcgttgaacgcctccgcaagctcctcgtccgtgttcatcacgatgggcccaagccacgccaccggctcgttcaggcggacggaactcatcagcaggagctcgatcgccgagtcacctgcctcgatcgtcacctgattcccgtctccaagtcggaccgcggtcttctcccccaccggagtgccactcaccgtggcatcccccaccagcgtgaacgccatgaccgagcggtcaccgggaacgtccagcgtgacctttgcatggggctccagcaggatgtcgtagtagtcgagcggaaggtacttgccctggaagccatgcgcctttccgtagctccccgtcagaagccgcagctttccgccatcaaggtcgaactccttgatctggtcacgcgtaatcccgtggtagaagggctccgccgtcatcttgttgcgcgcagggaggttgagccacagctgcacgcccaggaagcggggcgaacggccgggcatctcggagtgaaacgcgcccgaaccagccgtgagccactgcgcctctccgtcggagacggtcgccttggtgcccaggtggtcctggtggaccatcgagccgcgcgagatgaacgtgaccgtctcgattccacggtgtgggtgcatggggaacccgtccatgtactcgtcggggttggtcgagtcaaacgcgtcgagcatcaggaagggatcgaacgcgtcggtggtccaatttcccagcacgcgcgtgagcttgacgcctgcgccatcctgcaccgaaacgcccttgattgccttcgtgaccttgcgaatcatttctgtctcctgttccgcgccgtgtgtggcgccgtcgtgtggtcttatctctacttagaggttttgctaggtgagaggagcgactacctatttcccctccgatacccccggacgagacggacgacctcgctccgctcctccggcgaccatgccgcaagcgaccgttcgagggcagacgcattgtccggacatacccgctcggcaagctcgcgacctgctggcgtcaggctcacaatgctccgtcgaccatcgcaatcgtcccttcgccgctcgaccaagccgcgtccctggagatgccgcaccaccacggggatggtgccatcgctgctgaggaccgcctctcgtagctcccccatcgggagcggccccttgttaaggagcgcctccagcacggcgaactgcgaaaccgtgagcccatgcgcccgggcgaccgaagccgttcggcggtcaaggtcctgcacgatgcggtgcagcccgatcaccagctgggaatccaggcgcgtcatcccagcggcagtgggttcggtcacgttatcctgcttttcgtcgaacttctcttccatgctctcccctcctcaccagtcgtcgcttcctatcccgcttttacctctaactagaattttctattcatgggatggacgtacgtctctaagccgtaaactgcacacaaacgagaaggcggccacccgaggcagccgccgtaatacccacaagccctatcttcttgtcagagcaccgaaggagctggggccgtgacagtcccgtcatccgtccccaatgctatgcctgctgaggaatgtcgagtattggcaatttggacggcttgactgctgaggaaagcggagtattggcagtcggaggcccggctctctgccaaagttcgcaattcctaagcagaatccgtccatggattgccaatactcacatttcctcagcagcaatcgctggcgaacggtatccagcacccgaacgactgccacaactcgagattccgcagccactaccgtcgcccgagggctccggattgcaacgtctccagtttcctcggtagccatacttcataaacagcggcgaccacccgaaggtagccgccgcaccgaaagagaatcgctcctctcccctaccgctagaagctcatgacccccatagcaagaagaaccaccgccgccacggcagcagccacgatcaccacggccaccgcaatgtcctgccgaccaaagacgctcttaccattctccctgcgaccagcagcgaagaagagcagtccggggatgtagcccaagcagcacatgagcaggtactgccagccgctgagcacggtccccaccaccaggaacaccgtggcgatgagtccgatgagcgcctgtcccgcctcgtgccgttgcacggagagcttgacctggtatgccgccgcaagcgcccaggtgatggcaatggagacggtgcacatggacagcgcgaagttgtaggcgtcctcggtgaagagcagcgacgccatgaacagctgcgtgcagatgccgactacgatcagggagttgcgcggcgcgcggttggcattgagcttgccccaccacgagccaagaaggtgatcatcagccatgcgctgcgtgacctcggcgggaagcagcgtgaacgagagccagcagccaaagcccgaaatcagcatcgcaatggcgatgaacgcaccaccccagccaggggcgaccttctcgaacacgtagagcatggcagggtagttgagcttggcgacctcggtgtacggcatcacgccgtacggcaggagcgaggctcccaggtagatggcgacgacgacgagaaggcccaccacggtcgcggtgccggcttcggagcgcttgcgggcacgggaggtgacgacgctcgctccctcgatgccgatgaacacccacatcatggtgatgaggcaattctggatctgcgtggagaggctaccgagggacactgcgccgtcgcccgcagtacccgccacgacggcattgttgtacacgttgccccagaagtctgccgtgaagactcccgcattaaaactcacaccgcacagcacgatgaacactgccagcgcagcaacctttacgaccatgatgagcgcgttgaggaacgaggcgctctcgaccccgcggatgaccaatgccaccagcacccagttgatgagggagcccatgaggatggagccgatgttgttgccagggagaaagtacgggaagaagtagccgatggtagatgccaggatcgtcgcgaacgccacgttgcccagccaggcggagagccagtacccccaacccgagacgaagccggtgaagggaccaaacccctcctgggcgtaggcgtagatgctgttgagctcgggcttcttggtcacgaggttgttaagcgagaaggcgagcgtgaggaatcccacgcccacgaccagccacgagaccagcacgccaccaggggatgcgaccccggcaagctggccggtgagcgcgaatacgccggtgccaatgcacgagcttacgaccagcccgaccaggccaaagaacccgatgccaccttgcctctcgcctgtcttgccttcaactgcgtcagacatgttgcctccgttcgtgggagagaggggcggacgccgcgcacgacgcccgcccccaggggttttcggctaccagcggagcgagaggcaggtgatggagccgtcgatcttctcgaactcggtcatctcgacctcgatgatcttgtagccccacttctggagctgtgccttgacgcgcgggtagcccttggccatgaccacgtagtcgttgatgcgcacgcaatcggcaccgtaggcctcctcgtccggaacctcgaacaggttgaactgcccgcggtggtaggcgggcttggtcttgaactcgccgctcaccagcaggttgccgtcctccacgtaggtaccaccggtcttgaggtgcaggatgtgctccacgggaacctgctcggcggtgtagccccactcggcgaggaagccgctgaactggcggaagccctcgtcgttggtgcgctgggagtgacccacgtaataatggtcgtcaaccatcatgacgtcgccgccctcgagggtagcggggtcggtgatgaccttgatctggtcgtcgtcgaagaactcgtgcagcgtgggcagcatgagcgcggcctcctcgcggcgggtcagggctccggggcggtcggagattgcgcccttgggggtgatgaccgcggtgtcctcgacgaacacggagtcggggtagtcctcgagcgccgggagcacggtgacctcgagccccgcctgcttgagcgcctcgacgtactggtcgtgctgctccatcgccttctcgtagatgggcttgcccttgtcggtgaagtccgcgatgccgtcgatcacggagtgggaggggcgacggacgattgcgtgggtgaagttgcttgccatggtgagtcccttctgtgagtgaggtgcgacccgcggaacaggttgctgcaacgtggaccgcacctctcgcctgcttgccctgctggcttatgtatacaaaatacatttctgtccagtcaagcaaattcgcggctctctaccatctgttttacgagcggttacttgcaggacataaatggcagctcgactgcatggcgtactacttgtgcctagctccatacatgtatacaattttgtcgacaaaggaggtctcatgactgggcaggcatcgacgtcgctgaagcagcgcgtgtacgacgagctgagggcgcggatagagcgcggggagcttaaggagggcgagagggtcgcggagctagctgtgtgcgactccctgggggtaagccgcactcccgtgcgcgaggccctgatccagctggaggcggacgggtacctggagggcatgcctcgccgcggctttcgcgttcgaagctttgacgagcagagtgcccgcgaggtctttgagatgctggggccgctcgacgggcgcgcggcgcttctcgccctccctaacatgactggggatgacctggcggacatgggcttcctatgcgattcgatggagcttgccatcgcgggcggcctcaccgcgcgttactacgacctgcagcacgagtttcaccagcactacatcgatcgctgcggcaacaggcgcctggtcaaggcgctcggcgagctcatgagccagctgtcgtcccgctcgtaccagcgcgacgacccgcaggcgctgcagaacatgcgggctgccaacgaggagcatcgccacatcctccggctgttcgaggcgggcgacggcaaggcgctccaggactacatccgcgacgtgcactggtcgctcgacaacgtcgagtttgccacctggtgacggcccctggattcggacagacccacgggcggggcaccccccaacgtcacaatccaccacaagcaagaggagaccagatggaccgccttgaggcgtttgagacgatgcttgccgacgtcctacgatgtgaacgcgaggagggcgccgagctcgagcgcctgcgctcggagggtcgcacgcgcacggcgacctaccggcagcttgtggcaaaccggctcacgtatcgggcggtcctctcgctgtacgaggaatacgggcttctcgaccgcaactgccgctccgaatagccgtcgcgacccatgcaaaagcgggccggaagccaagtgcccccgacccgccagccagagcgagcggcctcggccctactcctcctcgagcttctcgttgatcgccgcggcaatctggtccgcgtcgttggagctgcggaccatctccttgaaggcgtcgtccatcagcaggaccgccgtctttgacagcagcttgatgtgcgtggtccccgcctcgccgtcgggcaccaggagggcgatggcgatgtcgaccggctggtcgtcaaacgacggccattccagcgccttgtcgttcttgaacaccacgacggtcgccgcagtgatcgccggactcttggcgtgggggatcgcaaacccctcggtcatccccgtggcacccatgtcctcgcggtcgagaaacgcctggtacacggcatcgggatcctccgtcacacccagctcggcggccttgtttgccaccgcgcggagcacgtccagacggctttcctcgtgctgctccagcatcacgttcttgttgctcaggaaacccatacctcttcctctctctttcgtgtggcacccgactgcgccgcgaagcactacttagcggcgagcgcgcggcgacccagctccagcgaacccaggatgccctggtctccaccgcagccggcggggacgatgtagttgtcgatgtcctgcagctcgggggtgaccaggtacccgttaagcatcttgagcgtcttctggcgcacgagcgggaacagctgctcctgcttcatgaccccgccgcccagcacgatcttctgcggagagtagcacagcacgtaggtcgagacgccctcggcaaggtaggtgctctccagctcccagacctcgtcgcggtcggcgagctcgtagcccttcttcccccagcgatgctcgatcgcggggccggccgccatgccctcgaagcagcagtcgtggtacgggcacacgcaggtggcatcgtcaccggaaacgcgcgggacgatgatgtggcccgcctccgcgtggagcatgccgtggagcaggttgccctccaccatcacgcccgcaccgatgccggtgccgatggtaacgtacaccacgttggagaggcccttggcggagccaaacacgacctcgcccaggcaggcaacgttaacgtcggtgtcgtagcccacaggaacgttgagcccgcggacgaaggcgccacgcaggtcgtagtacttccaagccgtcttgggggtctcgaggatctgtccaaacctcgggtcactggggttcaccgccgtgggaccaaacgcgcctatgcccagcgcatcgacgtcgcgagccttgaaccactcgaccatctcagccacgcagtcgtcaggcgtggtcgtgggaatctcctcgcgctcagcgatgtgacccgcctcgtcgccaatggccaacaccatcttggtgccacccgcctcaacggcgccaatccttgccatcagaaccgcctctctcttccgtgggaccacaccctcccacaaaaaacggccccgccaacaaccgccggcggggccgtatggggaaggtcctactcctggtcctgcctccactgcttcacgccactctcacgatacagcgcagccttgcccttgctgtcgaagagttccatcttgtgcttgataacctgcttaccggcttcgatgcactcggggaacaggttgttgggatcccagccggagttgggctgtgccaggatctcgcgggccttggtgaagaacgcgctcttgtagtcagaggagatattcaccttctggatgccaattctgaccgcctcggcgacctcagagtcggggttgccggagccaccgtggaggacgagggggatgtcgacgaccttcttgatgtcctccaggacgtccatgcggagcttgggggtcacgcccttggggtacaggccgtggcaggtgccgatggcaacggcgagggtgtcgacgccggtcttctcaacgaaggtcttcgcatcctgcgggtcggtgtacttgacctcggtcatgccaccctcgatggtgacgccggtgttgccgatggtgcccagctcaccctcgacggagacgttcaccatgtggcagtagcgcacaacctccgcggtcttctcgatgttctcctcaaacggaaggagggagccgtcgatcatgaccgagctgaagccgtcgtgcaccgcgcgcatgatcgactcgatggagtcgccatgatccatgtggaggacgaagggcacggggctgtttgagatgcgcgccaccatgtacttcacgaagtcgtccttgcagtaggcgagctcggtggggtgtactgcgataattgcgggcgagtcgttctcctcggccgcctcgaccacggtacggaacaggttggactccgagacgttgtatgcgccgacagcaaagtggttcttcttagcgacatccagcatctggttcatgttgagcagcattgctacacctttcatcctgtgacagacagaaaccgatttggggcggggtgtggttcgctagaacgccttattcacggagcccgccagctccatgtagcgctcgatcaccttggagccctccagataggactggtggagaagctcggggtagtcgtagtcggggttctccgccagggccttggcaacaaactcgcgctgggcgatcatgtagtcggtcccgacgttaatcttgttgatgccgcattccaccgagcgcttgatgttctctgggcccgagccagatccgccgtggagaacgaggggcttgcccgtcgcggccttgatcttctcgacgatgtcaaagtggaacgtcggaacgtagccctcggggtagtcgccgtgcgtcgacccaaacgagacggcaagggcgtcgacacccgtcttgttgatgaagtcaatcgcggcatcggggttggtgtacatgtccgactcggtgaagccggcaccttcccccaccaggcccatgttgccaacctcggcctcgacgctcgcgtcgaactcctgggcaaactcgacgacggagcgggtgattgccacgttcccgtcgaagggatgggcggacgcgtcgatcatcacgctcgagaagccctcgtgcaggcagcgcttgaggtgcgcgacgtcgctgccgtggtcgaggttgatcgcgacgggaacgtgggtctgctccgccatcttgatgatgggcttggtgaggacgtcgcagtcaaagtaggccttcacgtggtcctggagcaggtcgatgatgatcggggagttcatcttggtcgccgcgtgaatcacgcctgcggcagactcgaggttgaaggcgttgattgccatgacggcgtaaccctctttgttcgccttcgcgagcattcccttcatcgaaacgtacatggcgagtaccacacttcctttgatcggtttgagtttgtcaggagaagaatgaatcctccgttatacggcgcggaacctaggttcccaaggttccgcgccgtcatttgaactagctaaagctcaggccagagaggtcgaccttctcttcctcctcgaccttcttctccatctccgggtcaatcggcttcttgaggataagaagcatgaccgcggtgacgagagagcctgcggcaagggcaacaagagcccagccagggttcttcattgcggggacgacgaacatgccgccagagggaaccatggactcaacacccatggagaatgcgattgcgccacacacggcatcgcccagggcggtggagatgatggtacggacaaggtcgttcattgcgatggggatgacaccctcagtgatcatgcagatgcccatcgggaatgcgaccttgatgttctcgacctcttccttgtagaagatgggcttatgaacgaccttggagagaaccagggcgagggtcacaccgaagggaggaaccatggagcccagaaccttgactgcctcaggtccatagatgccatcggccatcatgccgtcgcagatgaggttaggcaccttggagattgcgccaccatagtcgaggtgctggatgaagccaagaatgaagccgtaagcaagcttctggctctgatcgagccctttgatgaaggcggtaaggccagcggtgagtgctgcaatcgggccaccgagaaggaacaccatgatgagaccggcaacgattgcggtgatcgtcggaatgatcatcatcggcatgagcgcctctgcccacttcggaaccttcatgtaggtctcgaggaacagcgcgatgtaaccagcaatgatgccgccaatcagaccgccgaggaagccagcgcccaggaaggatgccacctggcccatgaggaagccaggagcaaggcccggcctatcagcaattgcgtatccgatatatcccgcgatgaacgaagggagaagtcccatgccgaagacgccaatcgtcgtcagtgcatcagggacagttattccatcaagcgtatcgacgttagagccaccggtcaggttgccgatggcaatcagcagaccagatgccacgaccagggggagaaggtaaccaatggcagtaaggactggtgccttgatgccgaccttcttcatcttgtttgccatttccacacttccttcttctttagctttgccggacttatcccgaaaatctgctacgcagacttctcaagctcctcgtgaatcttggcgatgatctgcttcggtgccttaattgccagatccgtcgggatcttcatgaccttcttgtccttgaacctggaggttccctcaatgtgaacgtcaacgcagagaagcacacaatcagcctcttcaatctgctcggacgtcaattcgtcctcgacgccgatggtgccctgcgtctccatgtggatctcgtcacccgccgcctccgcagccttcacgattgcttccttggccatgtaggtgtgcgcgataccgctgcagcaggcacatactccgacgatcttcatccctctccccttcccttcgaatttccgttacgcttcaacgaccaatttcgaggagctcctcacctgactgtgtggaaccgtgtttcatgttacatatttctcagtaattttgtttcatatagcgtcagcagaagtttagcggcctaatttttcgggtaaacggcatcgctcacttttatcagcagtaatcagtactaatttgactctgaaactgagctgccagaggaactgtgcgtagctaagagaacgttgggcgcgtctctttatctctccccaagctctttcgctccatccaagtgagctctccaacgttctttccatatgtcaacaagaacatgaagagcgtctcgattatgaagtcctcgggaacatgggttgcaaactggggacccgtcaaaagttgatctcgagagattgccgaaagcaccacatcggctctctggacaagtttcgacatcggatttgaggtgatgaagatgatgggagtaccgctgtcctccgcattatccacgatagtttcaagcctatgggagtaaccggaagaggaaacgatgataacgaggtcgttccttcgaagcgacagcgatgcgagaatcatcatttccgtatttgcaggacaggttgcccttatcccaatttgcccaaggcgaaaagcgaaattcgaacagactggtattgagttgcccacagcggcaaagaggatgttgtcagactgcagaatcaggttaatggtcctctttactcgatccttatccagcgcttttgccgtcccctgcagctcttgaatcttattctcaagtacgaactgaaccgaggcatcaatgtcgtcgagagaaacctcactcactggctttccagctgtgaaatcggcgtctccctgttcacccgcaatagcgagacgcagatcagcaaagctgtcgtagccgatcttcctgacgaacctggacacggttgccccagaggtattgcttttgtcggcaatctccctcaccgagagccgtgcgacgtctggcatgttctgaaggatgaagtccgcaatgcgcctctccgtatcagagaagccgtcgtacgacgcgcaaaggttgtcagagatgctagcgttgcgattcatgtgagcgcccattcgaacatgtatcagcactccgcgcttccaccgataggggtgtccccgcaagaaatttggaatgctgttccatcaattgagtaggtctgaaatggattctaaccttatagggtttgctcaagcctgtcattctgcctgcccacacattccaatcgagacaactcgtttcacatctttggaactccattactccatctgagactcccctctctcttgatgcacgtgtttctcaagggagaagggcggtggaaatccccgcactccatatcggaagagcgctgaaatcgtcggagttgtgcccaacgcacatcacacccgcccgattgctgtaatcgtgtgcttagcttcatcggggctcggacgcagtgcaggagcctcgtgcttagcctcatcggggcgtgcactggtttgggtaccgaatgcttaatctcgccggtgctagcacgagtcagacccgctggaatccgcacgggctctgagttctttaagcacaccccgctcgcaactcatgcgggcaccataatttctaagcaccttgcatgagaaaggggcctgccatcggcaagccccttgggtacctcatgtgtgaaggtgtctacctcccggcagaagccctcacgccgccgtagtcgccgggatgacgacgggccttgcctcggttcccgcctccgctggtcctcgccttcgaggaaggacgtgccccgcgagagacacgctcgggacgtccctcctggcgggccccctgcgcgcgtctgggaccgtctccctgggaacgcgagctcctctgccgcgagttcctcacgacgcgacgaggggcaccctccccgctggactcacgagcctccgcacgctgctgtgccatctttttgcgagccttcttgttgggaagcttctccttgggattgcgcccctccttgaaccacggggtattaccctgcagacccagttccccaccacggggatacgtggggatgaccttgcccatgagctgttcggcatcacgcaggtccaggtaatcgtcctcggtcacgaacgtgatggcccacccactctcgccggcacgacccgtgcggccgatgcggtggatgtagtcctcggcctctccaggaacgtcaaagttcacgacgtaggagacgtcggggatgtcgatgccgcgtgcaagaacatctgtagcgacgaggacgtccacctctccctgcctgaagcgctcaagcgaatgctgcctctggccctgcgtcctgttgccgtgaatgggcgcacaggtgatgcccgccttgcgtagctttcggcacagaccatccgcacgatgcttgccacgacagaacacgatgacccgctcggtcccctccatcttgaggagcttgggaagggctgcgttcttctccgaagcctccagggggagaacaaactggtcaactgtctcggccgccgtccccttgggcgcgatctcgatcctcacagggtcatgcacaagctccctggtgttattaagaacatcatccgagagcgtggcagagaagagaagcgtctgcctgctggagggcgtctccttgactatgagacggatgtcgcggatgaaccccatgtcgagcatgcggtccgcctcgtccaagaccagcgtctgaacctgggaaaggtcggcacatccctggttgagaaggtcgatgagccttccgggggtggcaacaaggaggtcacagcccctctggagggccttcttctgcggctcgtaccccacgccgcccacaagcacgaccgcatggtgtcccgtacgacggcaaatgacggaagaaacgtcgtcgatctgctgagcaagctcacgcgtcggggtgacaacgagcatgaggggtccctggcctcgcctggcatgaccaaggcgatcgagggaggggagaaggaaggcggcagtcttgccggtacccgtctgtgcggctgccatgacgtcagagccgcccaaaacagcggggatggcctgtgcctgcacgggggacggagtctggtatccaaggtcttcgacggccttgagaacgttctgggaaaggtgaagtgacgagaagtcagaaggatttgaaacaggaacggaactggttggctttgctgccattaacactcctcaatcgcaccaaatatggtgcttatatacgagcggagggggcccgccccaaagggcggaccccctccgaatgcctctcgcgggacggcggcgacccgctctcccacggactactccgcagtaccatgggcgctcgggggcttagcttccggcgggttccgggattggtccgggcgtcctccccgctgcctggacgccgcccgcgaaggggcattcactagagggcgctccggcgtgcctgtgggtcgcacagcatgacggacgacgcctcccccacggccgcgcggtacgcgaccggtccctccccccggggggcggatgaaagagtgaagtcaagagctcgccgatttagtgcggcggggtgggtgtcatcggatgagcgcctcgcggcgctgcaaccgccgtctatcaacctcgtggtctacgaggtgccttccgaagggagacttcatctcgggagggcttcccgctctagatgccttcaagcggttatcccgaccgggactcggctacgggcagtgccattagggttgacaacccgccgcaccggagccgtccacccgcgtccttcgtactagggcagcctcctcagttcttcctacgccaacggaggataggtaccgaactgtctcgcgacgttctgaacccagctcgcgtaccgcttttgaatggctgaacggcaataacccttgggcacctcccagccacaggagtgctgagagacatcgggttgcaaacctccctcgatggactcttggggagatcagcctgttaccagcgagtacttttattatccgttgttgagcgacggccatttccctctggcagccggatcactagagcctggtttcccacctgctcgacaagttccgtctcgcagtcaggccgctatgctcttgcctccgaggacggtgtgcgacttcccgagcggaccttcgccgcctccgttactcttggaggcgaccgccccagtcacctacaccaccagcacgatccccgcccgggtcacggcgcggggttaggatgccagagcgtcgagggtggtattccagggcgactccccccgaggcgtccggttcctctgtcctccaccttcctctacacgacggacccgacggacggacggcagccaatgtctagctgcagtaaaggttcacggggtctttccgtccttccgcggggaagtcgcatcttcacgactaggcaatttcccgggtccatggtgagacagcgccaaatcgttacgcctttcgtgcaggtcggaacttacccgacaaggaatttcgctaccttaggaccgttatagttacggccgccgtttaccggggcttggattcgccgcttcgcttgcgctgacgctcctcgtgacttccggcaccgggcaggcgtcagaccctatcgtcgccttacggctttgcagagtcctgtgttttggtaaacagtcgttgggcctctcgctgcggccgcccggctcgcgcggcaagcgcgctcaccctggcggcaccccttctcccgagagttacggggtgatttgccgagttccttaaccatggttcttccgatcgccttggtatgctctacccacccacctgtgtcggtttgcggtacgggcctcgcgctccccaggggcttttctgggagcgtgggctcactcgcttcgccaggagcttcgtcgcgcacctcggccctcgcggggggcgatcttcgctaccccccggcctacgtgcgttcacggggacgtcccgaaccccgccgagctacccttctccgtcaccccgtcggtgatgtcgccgcgccggtggtgcaggaatgtcgacctgctgtgcgtcggctacgccttccggcctgccttagccccgactgacctgggaggattagcctcgcccaggaaaccttgggtttacggggaggcgttttccacgcctctctcgctactcatgccagcattctctcccggccggtccaccgcgggtcgtccgcggcttcccccgacgggagctcccctaccgccaggccaaggcctggccgccgcttcgggccgtgcttagccccgtatattgtggcgcatgtccactcgaccaggagctgtatacgcactctttgaaggtggctgcttctgagccaacatcctggttgttgggcggacgcacatcctttgccactcggcacggactggggaccttaggggcggtctgggctgtttccctctcgaaacagcttagcccacatgttctgactcccgggctcgggacccgcggcattcggagttggttggtcttggtaggcggtgaggcccccgcgaccatccgtgctctacctcgcgggtaagcgcccggggctagccctaaagctatttcggggagaacgagatatctccgggtttgataggctttcaccctatccgggtcatccccccagttttcaacctagggggttcggccctccggggtcttacccccgtttcagcctgcccccgatagctcacccggcttcgcgtccacggcgcgcgactcatcgcccgtttggactcgctgtcgctgcggctcgcttcgagcttaacctcgccacaccgtactcgctggctcattctacaaaaggcacgccgtcaccgcgcgaagcgcggctccgatgttgtgggcacacggtttcagggcgtttcactccctcccggggtgcttttcacctttccctcacggtactggtccactatcggtcacagggagtgtttaggcttggggggtggtcccctgcttcccaccgggtttcacgtgtccggcgtactcaggtactgacgccagccggcgcgcttcgcggtacggggccctaaccctgttcgccggcccccccaggccgttcgctcgctcgccggtttgactggacgatgtcaggccctacaaccccggcgcgctcgcgcgcgcgccggtttggctcatccccgttcgctcgccgactacggggaatctctgttgatttctcttcctccgggtattagatgtttcagttcccgggttgcccccgccggccatgtgttcggccggcgggcgcggggtatcccccgcgggttgcccattcggagatcccgggtcagcgggatgtgcccctaaccgcggcttatcgcagcttgtcacgtcttcgtcggcttcctgtgccaaggcatccccgtgtgcccttccatcttcttccgcagaggccggtgcataccaactgggcccctcgtgcgccggcctcgctagatgcgattcgtagtatgaagaaaaattatcgtcttgtcacgctattcggctctcaaggtacgcgggggcgagccctcgggaccggacctgcgcgccctcgcggcggacgagtggcagccaggagcgcggacgggccgccccacaagcacccaccaggtctccctagaaaggaggtgatccagcgcaccttccggtacggctaccttgttacgacttccccccttaccctccacaccttcggcgctccccccccctcgcgggttgggccgacgacttcgggtgcgacgactcgggtggtgtgacgggcggtgtgtacaaggcccgggaacgcattcaccgcggcgtgctgatccgcgattactagcaactccgacttctggaggggggttgcagcctccatccgaactgggccggctttggggattcgctccgctcgcgcgcgcgtggcgcgcccgctgcgcattgtagcacgtgtgcagcccagggcataaggggcatgatgacttgacgtcgtccccaccttcctccggttagggggtctcgcatggtgccgcggagtggcaacatgcgacgggggttgcgctcgttgcgggacttaacccaacatctcacgacacgagctgacgacagccatgcaccactgtcggctcctctcggccacggcgtctccgcgcttcaccgatgtcaagccctggtaaggttcttcgcgttgcttcgaattaagccacatgctccgctgcttgtgcgggcccccgtcaattcctttgagttttagccttgcggccgtactccccaggcgggacacttaatgcgttggctgcggcacgggggacgtccccccacacctagtccatgtttacggctggactaccagggtatctaatcctgttcgctcccccagctttgccgcctcagcgtcagtcgtggcccagaaggccgccttgccaccggtgttcttcccgatatctgcgcattccaccgctacaccgggaattccgccttccccccagactcaagccggcggtatcgggagcgggcgggggttgagcccccggatttgactcccgacctagctggccgcctacgcgcgctttacgcccaatgaatccggataacgctcgcccctacgtattacgcggctgctggcagtagttagcggggcttcttctgcaggtaccgtcacctcgcggcctcgtccctgctgaaagcggtttacgaccgagggcctccttcccgcacgcggcgtcgctgcatcaggctttgcccattgtgcaagattcccactgctgcctcccgtaggagtctgggccgtgtctcagtcccatctggccggtcggtctctcaacccggctacccatcatgccttggtgggccgttgccccgccaacaagctaacaggccgcgggcccatccctcgccgtctgggcttattacttgacgcccgcgacccatgcggggggcgcggggttcgtcgcggtattacccacggtttcccgaggcctgtaaaaggtgcgaggggcaggtgcccacgtgttaatcagcgttcgccactgtcctcggcgcgcgggcgcctcgccgttcgacttgcatgtttagggcgcgcgccagcggtcatcctgagccaggacgaactctcggttcggtgccacccgagggggggcatccctggtaagtgcatctcgaagggaaagtgttctgggtgccccgggaggtccggcctcggccgcgcgtgatctggagtcgcttgggccgaatcggagttagtgtttgaaccttctgttcgagcttcgctaatatgctgtcacttgtcgatatcatcgacgcagtattatctagtatccggttctcaaggttcgccgccgcccgccgggcccgaggcccccgtgcggcgcgaggaacaactatacgcggcgggccgccccgcggggccgggaaggcgcgcctccacgggacgcacacaaaactgaatatcctgtcctcgtcactgagtgggaggaggccggatatccgcaggtaaaccccgcccaatgtggaagggggagaggggccgatgccttggcccctctcccccaccgttgtgtctagtcgaactttgcgagctcctcgcccagaatcctgagcccctcgcgcaggacctcaggcctggcgcagtagcccaggcgcgcacccttgggcatgtcgaagcgcgaacccggcaccaggagcacccccgtgtccttgatgaggtgcaggcagaactcctcgtcgcccaccggaatgtcaaagcgcacgaacgaggtggagacgcccttgggcggaatccacgagaccctgggctgttcgtctatccacttctgcgcgatgtcgcggttgccgaagatgatcttgcggttgcgctccagcaccttgtcgcgatgccgcaggacgtaggttgcgagcgtgtcgttgaacacgccaccgcagatcatggtgtagtcgcggtagtggcggatgcggtcggcaatctggtcgtccgcgatgacccagccaatgcgcgcacccggcgtggagtaggtctttgagatcgagttagtgacgatgcccctctcgtagacgtctgccagggacacgtagtcctcggtgttctccatgggaaggtagacctcgtcgcagaggacgtaggctcccaccgaacgcgcgatgtcggcgatctcgcggatggtatcggcagagaggaccgtgccggtggggttggaggcgttgttgatgcagatgagcttggtgtcgggcctcacgagcctgcggagctcggccatgtccgggcgccagcccaggtcctcgcggatgtgccagtactcgacctcggcacccagcatgcgggggatctcgtagagcggggcgtaggtgggatactcggcgatcacgtggtcgccaggctccacgacggagaggagcgcgttgaggttggcgcccgtgcacccgttggtctggaggatcctgctgggggcgatgtcggtggaatagagcttgcggacctcgtccttgaaggcggccgacccctcgatccagccgtagtccatggttgccttggcgacctcctcgtcgagcgtcgcgccaccctcgccatccagctggcgtatctcgtccatggtgagcgacgcgatggtcgactcaccgatgtcccactttgccaggcggtcccagtcgttgagccaggcctcgacgccgatcacggggatcttcatggtgtgttgctcctctccccggcaccaccgggcggtgacgctcgggcgacggaatgtgctacagcaggcggatgatgccgcgcaccaggcgctcgaagtcgtccgcgtggcggccggcctcctcgagtacgctctggtgagtgaccgtggggttcccgcactcgttggccgcgagcgtgagccccaggacgttcatgcccagggcgtgcgccatgatgacctcgagcaccgtggacatgcccacgtacgagacgcccatggcgcgcatggcggcgacctccgccggggtctcgaacgagggtccgagcacgccggcatacacgccctcctcgacggtgatgcccaggtcgtccgccacgccacgggcgagcgtcctgaggtagggcgtgtaggcgtcggacatgccgacgaacggggtgtccaggtcgcgcacgtcgcggcccgcgagcgggttgcgaccggtgaggttgatctggtcggtgagaatcccgaggccgatgttggcgttgccaggaacggcaccggtggcgcaggcaaagatgatgtcgcggcaccccaggtggtgcgcatggcggacgagggcggtgacctcggcggggtcgtacccctggtataggtggatcctccccgggtagacgaccacgggcacgtcgtcgatcgtgcccacggtggcctcgaagctgtgcccctggaccgggcgcgcgtcctcggggaagccctctatgtcgtggtagtcgatcctgcggacgggcttcacgagcgatgccaggtggccgaggccggaaccgagcactatggcgacgggatgctcgacggacggggcgcagctcctcacaacgtcttcggtaaccacgcggactccttccctcttgaggaggcaggcgaacagcccgtcccccttggtgagacttcctgtgtacgttccatcgtagatgacgcccgagccgcacgagggactcttggccttcaacacggcgagcggcgcggcgcaatccagggctcccgaggcacggacgcgctcgagcgagagccttgcgcccctctcgaaatcccccgtgacgtccgtccctcccctgaggaacacgcggccatcgcgctgctcggcgggagggcgcgggaccgggaggccactcgccgactcggggcacacgcccaccgcctcaacgcgggagcacagtctgcggaccgcgtcgtcgggcttggcaccaccgtcgtagcggcaggcgacgccgcgcaggcactggctcacgatgaccttcacggacaccacctctgggtcgcgggggggggacgtccctctcccctcgggggagagggacggcgatttgcacagggctcttctgccccgttttgggcgtgcataacggacggggccggtgggcggggattcgttccccaggaacgcgagggggcgggccgggcacgaagcccgacccgcccccgtggacgctatggccttagggccgctcctacgcggcgaggctggagatggagatggaggcgttgcagaggatgccgtcgatatagctggtccactgcgtcgacgcctcggaggcctcggtggagtacttctgataggcaacgtagtacgccgcctccgccgcctcgtacgtggcggagtcgttggtgatggtgtacttggaaagcgccttgtagtagtcgccgtcggtggatgcccaggtgcccttgttggagtcccactcgtcgcccgcgaggtcgatgatgtacttggcgtagtccgcggacgcggtctggtcatttccgtcgctgggggcggtcggcgcggtgggctgcgttgaggtggcgcccacgaccttgtccttgagcttgctcatctcggcggactgcttgaggatcgtcttcacggtgtcggcgtccatgccgtagttggacgcgatggtgtcgaagtcgtcggtccccagctgctccttggcgtaggacttgacgtcgtcatccgacacggagatgccctgggcctcggcctcctgctggatgatctgggagcgggcggcggagaggatcgcgtctgccgtgggcagcgtgtagttgccgttgctgtccttggcgttgtcgagcgtcgagttcatctggatgacctcgcgcgcggtgaggttggtagtcttgccattgtacgtgtaggtggcgaccacggtgtcgagctggccctcggagacggtggtcttgccgctcgcggacgtcacgccgcccaggaagaacttaccgatcgcgatgccgccggcgaggcacacgaccgcgatgatgacccagacgaaggtagggaggccacgatggcccttggacttgccctttgccttcttgtccttctcacgcgccgccttcttggcggcctttctcgccgccttctcggcagccttcttctccttggcgagcgccttctcgtcgaccttcccgggcttgtcgccctcgccgtcgggctggtcgtcgccccgggcccctgcgtcgccctgctcggcctgggactccgcctgggtggcgtcgtcggccttgggctggtcctcctccggcctctcgtcctcgttgtcgttgatggtgtctgccatcgactccccctcttgcagtggcgcgccgagttgagacgcacctgccaatagtgccaacgttggaagatggtagcaccttggcatggcgcgcccctctcccctgccgcccaggctgcggggagggccgctcgccttggtgccggcgccccgcgctacttgcgggagcactcctccaggatctgcttggagtacgtcttggtgtagccgcgcccgttctgggcatcgaagccaacgcgggcgccgaccgcggccctcaccttgtcagagatgctgccctgcacgaattcctgcaggcagaccagcatgtcgtggtactcggggtcgccgtggtagcactggatcgcctcgtcgaggagcggccaggcctcctcggagcgctgctcggaggtggcgccgtactgggcgatgaacctgaacgcctggagcctcacggccgcggacgtctcgtcgaagagcgaggcctcggcaccgtcgaaggcatccaccacagaagaggcatctaccttggcgatttctgagagggccgagaggacctcccagcgggtctgcgcctcggggcggtcgagcgcgtcgatgagcttgggcgcgtagggaacgagcgcgtcggggctcgtcctggcgatggcctcgatggtgtgggccgcctcctggcgtcccctcctccccgcgcccgagagctgccccatgaggacgtccagcgccgcccggtccttgctgtcctggtctgccattgcgtgtatcccctctcgttactcgcagaagccgtctaccatgacggtgccgctcttagaatcctggtggatggtgatgaagcccagctttgacgcctcgcgcagcaggttgctgaacgaccggtagccaaagctcctctcggagaactgcgggcgcttgcgccgcatcgtgtccttgaggcgcgaggcgagcacggcactgtcactctcgccctgcagcgcgtcgatggtctcgaacaggagctggtagcactcgtgcttctccttggggacctttgccgcgtagtccgggataccgcccgtattgacgatgtcctcgtaaaacaggaactcgtcgcagttctcggcgagcagggtgctcgtcgcctccttggtgcccaccccgatgaccgtcttgccaaactccttgagcttggcgacgagtggcgagaagtccgagtcgccggacaggatcgcgaaggtgtcgatgtggtccttggtgaggcacatctccattgcgtcgacggcaaggcggatgtcggccgagttcttgccggtgtaggcgcggtcgggtatctcgatgagctcgatgccgagctcgtggagtggcgtgatggcgtcctcgaaccgctgccagtcgcagtaggcgcgctttgcggtgatgcggcccttgtcgaccagcctctcgaggatgcgcttgacgtccgggcgcggaccggggtcctggtgcccgttgcgccggcgcttgccagtcccgagggcgaggttctcgtagtcgatgagaaccgccatcgagctctggttggtgtcgctcattggtggtgcgttcctttcctgcgggaagtcggcggggcagttcccgccccgcgagagcatatatcagaacatacggaggtttcgtacccaaacgaggggatttcgaacctaggcgagaggaacgtgccactccgcggcggccgcgatgccatggggaaacgcggggagcccggatcccggggcctctcgcccccgtgaatccgggcccccttgcacgccgtcctcagtggcgcggagcgtgccgtttcctactcgtccttccccttgttcgagaagaggtcggtgaggcgctgcgtgaacgactcgtcctgcgtgctggatgagtcgtcgtccttgcccttgttggaggagtcgtccttcttgacgccgctcaccacgtagacgaactggacgtccttgacgttggagttgctggggtcgacgaaggagtgcagcgcgtagccggttcccaggcgctcgtcgatggcctgctgcacctggtcgaggaccttctggtccatgccgtccaccgacgccgcgagggtgtcgaggccgctcgagagctcctcggacccgctgtacgcggtcccggtgccgtcggcgagggtgcccaggccgtcctccaaggtgccggtgccggtggcaagctgccacgcgccggtcctgagggcggtggttccgctgcccagcgtgtcgagcccctgcttgagcgtcgacgcgccgcccgcgagggtgcgggcgcccgtggcggccgtcttggcgttgtcgtccacggtcttggctccgctcgcaaggctcctcgcgccggcatcgagcttggtcgacccgctgtgcagcgtgtcgagcccctgctcgagctgggcggcgccatcagagacgcgcttggcgcccgtggcgaccgcggaggcgttctggtccactgccgcggcacccgcggagagctgctcggccgcgctgaggagcgtgggattgcccgatgcgtccgtgccctcggtggtgaggctgtcgaccagctcgctggttccgtccgcgacgctctgcgcgccacccgcgagcacgctcagctggtcgagctggccctgcatccccgcaagctgctgctgggtgccggagacgagctgcttggagctgtcgaggaccttcccggactggtcgagcacaccgcttgcgctgctggtgaggctgccggttcccttctggatggtgacgaggtcgcccgccagcgtctgggcgtcgctcgacagggtctgggtgtcgaccccctgcgccgccgccgcgacaccctgaatggcctgcgcggcggactgggcgctcttggcggcgtccccggcgctgccggccgcgctgctggcgtcggacgccgcgtcacccgcaccctgcgcggcggttcctgcggagctcgcagcgctgctcgccttgttcatggcatccgtgatggtcgccttctgggcgtcggtgagactcgcgtcgcccaggagccccgagagctcgctcgcggcggacgatgcgtcacccgaggcggactgggcactcgatgccgcggactgcgccttctgggcggcggagccggcggactgggcggcggccgcaccctgctgcgccgccgtcgccgcgctgccaccggccgaggagaggctctccttgaggccaccgagctgcgactgcacggtcttgaggtcgttcgccaccttctggccgtccgactcggtcttctgcgcgagcggcgtgagctgctgggcggacgagctgatgccgtccacctcgccctggatctgggcgatctgcgcctgcagggagtcgagctgcgtgctggcctgcgtgagcatgttgggaagcgtgctggcgagttgtgtctgcagctggctcacgccgcctgcgacctgcgccgaccccgacttgagccgtgcgaggtcgcccgactttgcggcaagggcggactggagcgcggaggcgccgctggcaacctggctggtcccctgggactgcagcgcggagacgccgctcgagagttggctcgccccgtcggcgacctgacgcccgcccgctgcggcctgctccgtccccgcaaccgcctgcgaggtgccgtcggcaagctggcttgccccggaggagacggcgctggtcccctctcgctggagcctgctcacgccgtcggcaagctggctggccccggcggcgagctccgcggagccggcatccgcctgccccgctcctgacgcgagcctgtcggaccccgacgcaagctgcgtggctcccgccccgagcttcgccgccccggcgacggcgctgtccgcaccgacgttgagctggtacaggccagcggcgagggacttgccgccctggtcgagctggtcgacgccgctctggagcttggacgtggcatcggtgagctttgaggtgtcgtagtcgctcacgttggtgtcgagcgagatgggcatggccgctatctgccagccggagtaggtgaagtcgctcgccttgcccttgatgtgccagtctccgttgctgccggggagcagcaggtaggtgaccaaggtcttgttgcccacggtcgcgatggtggcgtccttggcgtcggagagcgagaaggtgccgttgtcgaaggtcccctgcgcctggaccatgaagctcttggcgaagtcggccgtgctggtgtcgtcggagagcccgtcgatcttgagctcgatgtccaggtcgccgtccttgccggcgaggtcagagggcgagacctccttgccgtcgaggcgataggtcaccgagacgttccagggaagctgggtcgaggcgtcgaggtcgccctggtagtagaagggcttgccggcgagcgtggtcacgtccaccttgccgccatcgtcgtccagcttctgcgaggtggtgaggttctgcagcttggtgtaggtgccggggtcgctcacgtcctgcgcggtgtcggtgtcccagtagttcaccacgtagacgccgctcttctcgcccgcggcatccgtctttgcgtagacgatctccttcttggcggtctgggaggttcccttctgctcggtggagtcggggtcggtggtctgcccgttcgcctcgtccgccatggcccgcacggcaccgaaggggattgacatcgagatgcccaggaccgcgctcatggcacccgccatgacccgcctgccgcgccccatgccgccccttccgggaaggtctccgctcgcataccgcctcgtgctcttgctcatgtctggtcactccgatttcagtcagtcaacgtttcctgtgccttggtggggtcacgccttgtcgccggtcgccctagtgggtgccgccgtggcatcgcctccgtcactctcgccccgatagaacccgagcttgtagctggtgtggcgcacaaaggcgtcgcctcccgtgaagagcaggggcaggacgaagaagatctcgatcaccgagatgagcgcgccgcgcgcgatgagcatacccacctgctggatcatggggctcgacacggtgaagtagatgccgaggcacgcgaggatgaggattgagctcgacgtgatgatgggctgcgcggtcttctccaccgactggatggacgcgtctgccttgggcatgcgcctgcgccttgccaggtactcctccgtgaagatgatcgcgtagtccacggcggcgccaagctgcaccgcgtctatcacgaggaaggccacgaagttgaccgtctcgcccgtgaagtacgggaccgcctcgttgatccagatggacacctcgatggccatgagcaggatgatggggatcgagatggacttgaacatgacgagcagcaccgcgccgatggcgaggatggacgccaacttgaccgtcgtggagtccgatgacgtgacggagcggatgtcgtagtacgagacggcattgcccaccaggcggtacttgtcgccgtagtgcttctggcagatggagcggaccttctccacgaggtcgaaggcgcccttggactcgtcggggatgcccgacgtgaggacgatcctgctgtagccgccgctcaggagctggctcacgtcgctcttgtcacccagctgggtgggcagcgccgagcccgcgatggtggagtacgagagcacctgcttggtggtcgggagcgccttgagctcgtccacgagctcggtctcctcgctccactccccctccgggaccatgatcgcccaggtctgcgactcgccaaacgccttgttgatgatgtccccgtcgatcttgacctgtgacgtgggcgactcgttggcggcagaaccgtacgtgaagctcacgcgaccggatgcgatgaggcacggcacggcgagcaccagcgcgatcacgaacgcggggatggcacccttgtggcagaagctcgccatcttgcggaagctcttgaagaacggcttgtgggaggtcttggcaaccgcgttgcgcatgccgtacaggatgcagggcatgaggagcgtgatggagaggaacgagcacacgatgcccttcgcgagcgcgatgcccatgtcggcgccgatcaggaactgcatcgcggcgagcgagaggaacccgaagaacgtcacggcggcagacgagaggatcacggggaacgacttgctcatggccatgaccatggcctcgaactggtcgtcggtcttctcgcggaaccttccaaagttggtgaggaggacgatggagtagtccatcgacacggcgagctggagcaccgaggcgacaagctgggtgatggacgagatggtccccctgaagatgttggtccccatgttgagggcgatcgcgacgccgatggtgaggagcatcaccacggggtgcaggtagctggtggtgttgaggaggaccatcacgaacacggtgatcacggcaatcgtcatgatcttggccatgtcggtgttgatggtggcgaggttggccgcatcgtccaccgccgagccgtcgatggcaacctgcttggcacccgagagcgacttggccatcgagcggatctggtccacctgcgcctggtcggttccgctcgccagcaccacctggaacaggtagcccttaccgtcgcaccagtccgagatggtgtcctggtcctgaacctccagcggctcgtccatgttgacctcgtcgcccagccaggtgacggagactacgtcgtcgagccccttcaggttgtcgtcaaacttctgcgcctcggtcttggagatgcccgtgacgtacacgcgggcattggtgatgtcattgccgtaaacgcgcttcatctcggtcaggtcctgcgacgacttggcgcttggcggcaggtagtcgctcatgttcgcgtcgatcttcaccatggggatgcatgccaggctgatggcggtgaggaccacgaagatggtcgtcaccagctttctgtgcctcagcacacccctgaagaacccatccatcgacagtccagctcccctctcgcaccgctcgccttttctgtactactgttggtctttgaacacctgttgttttctacccgcattcaattattgttatgggggagacggcatcaatcaccaatgtcagctcttggtgtttgttgtcggtcacgcagagggcagattgtttggattgagagaaacgatggccgaaaagaagaaccgaaacgcacttcgatcgattcgcctcatcaaggaggccttcctcaagctcctggcgacggaaccctacgagaagatcaccgtcacggacgtgacgcgggaggccggcctcaaccgtggcaccttctacgcacacttcgacgatatggacgacttgctgcaccaggtcatcgacgaggtggtggagcgtgcgtcggagctgctgcagcagtcgctcgactccgcctttttggagaaccccctaccggtcctggagcagctgggcaggtacatgggcgagagctacggcttctacggccgcgtgctcaactcggcgagctccgacatcttcgtgaagtcgctgggcgccatgttcgacaagaaggtccacgcctggatcgacaaccaggacatggacgaccccaccacgcagatcatgctgtccgactacctggtgggaggcatcctgcgcacctaccgcgcctggatggagggcgagtacggcaacatccccatcgaggaggtcaacctgagactctgcgcctttgtgaggtccacgggcaggctcttcctcaggaagccccagcagcagtaggcccgagggacggtacgacgaggggcggccccggcaagtgccggggccgccccatctgcgtgcgtggttcgagtaagagacccggtcgggtgctaccccctgctcccccggcggttcctgaagcccttggaagcgctggcagcccccttggacgcgtccctctccccctcctcgttatcctgggagacgctcatgtactcgggcatgggcgtgccgtcgcggcgggcgcgcctgactgcctcggcgttcttgtcccccgcccggcgaagctggtccttgttgacgcccagcgagcggtcgatgaacttccaggggccgctgctctcgccaaactccatcttgaggcccgcgatggcacctcccatgccaccgatggcgacgccagcgaggagcgagaaccccgtgagcccgatgaccatgctcgcgatgacgcccaccacgacgatcttgaggttggcgagccaatactccttggtggtgacgacgttcttggccatctccgcgccgatcttgctccccaccacgatgccgaagaggaacagcagcagggcaacgatggccatggagaacgcggacacctactcatcgcccccgtcatggtggtggcagtggcactcgtggccctctccgtctccgtgcccgccgcagcagccgtccccatggcccccgcagcagccgtcgccgtcctcgtcctcgaccttggccttgctccagtcgagcccggccttctcccccacctcggcgggggcgtagaggagcgagatggcctgggtgcccagccgcgcgccgcccacctggcacaggagcttgtacaggttctcggccgtggcggtggagggcatgccgattcccagctcgtcggccgcgtcgagcgagagggtcacgtccttgaggaggtgctccgagaggaagcccgggcggtagtcccccgcgagcgacttgggggcgagcctctggagggcgaccgagccgcccatgccgctcgagaccgcctcgagcatgcgggcgacgtccacgcccgacgcctcggcgagggccattgcctcggcgtaccccatcatgcacgaggcgagcgacacctggttgcagagcttgaccgtctggcctgcgccggcctggtcaaagtaggtaatcttggacgagaagcactggagcagcgggagcacgggctccgcctccttgggcgtggcgcccacgaagagcgtgagggtgcccgccttggccccctcctcgccacccgtgaccgggcagtcgaaggcgtggcggtcgtcgacctccgcggcaccgtggatgtcgcgcgcgaggtcgggagagctcgtggtgaggtcgatgagaaacgcgcccttcttggacgagcgcaggatcccgttggtggagaggtacacgtcctccacgtcggtgggatagccgagcatggtgaacaccacgtccgcccccgcgaccgccgcagccacgtcgtccgcccagtgggcgcccctctccaccaggccatctgcctttgactttgtcctgttgtagaccgtgacgtcgtacccggcgtccatgatgtggccggcgatgggggctcccatgatgccggtgccgatgaatgcgaccttggcgctgttgcctagggccatgtgctggctcctctccagacggaagggccgccctgctgctcgctggacggcccccaaaaccaacttgctctactccgccctgccggcggaacccttcctgaccttgcgggctatgcggtccgtgagggagaccttctcccttcggtcggtgccccagaaggcgagggcgaccatgccgggacccacgtgcgaccccaggatgggcgagacggtgctgtggatgatggtgacgtcctcgcagcccttctccttgcgaacctgggcgtcgagccagtccgcgtccttcctggcgtcggtgctcacgatggcgagcgggagcgacgtgtcgtgcgcatagttgtcgcggaagtcctgcaggatggcgcgaagcgccttcttgcggccgcggcacatcccacggagggtgagcgcgccgttgaggtcgtatgacagctctggcttgatgtcgagcttgccccccacgttcgccgccgcgggcgggatgcgaccgccggcggcgagcgcatcgaagctctcgagcgtgaagtagccatggatgaagtagcgggcgtcctccgcccactccacgagctcgcgggcgttgaggccgttggacgcctggcggcagacctcgattgccaggagctcgcccgccgcggagtcgcagcaggtgtcaaccacgtagatctcgaacccagggaactcgtcccgcaccatctgcgccgcctggcgcgcggagtcgatggagctggagagccctgcactgaggccgaggtagatggtgggcatgccatccctcgcggcacgggcgaacacctcgtagtagttgcctggcgtgaccgccgcggtgtggaagtgggcctcgggattcttgcgcatgaactcgtagaactcgtgcgggtcgcgcgacttccacatgtcgtccacgtgctcgaccccctcggggtcgacgtagtggaaggggatgacctccacgcccagctgctccgccacgccgggggcgtagtctgccgtggagtccacgatgatgcggacgttcctcttctgatgataggcccggccgacgcgctcgacgtcggccggggtcaggttctgtggctctgacttgttctcggacatcaggctcctatgcctcgccgtcttccgtctcgatcctgggcttcaggattccataaccaccattatggcggtggtagatgacgttgacgagtccggtggtcgcattctcgaaaacatagaaatcgtgccccaggaggtcggtctgcaccagcgcctcctcctcggacatgggcctgaggtcgatgtacttctcgcggaccagctggtcgtcgtcatccgcctcgatgaggtcgcccaggtcgtcgatcgtggcacccccgcgaatggtctgcgcggagcgctgcttgcggtcgaccaccctggtcttgtacttgcgcagctggcgggtgaccttgtccgccgcggtatcgatggccacatacatgtcctcgtccgccgcctcgacgcgcaccacgttgtcgcggacgaacacggtgacctcgcacatcttgcgctctgggttggagcggttcttgtcaacgcgtagcaccacgtcgcacgacattggtttgatgtcgaagaccttgagggcgtcccctatcttctcgttgacacgctggcgcatgccatcggtaacggagaccttgcgtcccgagatcttgatgtcgaccatcagtacctcctcttgtcgcgtttgaacttcgtaggagacaacctactgtgccctctagatacccctttgggctcttgggttacaggcggattcgacaagcggtcacagattggcgacgctcacggcccccgtgccgacgcccgcaagggaggcctgcgacgtggcggaggacgcgtcggaggagtcccctgacagcgaggtggcgtcgccggacgactcggggacgtcctggacctggttctgggtccccagctgtgccatgccacccagccagcgcgagcggaccaggtcgtagacgccgttggacgagaccgcgtcgtaggcggactgcacggcgtcctcgagctgtgcgttggagctcgagacagcgaccccgtaggtcttcgccgcgtcgagcgtccccacgaaggcgatgtcgtcgtactggctcgcgaggtacgcgccggagcaggcgtcgcacagcacgtagtcgatctgcccgccctccagggcggagaacgcgtcgttgaggttggagtaggtcttctcgctcatcacgaggcccgtgttctcgagcgccctctgcgacatggagccgtcctgcaggccgacggtcttggacgagaggtcgcccaccttggcgattcccgtgtcgcccttgtggaagaaggccgtcgcggactcagcgtaggtgcccaccaccttggcagacgacgcctcgccgtcggagaggtccatgacgatgtcacaggtcttgcccaacgagtcgctgacggtggaaacacccacgaagcgaaccttgagccccatctcgtcggcaatcgccgacgcaaggtccacgtccaggccgctcagggagccatcctgcgcctccacgagcaccggtgccgagaccgcgcccgtgcgcacccccacggtgagggtcccgggcgagacgagcgcggtgtcgtccaccgtcgccgtcttgccggacgagagggaggcggtcgcctccgccacggaggggtagcttgccttggggaggccggggagggacggggctgagcaggcgcacaacgagaacgaaacgtacgccgcgatccctgccgccaccgccctgctggccaccctgctctgcatgttcccaacaccccgcgcgttcgtcgccatcccaatgccctacccagctgacctggtatttgaccccacactcgcgcacaggggcttttgccgggtgcaccgcggtgtcccgactggaggccctctcgcccgcgaggccccatgccccatgtgtagacgggcggtgcgacttacctctaggacgagccatgctcgcgcgcacgcgcacgcacgcgcttacgtggatccttttgacctcgtctgccatggactagggagccacgagggcgcccgcaaccacagacctgggtaaagcgagtcagagtataccagcaaacccctcatgggggtcgcagacccgcatggaagcagggatgccattgcataaacggttgcaatcttccaatgaggggtcacgtgacgccaccgcggaacggttttggggccttgggacctcaccacacccgggcgagcgcgcagcaggtaacctcggaggcgccgcgcgcgaggagcgcccttgtgcactccctcatgctggcgccggtggtcaccacatcgtccgcaagcagaaccctgaggccgcgaacgtctcccacgacgtcgaccgtgccgctgaggttgcgggcacgctcgtccctccccagcttgcgctggtcgcgcgcaccgcaccggctgagcgcgtccagcagcgggatgccgctgagccggcagagctcgcgggagacgagctccatgtggtcgaagccgcggcgcaggtacgcctcgggcgtggcggggacaaagcagacgacgtccggcgcaagccgcccggtgcctcccccgcacgcgcgccatgaggacgcctcgtccagcgcggtcgccatggcggcggcgatcaccccggcggcacggagctcgtgcgaatccttcagggcacaggccatgcgagcggcgacgcccgagaacgggagggcgcagacggtggcgcccatctcccagtctcccttgcactccgtgcaggtgagccagccaaagggggcgccgcacacggggcaggcgtagcgctggtctatccaggggagacgggcgcggcagtcggggcacagcagctcacccgggagcccgcagcccaggcagcgcgtgggccacatcagctcgcccacgtctgacaggaggtctcgcagcggcgacccggggcgccccggcgcgcacggcgaaaggacaggggaacttggcatgggcgtctcctcgcacgtgatcgtgcgtgggggcgcgtcgggttgcgaccgacgctaccaggagacggccgagccgcgcaagcgcgagatggtccgggcgtaccccacgaaaggggcgtcgattggtcttgggtggcagcccccaagcctcgccggggacttgcagagtacggtgcgggaaagctcgaggccaccgggcgccaggagacccgttcttgcagcctgagggcgcttgccgcagctgcctgctgagaaaacgcgagttgtggcaatcggagacggacgctcgcgccgcaatgacgggattctgctgagaaaacgcgacccgtggcaatgaggggccggcgacgattgccacaactcgagattcctcagttgttcgggcgcgcggattgccacaactcaagattcctcagcaccatgggggctgcggtgatgaaccaggcggcaaacgagccggggtcgcgggcgagctcgcccgcgaggtcgtcggcgaaggcccagcgcacgtccatgacctcgtcggggtttggccgcacgtcgccgtcgtactcccccaccatcacgtggtcgtactcgtactcggcgagcccgttggcaaagggcgcatagtacacgaacgagcccacctcgtggcagacgacgcccgtgacccccagctcctgggcgaggcagcgctcgaccgcctgggggagagactcgcccacacgcgggtgcgagcagcacgagttggcccacagccccccggagtggtacttccccaacgccctgcgctggaggagcagctgcgtcctgccgtccacgtgccgccagaggaacacggagaacgcccggtggaggaggtggcggcgatggcagtcgagcttctccgcctggcccaccggctggtcgaggacgtctacgaggaccaggaggtcgtctccccccgccatggtcccacctcccgtcgtgaccgcccgggcaggcactgccctacccctgccaggggacgaagcggtcgtagtcgatgccaaactgcatgagtaccttgccgaccacgtggtcaacctgctgctgcgtggtctcgcacccattgtagaaggtgagcatgggcgggacgatggaatagccgtcctcggccgctcgcaggaggttgcggcagtgactgcggttgaggggcatctcccgcgggaccaggacgacacggcgcccctccttcatgcacacgtccgcggccctcacgaggaggtcgtcgtcgtaggagttgaccatggccgagaggctcttcatgctgcacggggccacgatcatgccgtcggtccggtacgagccgctcgagatgggggcggccaggtctcggttgtcgtaggtaacgtccgcgagggcctcgacctgctccatggagaggccggtctccctgccgaagatgaccttggccccctcgctcacgacgaggtgggtctggacgtcctccacccccgcaatcgcctgcaggacccgatacccaatctggacgcccgtggcgccgctgatgccgacgatgatcttgcgcatatggactcctcggtccgcatgaaagccagttacaaatgaagcggggccccacggctggaatgcagcccgggaccccgcagccccgcggggccgcccgcccagggcggacggctcccaagggaagcctgttacatcaggccgagcatgtggaaccaggcggcctccacgagcacgacgatgaagaccacgacggtgagggggatacccatgcgcatggcctccttggagctgtagccggcggcgtcctcgccctcgccaaccaggatcgcaaggttgtggaagggcaggatgtagtggatgttgatggcggagaagaccatcatgctcacggcgatggggctgatggacgtacccgaggtgaacgccaggaacgccgggacgcagatgcccaggaccgccatgaccgagcccatgaacatgtggatgatcacggtgatggcggcgatcaggagcgcgagaacgaagatgttgctggggacggagctgggaaggaccacgttggcgatccactggttcatgccagttgcgctgcccacggtgccgatgcccatggcagcggtgaggaacacgagcgtgttgatgggcacggagttccaggtggacggggtgaggacctcgccgatgacggggagcgccatggccgcgcccacgatgagggtcacgaagccgatgttgaagccggtgatggactcggtgagccagagcgcgatggcgatgacgagccacacgacgacgcgcttctccttggtgctgacggggccgagtgcctcctggcgctccctgacctcgtcgaagtcgatggtcatctcacgctcgggcttgaagaggcgcagccccaggaagagcgtgcagagcgtggcgacgagcatgggcaccgacatgtagaagaaccactggatgaacgagacgccgtccttggcgtacgaggcgacgagggggttgagcgttgcgtcgccggtgaggaagaacatggacccgggcgcggcggcggcgaaggtgaggaagccgaccttgaccttgtccgccttggacatcttggcggcgtcgcagatggcgatcatgaccgcgaggatcatgaacgcgcgcgggaaggggtgcgggatgatcagcgagaggatgaaggtgagtgcgaagatgctgatcacgagcgacttccagtcgcgcacgaacttgatcgcgaaccagtaggcgatcctctcgcccaggcccgactccttgaccgcagccgcgatgaggtaggcgccgatgaccatccacatctgcatcttggtccacgaggcgaacaccgtctcggcgtccgaggtgccggtgaggatgaggagcgagaggtagatggccgagacgtacgcgggctgggcgacgccgcaggcccaccacacgacggtcatgagcgtgagggcgaggcagtgctggccctgcgcgctgatctcgccgagcgcactcaggggcgcgacccacacgatcgcgaggacgacgaggccggcgaacaggccgacggtcttcttgttgagtttcacgaaccaatccttcccttggggcgcgggcgggatgcgcccgcgccacgtcgaggcttgcgggtactaggcctggagctccttggcccacttctgcttgtcgatctcgaggaacttgctgcgctggaagttgtccttgaggtcgaagggcaccgtgcagtcgaagatcgccttgcacgcgatgccgtggaagcggatggagagatccatcgcggggtcgttggaggggtcgagcacgtggcagtggcagccggggatcgcgatgaggtcgcggtcggcctggaagcgcgtggtcatggcccacatgacgtcgttcatgtcgaagatgtcgatgtcctcgtccaccaggaacacgtgcttgagctcgctgaacgccgagaaggcgagcatcgctgcgttacgctggcggccctcatcgttcttgctgctcttcttgaactgcaggatcgcgacgaacttgccgccgccgcagggcgccgcgtggacgttgagcaggcggccggggatggcggtctcgaccatcttgtagatggacgcctcggtggggatgcccgccatggagacgtgctcgtgggacggcccgatgcaggactgcatgatgggatgctcgcggtgcgtgacggcggtgatcttgatcacgggcagcgcgggcttggcgtcgccggtgtagcccgggaactcgggcatggccttgccggtgttggagttgacgtcctcgcggatggtcttgtcgtgcagcaggtagccctcgagcacgtactcggcgttggcgatgcacttctcgggaacggtgaggcagttggccagctcaacgggacggttgcggatggcgcctgcgatctgcagctcgttgtagccgagcggcgtcgtgggggcctcgaagcctgcggacatgtagaccgcggggtcaaggccgatggagatggagatgggcatgtccttgccctcggccttccagcggtcaaagaacgcgcccaggtgacggctgcccggggtgatccacatgcccagctcgtccttggactcgatgcagaggcggtggatcgtgacgtcggaggtgccgttctcggggtcatgccccatgcacaggcccatggtgatgtaggggccggcgtcctcgggggtgttggtgggggcgggcacgagggtgcgcaggtcgaagtcggggtcggtggccttgtgcacgacctcctggcagtcgatgtgcttgccctcctcgatcatcaccggcgggatggtgtgctgcagcttcttgcccatctcgaggcccaggtgctcctcgtccatgccgatgagctgcgagacgcgcttgcggctcgcgagcatgccgatcacgaccttggcgtcggggaagcccttcacgttgttgaagagcatcgcggggccctccttggtcgggcgcatgaccgttccgcccgcgccgacgtagcggtagacgccggagacctccgcgtcggggtcgacctcggtgtccgtggtcagcagctggccctgctctccctcaaggaactcgagcgcgcttctcaggtcgtgaatctctgccatgttgtccctcctgcacgtcgcgtatggggtggggatgacttccccacccccgtttcggcacgagggtagaagtgtgttgcaactatcaagtcaagcacatttttcccaaatggcttggaattggctggggagagggacgctggcggacgcggcggaggcctatccctccggcagcacgggaatctcgagcctgcagaggtccgcgtggtgctcctcgttgtagaaggccgagtccagcacgcaaaggtcgaagacgtcgccgcacggcacgaggcccctctcgcccatccagtcgaggagcttcctcaccggctcccagtcgtagggcatcgccaccttgtacatggtcacgtactcgccctccgggagggtgaccatggtggccccgggcacgtcccgcccgttggggaccagcacgatgctgcccgccccgtcgaggggattcggcgtgccctggctcgccgcgcgcaggacggacccaaaccccatggaggggagcatccccgcatcgagcagcttcccccaggcgcccatgagggcaaggtgcagcttcatcacgtccatgtccccctcggggtagggcgagaagatcgccttgcgctgcgggagccactccacccggggcaggttgaccgagcgcgccttggtcgcggagtgggagaagagctcgcccagctgacgcacctcgctcagctgctcctggagccgctcgatctgggactggatggcatcctcgcgctggaggaggagctcgatgacgccgtcgaccgagcggtcgcgcatgaaggcgcctatctgggcgagggggacgcccatctccttgagcaggcagatgagcctgagctgcggaatctggccgatgctgtagtagcggtagccggactcgctcacgtacgcgggcttgagcaggccgttcttgtcgtagaggatgagcgtctggcgcgagatgccgttgagggcggccatctcgctgatcttgacgagccccttgcggtcttccatgggcacctccggtgcgtggcggcttgcgtgggagagacaccacagaactgtattgcagcttcacagttgggtgccattcaggtttgccactgctcccgaaaaggcatcgccggaggcggcggccttcgcggccaccggtgcctagagcgagaggaacgaccgcgcgttgtcccagagcgcatcgtacgtgcgctggcggggggcggtcccggcatcctccctcacctgggcgaggcttgcggcggagaaggcgaccatggcctcctcgcactcctccccgcgcagggggacgggggccatgtacggggagtccgtctccgagagaatcagccgctcggggcactcggccgccgcctggcggatgtcgtcgctcgagcggaacgtctcggcgccgccgaacgcgacgtgcgagccaagctccacgaacggcgccatgatctcgggcccctgcgtgaagcagtggaggtcgcagccgcgtcgcgggacgccgtcctcgcgcaggacgcgggcgacgagggtgtgcgccgtgacggcctcgtcgtcccgggcgtcgcgaacgtgcagctcgacggggaggtcgcgctcgcgagccacgcggagctggtcgcgcagggcacgctcctggggctcgggcgggacgtcggagtacgggccgaggtccacgcctatctcgcccacgcccacgcagcgaggggagtcgagcaggagcgagagcctctcccccaccgacgggtcgtccaggtagtcgacggcaccgtacgggtggactcccgcgacgatccacacgttgtcgagcagctggggcaggccgggccgggccgggaactcgggcgggaccaggccgatggaggcgtacctgtcgagcatcccgcgcgcctcgcccaccttggcctcgaaccagtccaggaacctcgggacgtcccggacgtcgtccgccgggtcgaccgggaccacgaggagcctcacccccgcgagggccgcccgcgccagggcgttggcggcgtcgtgctcgcggaacaccgtgaggtgcccgtgggtgtcggcaagcggcgcgagggatgcggggcactccacggcccggccgcgcacgtcgtggaacagcgagccgtcctcccaggtgagcgcgtcgagccgggaggagctgggggagtgcctcccgctcatgcgaacgccccctcgccgagctcccgggcgaggacgacgaagtctgcggtcgagagccgctccgcccggacggtcggctcgatccccgcgcgcgagaacgcctcgtcgagggccgccttgtcaaaccccgaggaggacatggagttgcggatggtcttgcggcgctgtgcgaaggcagcgtcgatcacgcgcgccgtcgcctcgagcatggagggcgagaggtgctcccccgtctgcgggtccagggccggcctgcggtcgatgcgcaccacggcgctctgcacgtgcgggggcgggaggaagttgcccggccccacctcgaagcgccccgtgaccgtgccgtacagcccgagcttggccgtgtaggcgccgtagtcgcgcccgcccggggtcgccgcgatgcggtcggcgacctctgcctgcaccatcacgacctcgcggtgcacgtggggcatggtctcgagcgtacgcaggatgatggtggcggcgacctggtacgggaggttgctcacgagcttggttggccttggggagggaagcggcctgcccagcagggagaccgcctgggcgaggtcgtcctcccccacccccagggcgtcgcccatgaggagggcgaaccgctccgagtcgcgggcgcaggtgctctggagcacgggctcgagcgaccggtccgcctccaccgagcacaccgcgcccgcaagcgggagcagcgccacggtgagggtgccgatgcccggccccacctcgaagaccacgtcgtcctcgcccagctgggcgaggtccaggatcgaggcgatgaccgagtcgctcaccaggaagttctggccaagccgatgctttgccccatggccaaactcctccagcaccagacgggtctggcgcgggttggcgagccaggagcagggcctgtcgccggcgtccgccaccgcgctagcccctcttggcctggaggcgggggaacagcgcgtcacccttggtgacggggacggaggaggcgaggccaccccactcgcacacggccgcgaggtcgtccgtctgcgcctctccgccaaggctcatgcggcgaaggacctcctccgaggtgctgggcatgaagggcgccagcaggtgggcgcagatgcggatggactcgagcaggttggtgatgatgtccgcgagctcctgcgcgcgggcggggtccttggcgaccgcccagggcgcggagtcctcgatgtagtggttggcggcgtgcacgagctccatcaccacgtccttggctgccacgtactcgagcttgtccatgtgctccgcgtagcgcccctcgatgcccagcgcgatgctgcggagcgggttgtccctctccgcccagccgtccgcgagctcgggggtcttgccgtcaaagtacttggcgctcatgttgagggagcgagacaccaggttgccccagctgttggccaggtcggcgttgtagacctgctccatgcggttgaagctgatggcaccgtcctcgcccgggacgcagtcggtcatgaagtagtagcggtacccctccacgcccagcatgtcgatgacctcgcgcggcgcgatggcattgccgcgcgacttggacatcttctctcccttgccggtctcctcgttgcgcaccatgaggaagccgtgcgcaaagacgtgctcgggcagcgcctcgttaatggccatgagcatggcgggccagatgacgcagtggaagcggatgatgtccttgcccacgatgtggtactgggccggccagcggcgggcgaactccgccttggcctcgggggtgtcgacgccatacccaaccgccgtcatgtagttgaggagggcgtcaaaccacacgtaggtgacgtgcttgtcgtcgaaggggaccgggatgccccagtcaaagctcgtgcgcgagaccgagaggtcctggaggccgccctcgacgaagctgcggacctcgttcatgcggaagtcgggctggacgaagtcggggtgctcgtcgtacagcttgagcaggcggtcctggaacgcggagagcttgaagaagtaggactcctcctgcacgcgctccaggggacggccgcagtcggggcacaggtgctggccctcggtgtgacgctcctcgtcggccttcgacacctgggtctcggtgaagtaggtctcctcgggcacgcagtaccagccgtcgtagctgcccttgtacaggtagccagactccctcatgcggtcccacaggtactgcacggcgtgcacctggcggggctcggtggtgcggatgaagtcgtcgttggagatctcgagctcgcgccacaggtccttgaagagcggcgcctggctgtcgcaccactcctgcggggtcatgccgtggctgcgcgcggcctcctcgaccttctcgccatgctcgtccatccccgtgaggaacttgacgtcgtaccccgcggcgcggcggtagcgcgcctggacgtcgcagaggatcgtggagtaggcggtccccaggtggggggctgcgttgacgtagtagatgggggtggtgatgaagaaggacggcttgtcgctcatggggtctcccgattcctgatggcggaacgtacaacgggggcaattgtactctgggagccatggagacccgcgggaggcggccccaatcgaaaaaacacccgccatgcaccatggttccaggcgtcgggcgagaggggcaggacggcggggcagcgcctacgacccgccggcagcccggaggacgcactcgtacacctgggcgcgcgggatcccgtaccgcttggcgagcgccttggcgagcgcgctcttgggctcgccggacgcgagcccctccgcgatcgcctcatccagggtcgggagctcggccgacgcggaccgggcgttgcgcagctcgtcctcccccggcggggcgatgaccaccacgcactcgccgcgcaggccctcccgctccgcgacctcgcgggcgagtgcgggggcgacgtcgcgcacgacctcctcgtgcagcttggtgagctcgcggaccagggcgacgcggcgcgacggcatgacctgcgccacattcgcgagggtggctgcgaccctgtggggggactcgtacagcacgatggcgccggggatcgccgccagctcgcccaggcgacgcagctggtccccccgcttgcgggggaggaagccctcgaagaagaagtgctccatggggaggcccgacgcaacgagggcgcaggtgaccgcggacgggccggggatgacctcgacgcgatggccggcaaccagcgtcgcgtcgaccagctgctggccggggtcggacacgccgggcataccggcgtcggaggcaaaggccacgcgagccccctcgtccagaagagagaggaccctctccacgcggtcggcgatcacgttctggtcgcaccgctccagcggcacccggatgtcaaagtgggagaggagcctgcccgtcacgcgcgtgtcctcgcacagcaggaggtcggcctccgcgagcgttcgcagggcacgcggagaggcgtcgtccaggttgccgatgggggtgcccaccatggagaggagcccggcgccccaggttgcgccgccctcccctagcacagcatcccccgctcgaacgtggcgagcgagacccgggcgtcccaccccgcgaggcgcccctccgtcttccaggtctggaagaaccaggccgggcagccggagaacatggagatctgctcggagatgaagacgcgctcaagggcgatgcgcccctcgggcgtggtggaggagtccgcgaacgggagcgacccggaccacttgcccaccatcacgggaaggccgctgcgacgcgcctggtcgagctccttgcgcgaacggtcggcaagcttgcgtatggcggtgggcccgattgaccccacgttgtcgaagtagcggtacaggtggcagtcgagccaggcgttgtggtagcggcgctgggccatgaagcgtccccaggcgccatgctgcccggcgtccgggacgatgaccatcacgtcgtcacccgcggaggcacggatgcggtcgtacgcgtcacggtagtagttgcgcagcacgtggagcgggacgccgtcgctgagcgtgagcccgcgccggacctgtgggttggggtcatccgcaacctcgatgccggcaagggccgcacgcgtgccgtagcggtcgcagagcatcccgatgacgtcgagcatgtcctcgcggtacgaggcgaagtccccatggttgcgcacgagctcggcctcgaccccccgcacgcccgggttgatgcagaggtcgagcacgatcttgaggccaatctcgtccgcccaatcgaaggcgtcgtccaccagctcgacgcatccgacgaaggggccgggcgtggggccgtcttccccaaagacgtaccaggggacggggaggcgcacggcgttgaacccgcgcgaggcgatctgcaggaagtccgcctgagacatgaagtccgcgcgatgggcgcggacgagtccccggtagtcctcacgaccgatggcgctgacgagtgccgcctcgtcgagcaccccggagtcgacgaagagcgagggggtcacccacggctcgagcgtaagccagcccgtgaggttgactccgtgaagcggtcgcgccgacatcgtcgctcctttcatcgtgcgaggtacgaggtaatttgcagtataccgttgcaaactagcttgttctagcttgcatggcggggttgcctccgccagctccgggtcttgcggcacctctgtgcccgcccggttcacgcttcgccggggactgcctcgggaccatggggccctccggtctcacgtcccctccacgcgcgtttagggtctccggggcactcccggcgaccatgatgttaatcgcggcgttgaggtcgcggtcgatggtgaggccgcacacgtcgcagtggtacgtgcgcgcggagaggggcagcttggctttcactgtcccgcatgccgagcacgtcttgctggacggatagaagcggtccaccacatgcagggcgaccccggccctcgcgcacttgcgctcgagctcgcggcggaactccccgaacgatgcgtcctcgatggcctgggcgaggttgtggtttgccaccatgcccgccacgttcaggtcctcgatcgagatctccgagtagcccctggcgagacgtgtcgtgagcttctcgaggttgtcgcggcgctggttggcgatgcgggcatggatgcgctggacgcgacgccttgccctggcacgacgccttgaccccttctgtctgcgcgagaggtcgcgctgggccctgcgcagccgggcgaggcccctccgatagctcctctggttctcgaccacggtgccgtcggagagcgtggcgagacgggagatgccaagatccacccccaccgaggggcccctcggctggggggaggctgcatccggccgctcgaccgtgagcgaggcggaccagcggcccgcgcggcacgagacggtcatccgcgtcacgtgggcgccaccgacccgccgcgccacgtcctccatgcagtggacgcgccctatccttggcagcctgagggccttggggtcgtcggcgatgaggccgaacgagccggtcgtgtatgcgaacctgggcgtggccctcgccttgcccttgaacctgggaaagccgacggccctccccctgcgcctgccgcgcctggcgtcgaagaaggacctgagcgcacgggacaggcactcgaggccgtaggaataggcctccttggagttgtccgcccaccagggggcgagggcgtccttgttggcattccaccaacggcgaagggcgtagtgcgagaggtcgggcctttcccctgcctcaagctgcccttttacgtgggcaagcccggcattgtaggcaaagcgggcggcgcccgcgtgcgacaggagcatgcgcgcctgcctgggcgtggggtcgagcacgaccttgacggcctcaatcatcgcagctcgccgcctcgagggcacgctcggcgcggtgcttggcggcacgcctcccatagagcctcgcgcagaaggaggtcagcgcctcggtcatgtcgcgcacgaggtcatcgtcgagctctgtgtcgtccacgacgatgatgcgacgcccctgggccgcgagcgcgctctcgatgagtcccgcgttcatgcgggcgaggcggtcgcgatgctcgacgacgatggtggtgacggcagggtccgcgaggaggcggctgagcttgcgccgccggtcgctcgtgccgcttccgacctccgtgaccacctcgggctccacggcccccaaggagatggcaaaggccttgaggcggtcggcctgcctttgcaggtccgccctctggtcgcccgagctcaccctggcatagcagacgatgcgcccgcgggcgggagcctccagcggcgcctcgtacttcgggtcatgcacaagccagacgccggtctgcgtcttttcgacgggcaccggcatcttgccctcacggcaccacttccacaccgtctgttcgttgaggccctctcgttcggcccattccctggctctcatagggtaaagattagcatattagaacaagctattacaagctatttagctagcagattgctaacctcgaccccggacaataggtcgttcgtgccgcaagctggccaagagtggctgaaggaggccggcgacggcatgcggggcggccccttctccacggcttcgctatcctcttctgggagaatggggaaatccgcatgcgaagacgggaggggccttggttcgtgacatcgtgcgctcgcgcatcctgctcgcccgcccctcccggccggcgaccgccgacgacctcgcgataggggccgaccttgccgacacgctcgccgcccactcggacggctgcgtgggcatggcagccaacatgatcggcgagcaggtccgcgtcatcgcggttctcgaccgccatggacgaccacgcgtgatgtacaaccccagcatcgtctggcacgagggtccctaccagacggaggagggctgcctctgcctcgaggggaccaggcccgcctccaggtggcgccgcatcgccgttgagtaccaggactcgtccatgcaaacgaggacggggcggttcaacggcattgaggccgaggcgatccagcacgagatcgaccactgcgacggagtggtgatctagtggcgtcgcgcgaccagggtagggacaggcgccgctcgtccgggacaccccgggggaggtcggcgagccctcgctcgaggggtgccgcgcgcccctacggcgagcggacgtcctcgggtgggcgccgaatcgaccgctcggaggtcaggggcaccgcccgccccgccacgcgcccgtcgaggaggaccgccacgccccgcgaggcaccgcgccggacccgcgaggagcgtccacgcccccgcccgacgcgcgcgcccggagagccccgccgcacgcagcagcgccccgagcgcaggagggagcagccgtacgcgcgcaggtcgagcgaggaccgcgccatgcgcacggcgaacgaggccatcgcgaaccagcggccaaaccagagggagctgatgcgccgcgagcgcaggcggaagctccttctccccatcgccctcgtcgccgcagcgatcgtcgtggtggtggcggtgacggtgacgcacccctcactgctggcgccacaggaggagaccaaggtggaggactcgtccgcgcaggaccagaacgcggacatctcgcaacccaacggcctcgtcggcctgcagtttgccgccgcagacagcccgaccctcctgaagcagccgtacgactggtcaaacctggacaccagcggctcctactacagctatgccgtggatgggagcaccgagtcggtgctgggcatcgacgtgagccagcaccagggcgacatcgactggaagaaggtcaaggcggccgggatacagtttgtgtaccttcgcgtgggctaccgcgagtcgattggcgcaaaggtgtgcgccgactcaaacttcaagcagaacctgagcgacgccaaggcggcggggctcaaggttggggtgtacttctactcccaggcgacgaccgaggacgaggcccgcgaggaggcggacctcacgctccagatgctcgacggggcctcgatcgactatccggtcgccttcgactttgagccaaccaacgactccagcggcacaagggtctcgaacctctccgccgaccagatgacgaaggtggccaaggcgttctgcaacaggatctggagcagcggctactccacgatcatctatggcaactccgcggacctctcgctctacaacctgagcgacctcgcaaagtatggcttctggtacgcggagtacggctcgcatcccacgatggacctcaactttgcgctgtggcagtacaccgacgaggggaccgtggacggcatcgagggcaacgtcgacatagacctggacctctccgccgccaacgacgcgatctcggtcaccaagagcggcgaggacgcgaaggcggcaccctcgccgtccggcagcgactagccgctgggcgagacggcgcgccgccgcaagccgcaggtgacatcacgacgcgcatggcctgccgccatgcgagacgagcctacgccaggtcctgggccgccctgcggagccaggaggtgacctcgatgtgctgcgggcaggtgccctcgcagcgccggcaccctatgcagtcgcccgccccgccgtgtccgcggacgacctccgcatactccctacgcgcgcgagcggggttgccccacaggagctcctggttcagcgcctcgaacacgtctgggatggggatgtccctgggacacccctccacgcagtagcggcagccggtgcagggaacctgctccacgcccgcaagcgcccggcgggcgcgcgacaccgcctcgcgttccccccggtcgagcgggtggaagtccgccatgtagcccacgttgtccctcacctggcccagcgttgacatgccgctcaggacggtcatgaccccgtcgagcgaggcggcgaagcggatcgcccagctggcgagggacgcatgggggttggcgtcgcgcaggatctgcgccacctcccttggcgggttagcaagcctgcctcccttgacgggctccatgaccaccaccggcttaccgtggctgcgggcaacctcgtagttctcgcgcgagaagaccgtggggctctcccagtcggcgtagttgatctgcagctgcacgaagtcgacctcggggtggagggtgagcagctcgtccagcatccgcggcgagtcgtggaaggagaacccaacgtgacggacgactccgcgtttcttctgctcacgcacgaagtcccagatgccgtagcgatcgtagttgtcgcggttggacgtctggagcgcgtggagcaggtagtagtcgaggtagcccgcgcccgtgcggcggagcgactcctggagctgcgccttgcacgtcttggcgtcgacgcaccccaggcgcgcgttgatcttgctcgcaagcgtgtaggagtcccggggatggcgctcgaccagggccttcctggtcgcctcctcggacccctcgtacacgtacgccgtgtcgaagtaggtgagtccggcgtcgaggaacatgtcgaccatctgggaggtctgctccacgtcgatctggccgtcctcgagcctcggaagccgcatgagcccaaaccccagcttgggcgtgttggtcagggcgtcaccagacatcgttcctcccccgctcttggcctcggggtctcccccgcacggggacatgatacgacgcgcggccccaaggaggtgacgcggagggcgggacgcgcaggcggagacctcacgccgtcgtggtatacgtagtcagacgcgagcgagggagaggcccatggcatccaagggcggacgggcaggcagggcgaaggcaggcgcgacgaggcatggagcctccgcgtccggctcgtcaaagggctcgcacgcctcgaaggggaccggaaagggcacgaccggaggcggtcggcactcgtcaaagccagccggcaaggcgacctcgcgcagcgccaggacggcgccaaggaagaaggcgtcacgcggatcctcgcacgccggccggcactccacgcgaccggcgggggccgtccgggtcaccggccgcatcatcatggtcgccaccatcgcctgcgtcgtgctcctggcggtctccagggtcctggtctcggagtcctccgccggcagctttgccggctcggcgctccccagctcgtcggtggcccacaccaaccccttcgactggtccaggctctccctcggcctggatgggaggccgcgctacgttgtggacggcgtgaccgagagccgcgtgggcatcgacgtctccgagcaccaaggggacatcgactgggggtcggtcaaggcggatggcatcggcttcgccttcgtgcgcgttggctaccgcgggtcgagcaacggcaccatcgtggaggacgccaagttcgagcagaacgttgccggcgcgcagacggctggcgtggagctgggcgcgtacttctactcgcaggccacgaccgaggcggaggccgtcgaggaggcccagtacgtgttgcagaagctgcagggcacgtccctctcgtaccccgtcgcctttgactacgagccaacgggcaaccaggggtcgcgcatctacggcctgtccaacgaccagatgcgcgcaatcgcagacgccttctgccgaacgatcgaggcaagcgggcgcaccgcgatcgtgtacggaaaccagtcggacctcgcccgcatggacgcggcatccctctacacgtacgggtactggtacgcctcgtacacctccgcccccacgcttgacatggcgttcgccatctggcagtacacgtccacgggccaggtggcgggcatctcgacctcggtggacatggacctcgacctgtcgcgccccctcgccgagggactcgcggccgcgtcctcgtcgtaggggcagagagacgccgcaacgggagacgtcccccgtcgcggcggtcgcgggcctagtccctggtgagcttgcggtgcaggcggtgcggcttggagaggtcggggcccagcctcttctcgcggtcgcgctggtagtcctcgaagttgccctcgaaccagtgccagctgccggggtcctcgtccgtgccctcccacgccaggatgtgcgtggcgatgcggtccatgaaccagcggtcgtggctggtgatgaccgcgcagccggggaaggccagaagcgcctcctccaggctctccagggtctcggtgtcaaggtcgttggtgggctcgtccagcagcagcaggttgccgccctggcgaagggtcagggccaggttgaggcggttcctctcgcctcccgagagcacgccggcacgcttctgctggtcggtccccttgaagccgaaggcgctcacgtacgcgcggctgggaatctcctggtctcccacctgaatgtagtcgttgccgccggagacgacctcccacacgttcttctgcgggtcgatcccctcgcggttctggtcaacgtagctgatcttgaccgtctcgcccaggtcgagctcgccggaggtgggggtctcctggcccacgatcatcttgaacagcgtggacttgcccacgccgttggggccgatgacgcccacgatgccgttgcggggcagggtgaagctgaggtcgtgcatcagcacgcggtcgccaaacgacttgcagagccccttggcctccagcaccttggagcccagcctggggcccacggggatgtggatgtcggtgtagtcgaccttggtcgcgcgctgggcctcggcctccatctgctcgtaggcggcgagacgggccttgctcttggcctggcgtgccttctgggagctgcgcacccactccagctcgctcttcatcttcttggcgagcttggcgctctgcttggactccgcctccatgcgcgcggacttggtctcgaggtaggtggagtagttgcccttgtacgggtagagcgtgccgcggtcgacctcgcagatccactcggcgacgttgttgaggaagtagcggtcgtgcgtcacggcgagaacggcgccctggtagttcttgaggaactgctccagccacagcacgctctcggcgtccaggtggttggtaggctcgtccagcagcagcaggtcgggcgcctggagcagcagcctgcacagcgcgacgcgacggcgctcgccgccggagaggtgggtcaccggctcgtcggggtcggggcactgcagggcgtccatcgcctgcgacagctggctgtcgacgtcccagccgttggcggcgtcgatctcgtcctggaggcgtcccatctcggccatgagggcgtcgtagtcggcgtcggggtccgccatctcctcgccgatcttgttgaagcggtccaccttggcgaggacgtcgccaaaggcctcgcggatgttctcacccacggtcttatcctcgtccagagggggctcctgcagcaggatgcccaccgagtagccgggcgagaggcgcgcctcgccgttggagacctcctccatgccggccatgatcttgagcagggtcgacttgcccatgccgttggggcccaccacgccgatcttggcgccggggaagaagcccatggtgacgtcgtcgagcacgaccttgtcgtcaaacgccttgcgggccttgtacatctggtaaatgaactctgccatgctgctcctttgcggggctcggtgatggttccaggggacattctacggtgtgcgggcgggcgagatgtgagggccatgtggttccggccctccccgagggacgcgtgccctcccctcccgcggggacggcgggccgacgtggtgccgtcacatacaatggacgccgcgaggagagggggtcgcatggtttcagggggcgcgaggatgcccatacagcgggaggcgacgccggcggagctgatcgcccgccacggcgaggacatcatgggttcgacggggatggacgtggagaggcgctgcatccagcacgggaccacgagtgtgtgcgcccactcgctggcggtgacgcgcgcctgcgtgcgcatggcgcaggcgacccggctgcccgtggacgagcgcgccctcgtgcgcggggcgcttctccacgactacttcctgtacgactggcacgtgagcgaccccagccaccggctccacggcttcacgcaccccggcaccgcctgcaggaacgccatccgcgactttggcatagggccggtggagcagaacatggtccgccaccacatgttccccctgacacccgcgccgcccacctgccgcgaggcggtcatcctgtgcctggcggacaaggtggtcgccacgcgcgagacggcggagggcatcgcgctcaaggtcgaggcgctggccgagaggagattcgcatgaggagggtcctcatcatcgccacgggcggcacgatcgcctcgatgcaggacgagcggggcctctcgccccagctgaccggcaccgagattgccgcctacgtgccgcagctggcggacgtggcggaggtgggctttgtgcagcccatgaacatagacagcaccaacatgcgccccgccgactggctgcgcatacgcgacgtgatagaggacgcctacgacggctacgacggcttcgtggtcctgcatggcacggacaccatggcgtacacggcggcggccctgagctacctggtgcaggacagccccaagcccatcgtgctcacgggctcccagcagcccatggccaacccgttcaccgatgccaagctcaacctgtaccactcggtgctgtacgcggtgacgcccggctcgcgtgacgtgagcgtggtctttggcggcaaggtcattgccggaacgcgcgcccacaagcagcgcaccatgagctacaacgccttcaccagcgtgaactacccgctccccgcggtcatccgcggcaaccgggtggtgcgcgacgtcgccatgggcatgtcgatcacggggcagccggtggggccgctgcccggcgcggacggcacctctcgccccaccttctaccgctccctggacgagcgcgtggtggtcctgcgcctgacgcccgagctcaggccgagcatcctgggcctcctcgcccgcgactaccaggcggtcatactcgagacctttggcatcgggggcatccccgagtacgagggcggctcgtggaagcgagcgatctttgactgggtggggtccggccgcacgctggtgctgaccacacaggtgaacgaggagggcatggacctgggcgtctacgaggtgggccacgactacgccgagcacccgggcatcctcaagggagacgacatgaccaccgaggcgctggtggcaaagaccatgtgggcgctgggtcaggcgagagacgcggacgagacgcgcgagctgttctaccgccccgtgaaccacgaccgcatgccgcgctagcgtcccccctatgcctcggcgttgacggcgaggccgaggaacacgcacaggatggcggcggcgatgttgcacacgtacgccgggacgctccccacgaccccgcccacgaagacggtgaacccgatgcccacgacggagagcgtgagccaggcggcggcggcaaccgacgcggggagcgcgaacctgcggtggcgcgaggcgcgcagccccaagacccccgatacggccgccgcgacgaggttgacgacgaaggtcacggcgacgagcggggagccggcgtccaggaccccgttgtggccaaagagcattttgcccaagccgcccaggacgtcgagcccaaacgcgaagtgcgcaacggcggctgcaagcacggcgacgctcagcacgagcaccaccagggagacgatgccgaggagcgactgggtgactggtcgaccccccgtgctcacgtacctcatcgaacctccctgctgcgtttgagtcgcgtttattggtgtttgaaaaaaccaccgtgcaaactgaattagcatagcacacggtttcaccatattttcgtcatattacacctccggatgccacagtgcggcaccaatccgccgcgcgggcgcgccgcgtgcgccagcgtcgggcacgggccggccgtggaccccgagcaacactggcccccaaggcgctgccggccaaatgtgcatcctacgtgcatttgtgccgtcgcccctctcccccgacgcggcaagcgggcttttttgggaaatgcgccagcgcacgtggcacaatccttgtatcaccaacaccgtgccaccggcccccactggcggcgagacaaggagagtcacatgcccgaggcaatccgcaaggtcaacatcatcggtcacctgcaccctgacaccgacagcatctgcagcgcgatagcccttgcatacctcaagaaccagacgagcgacatcgagtacgagccgcgccgcgccggcaccatcaaccgcgagaccgccttcgtgctcaagcactttggcgtgcccgagccccagctcatcaccagcgtgcgcccgcagatcaaggacatccagatccagcacatggcgggcatcgaccgcgagaccagcctgttctcggcctggaacctgatgggcgagaccaagaccgacacgctccccgtcaccgacgagaagggtagcctcgagggcatcatcgcggtgaaggacatcgccaacgccaacatggacgtgtttgacaccacggtggtctcggagtccaagaccaggtacgccaacatcgtcgagacgctcaagggcgagatggtcatgggcgacgagggcgcctgcgtggagagcggcaacgtggtggtgggcaccacgcccgagatgatggagggcaacatcctgaagggcgacatcgtcctggtgaccaaccgctacgagacccagcgctttgccgtggagagcggcgcgagctgcctcatcgtgtgcaacggcgccgagctctcgcacgtggtgcaggaggcggcggagaggaacggctgctcggtcatcaccacgccctactcaacgtatgcggccgctcgcctgatcagcatgtccacgcccgtgcgcgccaagatgctccccgcaaaggacgtcctgagcttctcggtcaactccaccgtggacgacgcccgcaagaccatcacccagtcgcgccaccgcttcttccccgtgctggacgaggacggtcgctacgccggcctggtgagcacccccaacctgctcaacgtgaacaagaagcacatcatcctcgtggaccacaacgagcgctcccaggcggtcgacggccttgagcaggccgtgatcatggagatcgtggaccaccaccgcatcggctccatcgagacgtccgcgcccgcgatgttccgcaacgagcccgtgggctgcacctgcaccatcctgtacaagatgtacaacgagcaggacgtggagatccccaagagcatcgccggcctgatgatgagcgccatcctctccgacaccctgtgcttccgctcccccacctgcacgcccttcgacgagaaggcgggccgcgcgctcgccaagatctgcggcgaggacgttgaccagtacgccgaccagatgttcgatgccggcgcggagctgaccggacgcacggcagaggaggtcttccaccaggacttcaagatcttctcccgtggcaacgcgcgctttggcgtgggccagggcagcttcatgaccgagaacagtcgcaaggctgcggaggccctggttggcccgtacctcaaggagggcgcggccaacgacgagctgccgctggtgttctacatgttcacggacgtgaagagccagaccaccgagatgctgtactacggcgagggcgccgaggacatcgtcgcgcgcgccttcaacgtgcagcccgtcgacggcatcgcgacgctgccgggcgtcgtgagccgcaagaagcaggtcacgcccgccctcatgaacacgctgcaggacgtgcaggaggactagtcgcgaggatcatgcgagagacgagggggcgtcccgtgcggggcgtcccccttttgccatagagtccaccccgcgtgtacacgcggggtggacttcccggcaccagacccgtccctctggggtaggaggcccccctccgtcgaaaacctcgtcccgcgtgtacacgcgggacgtaccttctgacatccgcggtaccgggagagccccatctgcctgaaaccccacagcgtgtgtacacacgggatggacttcccgacaccagacccgttcctctggggctggagacccccctccgtcgaaaacctcgtcccgtgtgtacacacggaacgtaccttctggcacagaacggctccagagatggcctgcccccttgaggcccacgccaccacggtaaccgcgggacatccatggacaaagaatgggacggatcgtccacctcatagacaagctggcgtccccatgggggcgaggcaacatggccccctgcttgaggatctttcccctaccgggtgcatgccgtgttgcgagtagggcacccttggaggacccactggcaagagactcctgatgtgagcacttgcactgggagtcgcctaccagagagatgggcgagaatcgcgttcccccagttggtctcacatcatgatttcaactgtgtcagctagttcccgatgtgagtgctcatatccggctccccctgcaattccatccccgagggggcctgtttggcaacgaactcccgacacgagcactcacatcaggcgcttgctgccatggaacgggtgacgtgcgttcgccgatagggtctcaactgggaaaatgtcaggtttgctcggctctcgcggcccgcccccccacggggaggtgctcacatcgggctctggctgccatcgagggcatcctgccggtcagtagtcggcattcggtaatcttgcccgtgttcccccagttgacgatgcgtcaaacattcgatcttgacggcacaatccccgcgcgagtgctcacgcggcgcatttgctgctaacggaggatgatgccctcttccatgccatgggcccttctcccgcgcgagcgtcgtggctacgggggctctcacgagcagtactccatcaggcaggtcccgaaggggggccggaccagcagagactcccccatggggcagacggtccgaccatacacgagcacgttcacccatggaaccttgccagctcccgcacgcgacgggttggccctcgtgcgtggcgcacgcccctctccccttccttgagcgcttcgcccgaggggctttgaccccggggggctggtccgtccttcacgcgcgggcatcgcggggagttgcgcagcccacggaacatgccgagtgacctacagcagctgatccagcgtatgtccgtaggacggcaggaactcttccatgaagtcgcggacctcgggcagctcggcagccatctcctcgagcacggccctggtggtcctctcggcggtgacgaactcggtgttaccggcactccgctcgtccaggcacttgatgagtgcgctgagcttgtcggctgccttcaccaggcggtggagaagaacgtcgtccccgctcccgtcaggtttgaagatgccctcgtagaccgggcggaggtcgtctggcagcgtctgcaggagcctcttctgcgcggagtcctccacggcccggtacgcctcgcggagcgtgccgctggcgtacttcacgggggtgggcatgtcacccgtgatgatctcggacgcgtcgtggtacatgcccacgagcgccgcccgctcggcgtcgaggtgacgaccgtagcgctggttgccgatcacgcacagcgcatgcgcgatcatcgcgacctcgagcgagtgctcccccaggttctctgggcgcgagctgcgcatgagcgcccatcgctcgatgtacttgagcctggagagaagtgcgaggaagctcgactcgcgcggctgttcctgttccatgctggacccttccgtcgggataccgtgccatcatacggccacccccggacgggatggttcgccgtgcgacggctggggccctctggcctagaatcgaacccgttcgcagcccacctcgcagattggcatcgcatgcacgcgcttcacgcacgacttcccaagcacttcgtcctggaggagcgcctggagcgctaccgggacgccatcgaggtcgacccccgctcgtacgcgggggcgtggcgggaggcgtgcacgcccctggacggcaggacggcgttccgcgagctgagggtggacctgggctgcggcaagggcggcttcgccgcggagtccgccgcacgggagccggacgtgctgttcgtggggatagatgccgagcccatctgcatcgcctacgccgcgcagaaggcggttgagggaggcctggacaacctggtgctggtgccggcgctggggtccgcggtggacgagctcttctcccccggggaggtggaccgcatcatcctcaacttccccacgcccttccccaagaagcgcgacgcctggcagcgactgacccacctggaccagctgatgcgctatcgcacggtgctcgcccccggtgggagcgttgtgctcaagacggacagccagccgctcttcgacttctcgctcacccagttcgacctcgcggggtaccgcctgacgtggcggagctcggatgcccggggcgaccggccgaacgaccccatgagctggtacgaggagcgcctctcggcacagggcgccacggtgtacggcctggaggcagtccccggccccgcccccgagcacgtggagcaagccgccgagctgagcctggccgaatacctgccgcaggacctcgccagcctgacatacgtcccccacggcatggagggcacggtcaccaacctgcgcaacctcagggccaagcgcgcgatgggccatcgcgagagctaaggggagagacaagccgcccccgtcctccagaggagggcgagggcggcagccagtggcatgggcccgggggatggggcaggggcttctcccccaggacctggtgcaaacggcgacgggctacctacagcctggtgacgctgaccttgtccacgagggagtcaacgaggtcgcggggagccgcctgcgtgccggactgcatgacgttggcggcaccggtggccatcgcgagcctgacggtgtcgtccagccccatgcctaggtcctcggcgtaggcgagcgccgccaccacggagtcgcccgcgccgaccgtggagcccacgggcaccttgacggagccgcccttcaccacgtggtcgcggctcacgaacatggcgccggcgccacccatggacacgacgacgttgtccaggcccttctccacgagctcgcgcgccgcctccgcgaccttgtcgtcgctgtcgagcttgcggcccagcatgaagccgagctcgatctcgttgggcttgatgaggtacggaccggcggagatgcccgccaccagcttgtcgccgtcggcgtcgaggaagaccttggcgcccgcctccttcagggccgagacccacgtggcgtacgtcctggggcttgccccgcgcggaagcgagccggagagcaccgcaatgtcgccgggctccaccacgtccacgagctgcgccagcatgtcgtccagcatctggtcgctcacctgcgggccgggctcgttgatgtcggtgtgggtgtctcccgaggggtcgacgaccttgaggttggtgcgcgtctcgccctcgacctggaagctgcggagctcgatgccctggtcggccagcatggcggcgatggtgttgccggtgttgcccgccaggaccgcgtaggcgacgctggtgccgcccagctggcggatgaccttggagacgttgatgcccttgccgcccgggtcgctgcgaagctgcgagatccggttgacccggtcgagggtgaagccgtccacctgggcggtcttgtcaagcgctgggttgagcgtgacggtgtagatcatgggatcactcgccttccgtgtgccttggtgcgaccggtgcgttcaccccaagtctaccagcgcgcgggccacggcccggcaacgttgccgcaagcgttctgccacggcgggcgggggccatcccatgccgggaggctgcgctactctcccctgagctcgctcaggaactcgtccccgtagcgacggagcttggtcttgcccacgcccgagacctgcagcagctcctcgcgcgtggtgggcctgcgccgcaccatggcacggagcgtggcgtcggagaagaccacgtacgggggcacgcccgcctcgtcggccagtgacttccgcagtgccctcaggcgctggaacaggcgctcgtcctcgtcggtgacctccgcctcgctgggcagctcgcgctcgcgcacgccacggccgaaggtggtgcgggagcgcaccgtgcccaggtagtcgtcgggcgagaggcacctgcacaccgagcagccgccgcacccgccgtccgggagagtgaccgcctgcccaaagtaggagaggaccctcccgcgcaggcaggtgtcgctcatggcgtagccgatcatcttggagagcagggcattgcggttggcgaggaggcgctccctgtccgcgcgcgtggtctcgggcgggaactccgtgttgtcgatcaggaagtggcaggtgcggatgtcgccgcggctccacagcaggaagcactcggcaggctcgccgtcgcgacccgcgcgacccgcctcctggtagtactcctcgagcgacaggggaagccccacgttgaccacgtagcggacgtcggacttgtcgatgcccatgccaaacgcgttggtggccaccatgacctgggcgtcgtccctcacgaaggcctcctgggcggcggcgcggctctggttgtcgtagccggcgtggtaggcgacggcgcgtaccccggcgtcgcgcagcgcctccgcgagcgcgtcgaccttcttgcgcgtggtcgcgtacacgatgccgctctgttcgcggtgggacagcgcgtacgagaccacccaccgctcgcgcgccttgggcgtgagctcgaaggaggcgagcgtgaggttgggacggtcaaacccgttgacctgcaccgttgggtcccgcaggccaaggagggagacgatgtccgcacgcacgcgggccgtcgcggtggcagtgagcgccgcgaccaccggacgcttgggcagggcgtccacgaaccccgcgatcccccggtaggccgggcggaagtcctgtccccactggctcacgcagtgcgcctcgtccaccgccaccaggggcacgctcgcccggctggcaaattccaggaagcgaccgtcctgcaggcgctccggggccacgtacatgacgtcgtaccagccgtccagcgcccgttgcatcacgatctcctgctgccgcgggttgagcgttgagttgaggtacgagccccggatgcccgcctccttgagcgagcgcacctggtcgcccatgagcgagatgagcggagacaccaccagcgtgaggccgcccaggagcgccgccggtatctggtagcacacggacttgccggcacccgtgggcatgaccgccaggctgtcccgcccgccgaggatggacgagatgacctcggcctgacccggtctgaacgactcgtagccaaagtagcgcgagagcgcctgccgcgcgtcctccatggttggcatggggcacccctccccgctcgtctctcccccaacgcccacggagcgccgtgggccaagcctcgattgtaagacgtgggagcgacgcagcggccgatggcaggcggagggctactcgtcctcgccgtcctcgtaggtcgccagggcgtcgaacagccgggcaatcctgaggtcggggatgacccacagcgagaaggcgaggaccatcgcgacaaacgccaggcgcgtggtggggagcgcgatggcgaggaccagcgccacgacctcgagccccaacgtccagcgctccttggcgagcgacctgtgctgcagctctctcatgccgctggtggagcgctggcagctcacggcgtggcggatcacgcgctccaggttcatgtacgagagcgagaccagcatgttgagcacgatgtagcaggtggtgggaagggccgcgaagtttgtcttctggatccagtcggtcgcgagggggaagaacgagagcacgaacaggaacagcaggttggaccacagcatgcgccccgtggtgcgccgcaccaggttgagcaggtggtgatggttgttccagtacgtccccactgccacgaagctgaccgcgtagctcaccacggcgggaccgagtgacagcaggtctgccatcccagagccctccggggcagaaatccccagcaccatgatcgtgatgatgatggcgatgacgccgtcgctaaacgcctccttgcggcccttgggcatggcgaccccccgtctccctcgctcgcgccccatgcgcgggctggggcgatgataccgcacgtcggacgggggagggtgccgctcaggcgccgcccaggggcacgcggagcagctcgtcgtaggtgagctcacctccctcgggatggtggctccacatcaggctcgccgcctggacgcggaatgcggggatgccggcgggacgagccaggggagaggaggcgcgcgcctctcccccatcccccaccaccggctgccagccatccttgggccgggcgccgcggaagagcgtgacgtgcgggagaaactgggttgcggttgccgggagccggtcgcccagcccctggtcggcgagggcccgcacgagggacgcctggaggcggacgagcccctggagccccggaccgtccgcgacgccccgccacaccacgctcccgccgtgccggcgttcgaacacccccaccccgccgagcgcaagggggaggggcctcgcctgacgggcggcgtcacccagcgcgcgcaccgccgcctcacgctcgccggcgtcgcacatgccgaggaaggcaagcgtgaggtggaggttgccccgcgcggtcggcctgccccgcacaagcagcggggcgacctcgcgctgcgtgcggcagagctcgtccctcacccgctcgtctggcagcaccgccaggaacagcctcgtccgaccgtccgtcatccggcacctcccgcgatggtttttgccaacttgccgactgcacctccacccagccggcccatcctgttagagtccagtctatgcacgttgcgaacatccggcgatgggaggatcccatgagcgagaacgacgaggcaaccgactacatcgacatcgactttgacgatggcacccaggttcgctgcgaggtccagggcgtgttcgacctcgacggcgaggagtacatcgcgctgctgcccgaggacgggtcggacgacgtgtacctgtacggataccacgagtacgaggaggaccagacctacgagctggtcgacatcctggacgacgacctgttccagcgcgtctcggaccgctatgacgaggtcgcggcggagcaggccgagatagacgaggagctggccgccgaggaggacgcggaggctgaggccgaggcggaggcagcggaggaggactccgaggagtaaccccgccgacaccacttggcagaggagcgatgcgaggggccgtcgcccggaatgaaccgggtggcggcccctcttgtttgtgcaggtgaggggtcatgccgcccgcaaggtgccactcgtgtggccccgccggccggggaggggccccattgggtagtaacctaaggagcgctcgacgtaccaccaaccccgccccgcggcgggcaaacatagcttggagcccatcatgcccagactcacacccggcaacagactgtacttctaccagcttctctccacgcgactgggggtcggcgtgcagacgcccctccccaaggtcgaggagctgctgagcgaggaggacgttgaccccgccgacgtgggttgcgacgacgtgcagcagctcctctcccagatgcccgagttcatcaagctcacggtgttcaagaagggccgtacctacgtgacggtgcagcgccaggaggagtgggaccaggtgctcgcgcgcgccggcgaggagcgccagaggaaggcacccgccaagggcgccaaggcctggaagcacaagaagagcagcaaggatcccaagcccgcgaagccccgccatcgcagggagaggcgcggggacaccgacaccgagaatgccgcggcccagcgggacgagggcggcgcaagggccgtcgagtccgcagcggatgcagcggagccggccgagacggtcacgcgcgacgagccgaaggcggcacctaccgtcgaggcggatgaccgtgccaccgagacggtgcaagtgccgtcgcaggccgggcccgacgccacggcggccgaggcggccgacgcgggacgacaggtcgggccctccgaggcagcctcccagggcgacggcgcgaacgcgaaggcggagtccccgagggatgccgggggcgagacgcacggggccggcgagccccagggcgagacggacgccgccgcttcggcggagcatgcgcccgtcccaaagcaggggcccgcggccggcaacccgggagcggcgccgacggacggcgagcctcccatcaagctgaccatcacctacgacccctaccgtgacatggaggaggacctggacgccgccctgcgcgaggcggaggacggtgccaggcgcgaggccgacgaggttgcccgggccgagggagggcgtcccctctcgccccgcacggaggcgaagccatcggaccgcaacggcaccgcacgccacgactccccccgtacgcgaaaggcggcacggcccgacgcgacggcagagaggcccgaggacagcgagcccgcgacccccgcggtcgtggcgtcggacatcccctcccccgtcaggctgcaggcagacctgccgcaggactttgcgagcgaggtccactgcaccgaccgcctgctccagctgctgtatcgcaccctgcccatcgatgcggacgtgatgtccgtgctggacgaggactggcgcgtggcccgctcgacgggatccctgggcgggacgcgcagcaaggtcaccttcccgctgcgctacctgcaggaggacggctcctcgcacgtgatggtgacgctgcgccgctcctccaaggcgaccgccggcaagcgctgggcgctggcatacgtggacggcgacgacggcacgggagacacgcaccaggccgttgggctggagggcctgcccaaggaggacgagggtgcctggagcgaccttgccggctcatcccttggcatggcccccacggcgagccccgcacgcgagctcgcccagtttgccgtgatcggctcgtgggacgagctcctgggcgccctggcgaccatggcggcccccgagcgctggaactaccccggcgagggcgtgggaaaggcgagccgctacggcatcctgcgcgagtacctcacggtcacgttccaccgcctcctcgccaccgatggcgtgcgcattgcggcggacgggtcgctggctgcctttgacaccgggctccacacggccttctggcaggacatctacgcctgcttcgcgccgcataggggagacataccctggcagttcagcggattctgcaccgccggctccggcgagctgggggcgctcctggtggcgtccctcgaccccctgccccagccggcccgctacctggagcgcataggcgacgtgttcccccagccgggcaggatggtggtcctggacaccgagtcgctggtcatgcgccagctcggacgcctgccgcgcgcgttcctgcaagagcaggtgggaacgagctccgtggcaagcgaggcccttggccgcgtgctctccaacccgggtgacgcgagggcgcagaccgagctctcgcgtgccatcaagggcgacccggggacctaccgccgcgtgggacgcgccctcgacgacgcctgcgacctcgccctccgcagggctcgctcaagctaccgcacggtcgcgcccgcctttgacccgcagacggactccatgcggctgctgctccccctctgtctggtgagcgacgacaaggcggactgcgcgctggcccttgcgccccagcccacgggaaactaccaggggaccgcggtcctctcgctcccccgcgcctatgcctgctccagggtcgtgggagaggagcagccctcctggctgcagccccaggacgtcctggcctagggtttctgggagtcaccccggggctcttttggggggacttgggcagagtgtctgctgaggaattacgagtgctggcaatccacgggcggcagccgctggggaaatgcgagtgttggcagaaagtggaggcccagaaggctctcgcccgtcgaaaaccctgtcccatgcgtgcatacgtggacgcttcctgacgcggggaggccacgcgatgccaggcacctcgggcctcgggcaaccacggttgcgacggggtgtcgatgggctgagaatgggacggctcgttgaccatccgggctgttcagcagctccgggcgccaggcccacggccgtccccgcggcgcccctccctgccagggacgggtgccgccgcgcgccaggggtctccctcaggggcccaatggcgagaagctcccgacgtgagcactcataccggtaagcagctgccatccagacccggagagaggcccacttggcaggaaactcccgttgtgagtactcatatcgggctcccgttgccatgggtcatgctacgttttgcgaccgaaggccttccaactgggaaaagtcgacaaggtccgatacccaggcccctccccctgacgggaaggtgctcacatcgggccttggccgccatcggtcgtcgggataacggaacggttggcagaccccctcgcgagcgcccacacgtagctctcggtgtcgtccgcgactgccaatactccgctttcctcggcagcctccccgaatgccgcacggagtcaggccggatgtggctcggcaccccccacacgcggcagcaagccccgccgttggcagcaccagacgaccgtggctcccgcgccaatggcgccgcccgcttcgcttcgttaaaaaacagatacgccccgcttacattgccgttgcggcagccttccacggctacactgggttggtcgttaacagccctctagccgcaaggcgtgcacggaggtaagcgcatggcgaagatccagatgaagacgccgctcgtcgagatggacggcgacgagatgacccgcatcatgtggcagatgatcaaggatgacctgatctgcccgtttgtggacctcaagaccgagtactacgacctggggctcgagaacagggaggcgaccaaggaccaggtaaccgtggactccgccaacgccaccaagcgcctgggcgtcgccgtgaagtgtgccaccatcacccccaacgcccagcgcgtggaggagtaccgcctgtcgaagatgtggaagagccccaacggcaccatccgcgcgatgctcgacggcaccgtgttccgcgcccccatcgtggtgcgcggcatcgagcccgtcgtccgcaactggaagaagcccatcaccatcgcacgccatgcctacggcgacgtgtacaagaacgccgagatccgcgttcccggcccgggcagggcagagctggtcttcaccgcggaggacggcacccagacgcgcgagctgatccacgagttcagcggccccggcgtgatccagggcatgcacaacctggacgactccatcagcagctttgcccgcagctgctttgagtacgccctcgccaccggtcaggacctgtggtttgccaccaaggacaccatctcgaagacctacgaccaccgcttcaaggacatcttcgccgagatgtacgaggcggagtaccgcgagcggtttgagaaggccggcatcacgtacttctacaccctcatcgacgacgccgtggcccgcgtcatgaaggcggagggcggcttcatctgggcgtgcaagaactacgacggagacgtgatgagcgacatgctctcgagcgccttcgggagcctcgcgatgatgacgtcggtgctggtatcgccccacggctactacgagtacgaggcggcgcacggcacggtgcagcgtcactactacaagcacctgcgcggggaggagacgtccaccaactcggtcgccacgatctttgcctggaccggggcgctccgcaagcgcggcgagctcgactccctgcccgagctggtcaactttgccgacgcgctggagcgcgcgaccgtggacaccatcgagagcggccgcatgaccggcgaccttgcgcgcatcacctcgatccccagccccatcaggctcaacaccgaggacttcatcctggccgtcgccgaccagctgcgcagcgagctcgacaggtagcgatcaaggcaagcgagacacgcgacccccatgccagggacccagcggctttggcatgggggtcgtctcgtctgccgacgaggccagcgcgccttcctacccccgccccttgcggagcgcctcgagacggtcgaggaggtcgaggccgcggtcttgcagcatgagggcgttggcgcaggtcacgaaggagtccgagccatgcgccgcctggaagcccatgaactcggggtccacggagagcctggtgacgaagaccagggtctcctctccctcgccaaacgcccgcgacataaagtcgatggcgtggtcgacctgtgccgagacgcgcctgacgcgatgggagagggtcctcaccacgtcgttgtagcgtcccttggcgccgtccaggccgccctttgcgaccagggggcagagctcgcggagcagggcgagcctgcgggcgcacacggcgcgccggcggtccgaggcgaagccgcgcgacaccagcccggccagctctatctcgcagtccgacaccacggcacccgccgcctggggctcgtcccccagcgtcttgaggatgtcgcgcacctggcgcacggcctcctcctcgatccgcacgccgtggatccccgcgagcagggccgactccaccaggctcaccactgccatgcgctcgtccaggtccgccccggagacgtgcgccacggtggcgtcgtccgcgaggccgtcgagcacccgcgccacgtccaggtcgtcgcggtacttcccaaacagctcaaggtagagcgagaagtcctcggcgacctcgtcgtcctgcaggtactgccccaccagataggggtccacgtcgatcccctcgcgctcataggcctgcagcatgcgcgagaggtcctcccagcctcgcgcggtcaccacgcgcgtgccctcgacggtgctccgcacccggaagaagttctcgggcttctcgtccaggtaggaggttatggccgggtgcacgccatgggcggcggcatagcccatccacgcgtcgaggtcgggctccacgtcgatgcgcttgagacggtccatgatcgcggggtcgaactcgcgtgccgcgcggttgtactcgggagggttgccggcgcacacgataacccaacccatcggcagccggtgctggccaaaggtcttgtactgcaagaactgcagcatggagggcatgagcgtctcgctcgcgcagttaatctcgtccaggaagaggatcccctctcgcccacccgacgaccgcatggcgtcgtacaccgatgcgatgatctcgctcatggtgtagcggctgaccttgtagcgctcgccctcgaactcctcgtcctggatgtaggggaggcccagcgcgctctggcgcgtgtggtgcgtgatggagtagctcacgaagcacaggcccagctgctcggccacctgcgagacgatagccgtcttccccacgcccggcggccccatgaggatgatgggccgctgcatctggggcgggatgaggtagatcccctcgtcgtccctcgccaggtatgcgcgcaccgcgccctcgacctgccccgccgcctgctggatgttcaccgtgcgcctccctgcgcctcgtcctcgcccgcccccagctcgtctgggtcgagcaccaccttgatcgcccacggcggaaccgacgccgcgggaaagtccctgtcgtagaacacgaacgcgacccggtagtccgggaccctgctgggatagatgccccagccgtccgtgaggtagaccagccccgagaggtcccggagtcccccctcgcgccgaagccggtccacgtagtcgaaggcgggcctgaagtccgtcccgccgccaccgaccacgcggacctcgcgctgccagcgcctgaggtcctcctcgctcgacaggcacacgtcgctgcgcacccccgcgtccgccatgaccacgtggatgttggtcctgtcacccatggcaccgccgtcgcgcagcatcccaaaggtcaggtcgacgaagcgtttgaccatggccggcgacacggacgccgaggtgtcgatgaccaccacgaagtcgcgcagggtctggcgctcgcggtactccaggctctcgatcaggggcatgttgccatagaggctgagccccagctcgtagaacgcgtagtcaaactcgtcgggcgagacgcgcatctcctcccgctcgcgggcaaagcgcctgaggaagtccgcgtagcttgcccgatggcgcgtggcggcctcgatctggcactccaggtcgcccaggccctgcccgcggccgcgcgagagcgtgcgcaggtcaacggccgtgctcttggccacgtgctcccagcgcctccggagctcgtcgcgctcgcggggggagaggggacgccttccgtcgccgtcgcccgtcccgcgggcatccgggccgccgtcgccgtgacgcgcgcggcccgacgcgcccgggggcggggttccgccgctgccggcggggttgccctgggccccggtggcgcgggactctcccccgccgtcgtcggaggagcccgacgcatgcccccgacttgcgccggcaagccatcccgacgcgtcgtcgcagcggaacacgcgctgccaggaccggcgggaggcccgataccctccctcgcggagggcacggtagaccctctcggccgtgagcggctcgcccaggtcgcgcgccagccgggagaggaccaccccctgcgcctgcccgcgctcgccggggcgcggcccgcacacctctgccacgatcctctccgccgcgatgtcgcaggcaagctgccacgccgcggggtccttggcgacctccccgcccatgaacgggtggagcagcaggcagtgggccagcacgtgcacgtagtccctgacgggcggctcgcgcgtgcggccaaggtcgagcaggatgcactcggggtcgtaccacagggtgcggccgtcggtcgcgaagggggcgcccaggcccgacgacggctggggggtgagcatgccggcggcctgcgagaggaagtagctgcccgagatcgcgcggctcacggcaagccggacggtgtctgccgccagcctgtcgggactgtcgtcacgacgcgacggggccatgccggagtcccctgccatctggtcgccacccctcccgacccctgccggaacgccatcgatgaggtcccggacgcctgtgccagccacccgcattgtcctacaacaggaggtcgcccagctcccccaggtcgccgtccgcgtcctccgaccggtggtcgggggcctgctgccgctcgcgcgacctccccagcagccaggcggccagctccgcatggcccgccgcggacgcgaccgagagacccatgcgggcgagggagggagagaggaacgacggccactctgccacctggcgcatctgggcgagcatcccgttctggcacaggtagcgcacgagcgccggcgcctgggacgacgggatgcccgccaggtgcgggaccatggtcgcgaccacctgggggttgcgggacagccaggtgccgtcgcggagctggtccgccacgagcgagggcgccagctcgcacaccaccgccaggaccgcgtcgcacacgcccgccctgaggaagagccccagcacctgggccacgcgcccctctcccccggcaccgccccctctccaaaggtcccccatcctccacgcgagggagaggcacgcctccgcctcgccggggcgggacgcggcggaatcgagcgtcaccgcgttggcacgcgcgagggccgccctcaggaggtctgcgtaggcgagggggtcgaacaggccgtcggcagcgagcctcgccacgaggtcgcaggttgcggcgacgtccgtggaggtggagaacgacccgccgcacagctgctcgtttcccacgaagggctcgaaggcctcgctcgagacggaccgcgcgaaggcgtcgcgcaggatccccgcgcttccccgcgtgaggtcgaggcgcgagagggaacgtgcgccctcctcccccgccggcaggttgggcggtgcctggagcaggtccgccccgcgggcgagaaggacgcgggcaacgtcctcccgcgccgtcctcagggcgagggcgagggcccagccggcataggggatgggcgcgagggcgtcccaggcgcacgagacgagcgcccccgtgccatagacgcaggagcgctcgagcaggtcgatgacctcgcgcgacgagaggcggtccctttggccggacagcatggacagcgcgaccatggcgcgcatcgagtcgcccgagacgatggccccgcgggtcaccaccaggagcccggccacgttgtctgccccatgggggagccgcacggacggcacgcccgcccctctcccctagtcgaggtccctgaagtggaagtggctgcgcccctcggcgtagtcgcccaccacctgaccggaaccgcggagctcgtacttgtaggtgaccagcccgtccaggcccacggggccgcgcgcgtgcagcttgccggtggagatgcccacctcggcgccaaagccgtagcggaagccgtcggcaaagcgggtcgaggcgttctggtacacgccggcggagtccaccaggcgcatgaagcgcttggccgccgcgtcgtcgtcggtcacgatggcgtcggtgtggtgcgacccatggcggttgatgtggtcgattgcctggtcgatgtcgtccacgaccttggccgagatgatgggggcaaggtactcggtgtcccagtcgtcctcggtggcgggctcacagcccacgaggtcgcgcaccgccttgtcgccgcgcagggtcacgcccgcctcgcggtacgcctccgccatcggcgggaggaacttcgccgcgacgtcgcggtggacgagcagggtctcggccgcgttgcaggcggcggtgtactgggtcttggcgtccaggcagatgcgcacggccatgggaacctcggcggccttgtccacgtacacgtggcagatgccgtccgcgtggcccatgacggggatcttggtgttgtccatgatgtagcgcacgaaggcgttggacccgcgcgggatcagcaggtcaacgtagccgtagcagcccagcagctcgtcgacctcgcggtgcgcctcggccaggtacaggcaggcgtcgggaaggccggcagagagggccgcggcacggatgacctcgaacatctcccggttggtgttgagcgtctcggacccgcccttgagcatgacgcagttgccgctcttgatgcagagcgtggagatctggaccatggcgtcggggcgcgcctcgaagatcacgccgatgaccccgatggggcaggtcacgcggctgagcacgaggccctggtccagctcgcggcgcagcagcacgcggccaacggggtcgggtagcgagaccaggctgtcgatgccggcgcacacgtcggcaagcttgtgctcgtcaaacagcaggcgcttgcgcaccgccggggccacgttcgcctcgtccgccgccgcgaggtccttggcgttggcggcaaagatccgctccttgctctcctgcagcgcctgcttgatgcgcaggagggcgtcgttgcgcacctccaggctgaccgaggccatctcggggctctcgagcttcatgtgacgtgcgacgtctcggatgtctggcatctctccccctcttcttgttttctcgcaagtataggggctgggggagacgagcgtgggcgaggcgtggtgccccgtgccacgcacagggggcgggccgcccgccgcagccgcgacgggagcccgcccgagggacgctagccctgctcgcgaaggcagcaggaggccaggtggtcgttcaccacgcccgtggtctgcagatacgagtaggcgttggcggggccaaagtacttgaagccccggcgcttcatgtccagcgccagctcgtccgatatgtccgtgcgcaccggtatgtcgcggagggagtgggggcagcggtcgatcacctctcctcccgtgaagccccagaggtagttggcaaagcttcccctctcctcctgcacgcgcaggaacgcccgggcgttgtcgatcatggcgcgggccttccaccggttgcggatcacgcccggcacgctcaggacgaagtcgacgtcgttctcggtccaggtcgccaggacgttggggtcgaagccggcgtaggcgcggcggagctcgcaccaccggctcaccgcaagcgaccagctgagcccgctgcgctgggtctcgatgcacatgagctcgaagagcttcccgtcatcgtgcgtggggtgtccccatacctcgtcgtggaagttggtcatggcgcttccgcgcccctcccacctgcagcggccatgcgactctgacatcctggctccctcccttgtggcttacccgtgaaccaaccgtaggcgagcgcgggcgacggcggacggacccgccaagttttgccgcagcaaggatgcgctttcgttgcgtgcagattgcatggcaaggcgctgagctggggttatgtggcacgcattttggtagtttgcgcgcggcaagggggacccacggcgatcggggctggatcctctccccctggcccctggggagacccatggcaatcgaagccggagcccctcccgacggccaacgggacaacctctctggcgccaatatgggcgcgtgggattccagccacagtacgcgggcatgtcgaagccaccgaggtcaaagagggcactgacatgggcagtactccgtgagacaaggactcatcaccagtaacttaggacccacggcagcagaagcttgatgtgagcacttctcagaactggttttggctagggaatggatgtcctccgacgatttcccaggaaaacgaggcgattgaacccagggctgtcccgaagtggcggcggaagccacatgtgagtactcatagcaggagcctgccgccattcgacccccctcctcgacctcaatggcaacgggagcctgatgtgagtactcatagcaggagcctgccgccattcgatccccctcctcgacctcaatggcaacgggagcctgatgtgagtgctcacatcaggagtttgctgtcacggccccttcttgatggtctgatacctgggaaaacgtgaccccatgggcgataggcgccacgtggaactgctcacattggtagttcgctgccatagttttgattttgatgactttccaccccagagtacgacctcaggtcaaggagactgacagcgttggcagcagctcgcccgcgtgagcgctttggcgacccaccctccccggagggaagctccaacctatattcccgcaggccatctcgctgccgcaaatccttgatgcccatccctggcaacaaacggcccgcgtgagtacacacgcgaccgggtttctgccaaacaggtcccgtccccaccccgatgggcgacgtaagccccgcgtgtgtactcacacgaggacttccagccaaggttcgaggattgatggatccctaactgggaaaacgtagcttgacccatcgcaggaacggcgcgaaagtgctcacgcgggcgatttgtcgccattcaacccattccttgaccctaaatggcagctgaagccttacgtgagcactcacgcgaggcgtccgccgccaaagctcaactcatcttgttgctgcacgccagagcgcggggccggcggcgcccacggttccatgccgacgcaaaccacgacgccccttgggacgaggccgcctacttcccggcgggatccttgggaagcgtcccatcctgctgcgcgcggcgaatcgccatctccaggttggcgagcatcggagcggcctcccctcccggcagcggggcgtcgggcaggctctcgccacggtagctgttgtcaaacagcacgctgagcatgtcgggcagcgggctctcgtagccgtcgtcctcgggctcgtagccctggacgtcgtaccccgaggcctcgagcgcaaacgcgatgaccgacaggtccaccccggcgtccttggcaagctcggggatggtcctctccgccggaagctcctcaaatcccagctcgatcagcgtctggcgcaggtcctcgttcccctccagcagctctcccagcggctttgccagatcaagcgccctcttctccgccatggtcctccccctccacgaagtgtcaactgcgatagcttaccccacagacgcgatgcaagtcgcaagccaaccccaccaaagccaaggagagagacgctgcgcgacggctgccaggcccgtcccacgggcaggaagccatcctcgcccgctcggccaccgcgggaaacccgggcggcgtccctcacggccacaggctgccggcgatgagcaactgggcggcatagtaggtggagaggctcgcgacgcggcgccccgtcgtgcccccgcctccaaaggagttgatcgcgagcagcgtgtcagacaccgcgaacagcatcccgcccagcgcgaacgccagacgcgacggggacggctgggagaggaacccgacgatcgcgaaggacgcgacgcacacgaccgctcccaggtagatcaccccgctcaagtgcctggtgccgcgcaggcgaatccgcgggcccagcacggcaaaggccacggcgactgccaccacggcaagcaggagcgggatgcccggcatcgggcaggcgggcacgagcgcccccaggtaggcgacgtgcccgaggaagaagctcacggcacccgacatgaagagatgcgtggcgacgcgcttgaccggctggacaaaccggagcgcgtgcaggacgtcccccaccgcaccgcagcccagcccaaggcagacgagggacgacgccatggacgccccgctcgcctgacccccttggaacgcaccccaaagacccaggagcacgaaggcgagggacgcgagccccttgaggacggcggcaacgccatagcggtgcgagcggtcgctctggatgaacgccgcctgcaacgcgatgccgatgagcgcgagcgaaagggacggggacatggctcctccgggctttggctgacatcgggaggacgcccctccccagcagatggtacccgcgcgcgttgggcgcggtcccaagccacccgccccgcggcggcgaccgtcacgcgggcggaggaagcggagcgtccctctctctcccttcttttcgtctacctccactcaagcgcctcgtgactccaggtcaaatcggaagccgccccttggagcacgggattcaccaccaatgcggaaaagaccaccgcgctctccatcttcgaatagcgttcggaaagccccgtctgtgcaacgagcttgctgtagctcgtttcataagtgccccgccattccctagggacgtcgaactgatcgggcagctcgaggcccctggcacctgattcgcgacgtaggcgattctggaagtccaacccgttgatatcaactgaagttgcgtagaccacaatgtcaacaaggtctttcacccttgaagatggcctcccgtcatggcgttcgagaattgcgcaaaccttatctgaaagggccgcctcggcaggataaaccaggtactcaaatgtttcgactccgcggatttcaagcctgtcggcaggaaccatcctctcggctctctccaaagggacatcatctacaacaaggtcaattgaaatcggctgcagtcgcttcgagccaagccagggaacaaacgtaacgtttgccccggtcctatattcgtcccgcgcctttatcggacgaactttctcaaagacaaaatgcacgtgatccccaaggtcaagagaggccgccaccttgagccgtttcacggcttcatcgattgaagtgccttctgcaagtaagtcaacgtccctggtggcacgagcatccattgttctggcaagcatcgctcgaccacccttaagaacgaaacctgagcgagagtcgcagaacacccgacacaacagacgatggaaccaaaaggactggaccgcacgacccgtatccatcggcgacgcctctgccacagacttgactgcctgttcgagggcgcgtggggttcggtaggcgaatcccgtctccccgctatcttcagctggtgtggacaatcctctccccctctccgaaatgctctctaagaaccccaagcagcttgcgggtacgttggctcttgccctccagagcgatcagttcatacaggcgagagtcgtcgattccgtgtgcccttgcatcagagaacgcatcctccacaagggaagggtcctcgccgtccaggcacaaatcaacaagggtacgctcgggcctagtgacgggaaggccgtgaagccatgtgacatcgcgctcctcgatgcacctcacgccaaatcggacgcaggagagccttgagttgatgcgactcggagcatagaggcgatagggagagagccaaaggtctcccaggttcagcaagcttgcggcactgctccccccaatgacgataccgtcgaaagacgtcatacgctcccctgtgaacattgtcgaagcggtgagtttccatacggcagacagctcgtccgtctcggacggaggcgtgctagctacacggtaagcaccgtgaagcaggcgatcaacgtggccctcggagaacgcccgcgagagcacttggcgcggtatgcccagacgcattgcctgggcagcagtaaaaaccccctcggaagccgagagttcatcgagtgcccctctgtaatcatgatatttcatgttgcgattgtctcatattacaagacatttgcaacatataatggtgtacaaacgtagcaatgatctctgagacccttcgatgcttcccgaatccagtcaagcgtcacccaacccacgtaaaggacatgggagcaaatgtcgccaggcgcgcgacacgcgacagctcgggagagataatcgttcaagcgaaaatgacgagggcgtcccgaggggagaagggcatggcatccgagcaggagctggagcaggtcgcacgcgacgtcaacgtcctcgcgagcttcctgggcacgagggacgtgccctccctcactcccagggcgctcgacgagcgatacggcgtagcgcaggcagacgcgatggcactctttgggggctccatcctcgccggcggggacgtcctggcggacgccatgcgcgcgggcgtcgcacgcacctacgtgatagtgggaggcgccggccacacgacggagacgtttagggagaaggtccgcgaactctgcccggacctgacgttcgccggcgacgcaacggaggcccagatcttctcgtcgtacgtgtcgcacgtccacgggctcaaggcggacctgctcgagacccgctcgaccaactgcggcaacaacatcacctacctgcgcgacctcctggccgatcgggggatttcctgcaagagcctcatcctctcccaggacgccaccatgcagcggcgcatggttgcgctggccaccaaggagatgcccggcgtgctgcccatcgcgttcgccacctactcggtgcgcgtgaccgtgcgcgatggcgaactcgcctacgaccacgcacccctcggcatgtgggacacgagccggtacctgaccctcctcatgggcgaaatcccccgcctgaccgacgacgagaacggctacggcccccgcggcaagggctttctcgcccacgtggacatacccatgcaggtgagaggtgcatgggaccgcctgctcaagcgctacccctggtcgatgaggactgccgacccccgctacgcgggctgaggtcggcaccgttcacctggggctttcacttcgtgatcttggagaagcgcgtgcctccaacatcgtggcccgagctgttgcaaggcaggcggggagagaattgagaagcggatggaactggctatcccacaacggacttaacccatctgaccagcccctcaaaccccgccatacgcagcccggcgccgaggagcgccgtgccaacgcgcttgttaccgtccgcaaacggatggtcgcgaataacgccgaaggcgagccgacagaccttctcgacgtcgttagggtagaggtcccggccaccgaacgtctgccatggttgggcgagagccgactcaagcagaccctcgtcccgcacgccggcaaggcctccaaagcgtgctatcgaggcgtcgtgaatggcaatggcttcccgcttggtgaaacgatgcaccccactcacttggcgagctctcgaaagacgtcggcgtactcgtccatgaagtcaaccgccacgtcgactgcaccgccctcggcagcctgcgttgccggttgtatgaccacccagggcctgttgttcttgagaaccgtgacggggcggccggtgcggttcacttccgccgtgaccttcgagaagttgttcttgacctcggcgaggcccatcgtgattgcggccatggtccctccatcacagcagacttatctagccataattatgcccattttgatagatatgaggttgccaatgcgtgacaacgtcacagccgcggcattggggactagggtgggctggcgtgagacggtaggattgggctgtgggtgtcggaggccgcccggggttcgtgacccgggaaaggagcaccggcgccccgttctttggatatcgcgggtgctactgcacgaacccttccttgtccggaagggtcccgtccaccatgtagcgctcgaagaccttcgtgatgaggatgagcgcgcaccgcgggtatgttcccgactccttgaacgcgacgtccacgccgcagagctcgtccacccttaccgtcccgtcctcgatgtgctcgtctaggtgcgggaagtgcgttatcttcttgcgcacgagcctcttgcggccgttcggcctcctcacgaccttctcgtgtatctctggctcctcgagggcggacttctggatcgtgaacatcccctcgatggcctcgacccgctccctctcgcccctcgggaggttgaggttctccccccggtaggtgtagatgacggtctcctcgtcctccagcgccttcctgcagacccctccgtaccccaggctcatggcttacctccctccaaacggtctttgccgagcaggggctcacgtccaacactcaatcgcggggcagccgtgaaaccctacgcccagcgggcactcttgcgcatccccctctaccacagcagccttgacgccaccgcgaatgccatggcgtcaaggtcgcccctcggaacgctgtctctacctatgcgcgcttccttctcccgcacttgcggcaccgcttagaagccgccagccgccttcttggcttcgtcggccttggcctgggcctcctgcgcagccttgtcggcagcatcagacgccgccttggcctcgtcgtaggccttctgcgccttgtcgagcgcctccttcagagtggccttcttctgtgagggcgtgccggcctccgccttggcggcgagggtgcggaagtagttcgtggtgccggcgacgtcaccgtcgacgccgctgctgtggccgcccgccgcgtcggcatacatgtagatagggacgctctcgctgtggcccatgccaatgtacttggcagagctggtgaggctagtccagtgaccataaacggtaaagccacccttggcggcatagacgtatccgttgatgttgcccacgtactcgttgtagaacgcatggattgagggctcgttggaccaatccacgactgcgagggccgccctgtactcgtccgaagcaggtgtgtacttgccgtctgcgaccttgtagccgttggtggcgtaggcctcggcatcctccttgaagtcgtctcgctcggagagccagccatcgacggcgtcaccatagtatgagcccttgtgatagccccacgagagatccttgaacccagcgcagccccagaagctcgtgtggtactcgagggtgccgtcgtcgacgaggtcgcactcgagcatctgtcctgccatctcgtagccgctcacggtcatggcatcgaggccgtgcgaagtgcggtactggttgagcttgtcgatgtagtcgagcgcggcgaggaagttgtcgtaggtcatgttcgacccgttggccttgttagtcacactcgagttgagggtgctcgaatatgtctgcgcggcccactccgagtacttgccgttcgagatggagtcgaggaactccgccatggtcaagacgccggtggcggcgggctctgcatcgtaggccttctgcgcggcgtcaagggacgccttggcctgtgccgtggcggcgtcctttgcgtctgcgtccgccttggcggcatcggcagccttctgggcctcctcggccttcttctgcgcctcggtgcgcgcgacattcacggtgacgcgcacggtgtcagtcgtgccatcgggatacgtgaccctgaccgttccggtggacgtgccctcgcgggaggtatcgggagccgaggcccacgagaaggtcgtgccgtcgggcagcgccgcggcgttggcgatggcagacttagcatcgaccgagaacctgagtgcgacgctgaggttagccggcttgggctcgtagacattagcgagtgggtcctgcctcgcccccttggtggtgccgtaccaggcggtgccctcaaagttccagccgaccctcacgaggtagtcgctctcggccctgctcgtggtgtagttgtgggcaccggccttcgcgttggggttgtactgccggtagagggtcacggccttggtgtcagagctgtaccagccgattccctcgtagttccagcccacgctcacgaggtagtcgcactcgcctttgctcatcgtgtagtggtggtcgccggcgttggggttgtagagccggtagacgggcgtcgtagacttcacgggcgcaacccagccctcgccctcggagcgccagccaaggctcaccaggtggtcgcgctccgcgtcgctgcccgtgtagaagtgctcgccgctgttggggttgtacaggcggtgcatgggctgggtccccttccagtccgccgccatggcaggagtcgccgcgatcgcaccgaacccgagacccgctgcgatggcgaccgatgccactgcgccagcgaggccgagtgagttctctctcatggtccctctcccctcccccatcgggccacccgacttggcccggcttcaggaaacagaatatgatgcgccagtcttcctgtgatggtaggaatccgcgtgcggcgtaaggtttagcagttgggctctgggcttggggcacgccccgtaaacccaacgtcatgctcctgcaagaacattaaccagagctctcatagcgccttgagttgtccagatggagtacgcttcggataatttggaaaccaaccctgagcgtgagtttttacagggcctcttttgggctcttcgacgtttctagtgggtagcgcatgcgacggtcgtctgcgccgagaagtccaggcggccgagcctgaggaagatcatggtctcgaagtaggacgtgtttctgaagcccctcgctctgatgattggatgacggagttgaggccctccatgctcgcgttggtggcgttacctcgagaaccagttgaggagccctcgtcgtccttgcgcacggtcttggcacgaccttatctcgtccacgttggaagtgcagcatccagggaggtagcctgtcggcttcgaggttcggcgtgaggcgcctgtcgggcaggcggagtgaggcccgaatcgcctcggtcatgggcgcacgaccccgggccagaggcaggtgctcggacgcgagggactcctttcctggcacgtgccatccggagcctctaccggcctcttcagccagacgtacttggttacgcatgagcaggcgccgcttctctcggcgggaatttcctcgcggcagaggacctgttcggtggccttgcagaagaagagcatcacgtggaaagcggtccacggtctgggcggcgttgggcatcgcctccgccgcgccgagcgcgtagggcctaggacatgtcccgcgtgggacctcgcggaatggccatgcgggtcgcccgtgctcctcgagctgcgccgcgagcctcgcgggcgcccccttgtcgcggccctcgcaggacggaccgacctggcgccgtcgagtccccatgtggatatgtagctctggccgcgcctgcagggcgtgtcgttcgatgccggccctcgtggagccggagtctcggcggcctccctggctgagggccgcgcggcccagcatcgcccaacacccttctgcgctctcgcggaccgcttcgctatctccgtgacggtcatcacgacatggccatcacgaggaccctcggcctcgaacgagcgcgtgaaagtgggagttcggccgcacctcccagggcacctgacggtagggactcgtcctcggggccagtcggcccggggacggccgcagtggacgatgtctcgtactgacacgatgtcaaggttggccgccaggtgcgctccctggcgtcgaggtgcgcagcgctgtggcagacggggcatagacggcctcgcccctcgcgtgggcgaccctcacgctgagctcgtccgggtgcgcccccgcgatccttgaaccaagacgtcggtgaccctccaatccctgccgagccccatcgagcgctagaagagcctccgcgagcatgccggcttatcgtccatgcgcgcctccagacggcagccgtccatggaagaatgctaccgcagggggctcggcccaaagtctggcgagggtgatacccacccaaatgttcgaagagcccttcttttgacccacgggtaggtaagtttcacgtgggtgttgtgccgctctgaggcgcgaaaagcaacaatgcaaggtgagtggcttgccgctagcctaccaaagttgtacgagtctcgccagatggcagctttagagttgctctattttcgctatatatctcgcggcaggtggccaaaacctcaagggcaagaaccaacgagctcctcatcgcggatctaacagaggcaccgcggtagtcgcccacctgcggtagcgccatgcgctggaaaggctccccgtgagtcgcctttccatgtgcacgcggtcttcgcagccatcgacatttcaacagccaagtccactaggatgtacgccgccacccagcatcactctgcaagctgtctgtcaagccttcttggaagcgaactcacatcaagaggtacttcgacgcgatctctgcgccgcccaacgtcttgggatcgtcatcgaaacttcggccttggccctcttcaatcctcagtcgagtttcgtccgcgatcctctcgagggcgctcctctcgcatgactcggaggcagacatgccgcgaaagtccttgcatagtcggttaccagcagcttttcgctctcgtcccatgcgatgtgtcatcgtcgcactcgcccatcgtcattggccgtcctgcccctctgtaatacattgtcacacatatacccatgtcactctgccaatcattaccacccgatacggtggtttgctcttgtgtataacccagaaaagccggccagggattccaagtcgccctggccttcacttcggtcagcccgatggccgcttgactcgtggcgtgcccgtcaaacgggcagtgccaggcataccctctgacggatcactaactccttgacgctcagcccggtccagggcgagttcgcccggctcctggctcccgcgatgtacttcgcgatcgtgcctcgtttcaggcgacggtggaccgtagtagccctccgccccgagacttcctgtcccgaactttgtacttgaggttcgagtgccgtgaacatgaggagcgagctctttccttcagttctcgccatgaagctgacgacagctggatcttgggcggggagtgatcacaagcatgtgcacgtggtcgggcatgaggtgcccctcgatgatcgtcgccccccttccactggcatagctgccttgaggatctgcccgagtgtcctgcgcggttagtgggttgtagatggtgcgcttctcgcatatacttgtgggcaaaaacacggatgtggtgcagctgtgcacatccactgggtgtgcgcgaaggtgttcgcttcttgccatgtgtgtctcctcctctcgcggcgtccggcgacctgaacaaccgccatcctagaggggagggagttttgttgcatagcgtcagtgtcatccacccgctgagcgggtggttctctgtgtcgcgcgtggcgcgacacaggctaaagccatgaatcgaacgggcgccgcagccaccgaggtggtgcggcgcccgcgccatggcaggttcaggggttcacgccccccgaagtcgctaagcaatccctactgccggtagtactccaggaagtcgccgatcttgcggatggcctcgctcagcacgctcacgcgcggcaggtacacgatgcggaagtggtccggcttgtcccagttgaagcccgtcccctgcacgatgaggaccttcttctcccttaggaggtcgagggcgaactgcatgtcgtcggtgatgttgaacttgtcgacgtcgagcttggggaagcagtagaacgccgcatgcggcttgacgcaactgatgccgtcgatctttgcgagctcgtccatgacgcagtcgcgctggtcgaacacgcggccgccggggaccaggtagtccttgaccgactggtggccccacagcgccgtctgcaccacggactgggcgggcacgttggagcacaggcgcatgttggacagcatgttgatgcccagcatgtagtccttggcgatgcgcttgttgcccgagcacaccatccagccaatgcggtagccggcgatcatgtgcgacttggacaggccgctgaacgtgacgcagaacaggtcgggggcaagcgacgcgatgctcgtgtgctccagcccgtccatgatcaggcggtcgtagatctcgtccgagaagatgatcagctggttctcgcgcgcgacctgcacgatctcctcgagcacctcgcgggagtacaccgcacccgtggggttgttggggttgatgatcacgatggccttggtgttgggggtaatcttcttgcggatgtcgtcgacgtcggggaaccagttggcctcctcgtcgcagcgatagtggaccgccttgccgcccgccagcgttgcgcaggccgtccacagcgggtagtccggcatggggatcaggatctcgtcgccggtgtccaggagcgcctgcatgcacaggttgatgagctcgctcacgccgttgcccgtgtagatgtcgtccatggtgacgttgggcaggccccgcagctgcgagtactgcatgatcgccttgcgcgcgctgaacaggccgcggcttgccgagtagccctcgcactcggtgagctggctcgccatgtcctgcaccacctcgtcgggcgtgcgaaagtcaaacgtggcggggttgccgatgttgagcttgaggacctgggtgccagccgcctccatgcggttggcctcgtccaccacgggaccgcggacgtcgtacaggacgttgtcgagcttgctggacttcttgaactcgcgcatggcgcttcccttcggctgttgccttgactcgtcgtctctcacccttgaggtgccgctggcggtgggtaccgccccctcgtcgtccgtctgcccgcccagccactccgggctggtccccagcgcgtgggcgagaaaggcgagcatctcgcgccggggcatggtcttggcgctcaggtactggctgagctggctcttgcccagcttgtgaccctgctcgccggcgatgcgcaggaggtcgacctgcttgaggcccctctgctccatcaggcgcgagagccggctggcgaaggttgccgtgcgctggtcctcctgggcttccctctgttccacgtggcctccaagttcaattattgggatgtaagagttcaatttaagaactcgcatcccgcgtgaattgaactgagggtagcaccatggggagcgttggcaagcgagaagttcattttcacccaattggaacggccaccggctggcagccggcgcttctctcccccggcatgagagcgccccggacgcacgaggcgcccggggcgttgagttcggtgccgacgacggcgtggtggaggaagcagctccctacgcgacgtcggaggtgggggcgtgcgagagacgaccccgcccctacatcgccgcgcggaagatgttgaccacgtcgtccttgtcgagcgggacgtaggcgttgatggtgcggcgcgcggccttctcggccatgacctcaaagtgctcgtcgctggtgatgcccaccgcgcggaggttggcggggagccccatggtcttgaagaagaactcggaggtcttggcgatggcgtcgtgcgcgaccgaccagtcgtcgctgccgacgagcccccacacgttgcgcccgtaggtggcaaaggcggagacggtcttgacgctcaggacgtagtccatccagaccggcgtgaggatggcgaggccctcgccgtgggtgatgtcgtagaaggcagagagctcgtgctccatggggtgcacgcaccaggggtcggcgctgccctcggagaccaggccgttgatcgcgtggctggccgcccacatgaggttggcgcgcgcctcgtagttgtcgggctcggcgagggcgatgggcccgttcttgatcatcgtgcgcagcagggcctcgcagaagcgcagctgcacgtcggcaccctgctccttggtgaagtagttctcgaaggtgtggctcatcatgtcggccgtgcccgccgcggtctgcctgcgcgacaccgagaaggtgtaggtggggtcgaggacggacatggtgggcttgaggcactctgccgccgtgccccacttctcgttcttggtcatgtcggagatgaccgccgcggagtccatctcggagcccgtggccgagagcgtgagcaccgagtagatgggtagggcgtccttgatcttggtgcggtcgagcaccaggtcccaggcgtcgccgtcgtacttggcgcccgccgccacgaccttggcgcagtcgatggtggagccgccgccgatggcgaggaccatgtcgatcccctcggacttgcacgtctcaacgccgcggcggaccgtctggatgcgggggttgggctcaacgccggaaagctcgctcacctgcacgccggcctcgcccaggatgcgcagggcctcgtcgtagatgccgttgcgcttgatggagccgccgccgtacaccaggagcgccttggtgccgctctgcctgagctcggacaggtgcgagatctggcccttgccaaagtggatggtggtgggaatggagaacgtgaagttgcgcatgcaagtcccctttctggtgtgacgcttccaagagcgtgccgtcaccagaattgtaggacgctcccggggaggtcgtgcgccgggagggcgaggcgagacgagccggcaacctcgcgcatgggcgcgtcggcgggtggcgggacgagtgggacgcgtccctgccggcgggatgggccgccagcggatgccccggctactctcgccagcccttgcagacgtcgacccaccccagcgagttcgcgaccctgggcagctggtcaatggtcacgtccacgcccgtgttctcggagcccgccgcgggacgcacgaagtcgtagcgccggagcgagacgtccaggtagctctgcacgccctcgcacacgtcgaagggacagacgccgcccatggggtgcccgacgcgcccctccagctcgtccgggctgatgaacgtgggcttgacgccaaactggcgcttgaacgcggagttccacaccttggcgtctccggcgcacagcaccagcacggcggtgcccttcacgtcgaatgccatggtcttgccgatctggccgggctcgagtcccgaggcatcggccgcctgctgcaccgtcgcggtggggacgtcgtaggtgatgatcttgtcgtccagcccaaagcgggccaggtactccctcgtcgactcggctgacacgggccgctcctctcactcgcactgccctgcagagggtagcacgaggcgagaggggcggcccgaatttgccccaaggggctaacgctgcggggtctggccactgcgcgcggatgacggacgagacggccgactggtgatgcgaggcgtgagtggctcgaggcggggtgacggcccatggcacgagccgcgcggcagacgtgcgcgtgcgcgatgctgaccggcgactctcgacgagcggcgcgaggctactcgcaggtgtggccgccgccaggggtgaaggtgcaggcaccgccggccgcagcctcctgcgcgggggcctgggtgcccaggcgaccggccaggtagtcgatgatgtcgccgctctcgtacagcggcttgccgtcgatcagcaggcaggggcactggcgctttccgccaatgcgcaccaggtcgtcgccgttggtcccctgcgtcacgtccaggtgctcgatgctgacgtcgttcttgtccaggaacgcgtcgaccttggcgcagaacgggcagccgggcaggacgtagagcttgaggtcgtcgaaggtggtcatgtgggctcccatcgggttgtgtggcagggacgtgccctgcgtctctctccaaactgtgatgcgtatacccacatttgcgcctcgggtgcgcgacggagccgagtccacggcaacggcatgggagaggcgcggcacgcctcggtcgctcgggtcccggcttggcgccggggtcacgtgggccgctacggccacggggacccgctgccagggggagcggcggaaggccggattgcaacgcccctctcccccgccgtttgtggcaccatcgtctgaacgatttcgacgaggggagagccatgagggacctgcagggaacatgccgcatcgcggtggttcagagcgagccggtgctgtttgaccgcgaggagggcacgcggcgggtcgtggagcgcatcgaccgcattgcccgggagcatcccagcgacctgatcgtctttcccgagctgctgattcccggctacccccacgggatgaactttggctttgtgctgggcgcccgcaagcccgagggccgcggcgactacctgatgtacgcgcagaactccgtggtggtgggcggccccgagaccacggcgattggccaggctgccgcgcgcgcgaacgcgtgggtgagcgtgggcatctccgagcggcaccccaccaacggcacgctctataacaccaacctggtgtttgcccccgacggcagcatcgacgccctgcaccgcaagctcaagcccacgggggcggagcgcctgatctggggagacgcgcaggaccactactttcccgtgtcgcagaccccgtggggccccatgggcacgctgatctgctgggagaactacatgccgctcgcacgcgtggctctgtaccagaagggcgtgaccatctacctggcccccaacacaaacgacaaccccgagtggcaggcgacgcttcagcacatcgcgatcgaggggcgctgctttgtggtcaactgcgcgccgtacatccggcgcgacgactatcccgagggcctggcgtaccccgaggaggtggaggcgctgccgcagaccgtctatcgcggcgggtcctgcgtgctggggccgaccggccactacgtgacccagcccatgtgggaccgcgaggacgttgcctacgcggagctggacatggacgaggtggtgtcgtccaagtgggagtttgacgcggtggggcactacgcgcgccccgacgccgcgcggctggaggtcagcgacctgtagcggcgggtccgtgacgggtacgagggtgtgtggagcgaaacctacattcttgggagcgtgaccgacgatgcgtcgtgacggaagccagctgagggacaagaacggcctgaccgaggaggagttcctggcgcggtacacgcccaagaagtacccccaaccgtcgctgaccgcggacatctgcgtgttccgccgcaacggggagggcacccagctgctgctggtgcagcgcggaggccacccctacctgggctgctgggccacgcccggcgggttcgccaaccccaacgagaccgcggaccagtgcgccgcgagggagcttgcagaggagacgggcgcgcaggggctggacctggagcccctgcgcctgtacagcacgcccgggcgcgacccgcgcggatggaccgtctcgtatgcgttcgtggcgcttgaccgacggggcgtcacggtccacgccggcgacgacgcggcgagggcggtgtggttcgacgtcacggcgaggtcggagggcgcgcgggaggagctgaccctgagccatggggacgaagtgctgcgcgtgtcgtttggcgcctctcgcctgccgatctccggacttccgcgggcgacggacgtggagggcgacggcctcgcctttgaccacgccaacatcgtcgcggacgcctggctcatggtgcaggggcgctaggggtctgtcgggcgcagtgacgcgacggcgctacgcgttgaacacgtgctcgtccaggcggcggaaggcctcctcgaccctgctggtgggcagcgcgaggttgatgcggatgctctgcggtgcgaggaacgcggcgccgtcctgccaggcgacgcccacgtcccagcctgccttctccagctgcgggagggtccagccgtgctcgccgagccaccccgagcagtcgatcagcagcatgtacgtggcctgcgggcggtagacgctgacgccctcgaagcggtcgcgcacgcagtcgcacgccaggtcgacgttgcggttgaggacggggaggagctggtcgagccactcggcgccctcgtcgccgtacgcccccatgagggcctccatgctgaggacgttcatctcgttgtagtgggttgcgtcggagacggagcgcatgcggtcgcgaaggcgggcattgtaggtgacggagtagctgcccaccaggcccgcaaggttgaaggtcttgctgggggcgaagagcgagatggtgttgtcgtgcgcccagggcgtgaccgactggggcgagacgtaccgcgcgccgggcagcacgaggtcgctccagatctcgtccgcgatgaccacgcactggtagcgctcgaagagccgcatggcgcgctccagctcctcgcgctcccacacgcggccgcaggggttgtgcggcgagcagaggatcgcgacatgcacgtggtggtcgcggagcttgcgctccatgtcgtcgtagtccatgcgccaggtgccctcggcgtccctcacgagcgggctgtggagggcgcgacggcccatcgcggcgagcgtcttggtgaatccaacgtaggtgggcgagttgatgaggatctcgtcaccgggggccgagaaggccgcgagggcgcttgagacgccgcccaggacgccgttttggtagtcgacgtgctcgcggcggatgtccgtgacccccttgcggcgggcgtgccaggacgagatggcgtcgtagtaggcgtcgggcgtcaggaagtagccgaaggcgggatgccgcgcgcggcggatgattgcgtccgttatgcatgcgggggcggcaaagttcatgtccgccacccacatggggatgaggtcccagcccggctggggtgggtcgggggagaagccggggatcttgcctaggccgtcgatggcgagcgcgtttgtgccgctcctgtccagggtcgtctcgaagtcgtagtgcatgcgggtctctcccctcgcgtggtgttgtacgacccatggtatcgcgacgacgggcgggacggcgggagcaggcgagacaagctggggggagacttcacaggacacccagcttgggactgcagacttccgcgatgccagggcaaggcgcgtgcggaaaagtttgctgcgcttctctcccctgacttaccagcggttatgttggaggaatcggactcgaggaagggggttggatggggaggggcgtttggaaggcgcggcaaagggatgtggagcttcttttggacgaggcggagggcgagggaaggtgcgccattgccggcaagcgacagagggaccttctgaggagaaggcagctggcaggtgacctcgtgaggccgtttccctccgccttcatgcgaagggtgacgtgggaggggctctcgccggaggggcagtgccttgccgagatcaggacggttgggcttctccatccggactggttgttttgcaatgggtcggcggcgctcgtgcacgggctggaagtcccctgtgccgacccgggcgtcgtctgtgtcacggggatcgatgggacgggagggtccagctcgctccacgtgagaaggcgcgccttgaagaggcggtgggtcctcgtggacggcctacgggtcacggactacgagcagaccgttacggactgcctggggagcctcggctttgctcgcgggcttgcggtcgcggactcccacctgaggaaatgcggcgacacggtggatgggctgtctcggctggtgcgggagtcccagttgatgggggcgaagaggtcggaggcgcttcgaaccgcatactgggccgacgggctgagcgagaacggaggggagtccttcgcccgcgcgcggatgctgcagcttggcttcgccaggccggcgctgcaggttccgattgcggacccggttgggggcgggcggacgtttcgcgttgactatctgtggacgcgcgaggacggggcccgcattgccggcgagctggacggacgcgagaagtattggcgggaggacatgaccggcgggagaagcgccgtggacgtcctttgcgacgagaggcttcgcgagtctcgcctgtcgatggccggggtcatggtggttcgcttctcgtttgcccaggcagccaggggagatgaactcgccaggatcctgacggcggccggggtgccaaggcgcgtcgagtagctggggcggggctatttttcgtgtctcgtaaggattgacgcgtttatgtccgcctaaacgcgcgtttctttacgagattcgaagttccgtaagaattgacgcggttagcacccctgtaaacgcgtcaaatcttatgagacccctgatgggggtccggggagcagcgacagcaaagcaggggtccgcggtccacctggaccacggacccctttaggttggcccctcgcgctgggcgggagattgattggcgcgggcgggcacgcgcaaccgcacgtgcagcaccccccacccgtgcgaacccctactcggcaaccaggatgtcgctgtactgcgggttcttctggaaccagcgctgcgcgtacgggcaggtggcacgtgccttcacgcccgcgaagcgcaggtgccgggcggcctgtcccatgagtctgccggcgaggcctgtgccgcgctcggagggctccacgtacgtctcgttgaagttggcgacgccgtcgtcgtccatggggaacgagacgcgacccatcacggtacccctatcgttgacaaagaccacctcgtcgtcttcggtctgcatgttcatgacgctctctcccctctttacgggccacgccgccccgaagggcggcgtgggtgttcgtttatgtaaagtagttctacccaaggggagcctcgtccaaacccaaggtcacttggaggcgtgccatgggagaggaatcgggcgagaggagcgggacggccgaacaagccccgggccaggagggcgagcatgggccgaggcgacgagcgggccgacgggtcgaccccgcctcgcaacacgaggcggggtgcaggctcgcggcaaagggacaacgcccctctcccccagcaacgccaggcgagagggacgcgggcgacgcagccctagctgatccagccgttggggtccttgccctcggcggcgaggcggtcggagaggcgcttcttgggcgacttctcccacagcggctcggatgcaacggcccagcgctcggcgacggccttggtcttgccctcgagctcgtccacgtcctcggggtgcgtgtagtcggtggacttggcgccggtctcgtgcaccatctcggagagctttccggggttgtcgagcagcgggcacggcctcagcatgttggtattgaacggctggtgcgcctggtagctcttgaacagcgggctcttgtagcactcgagcaggctcttctcgcggatgttgctgtcggagtagtggatgaacgcgcagggctcggcgtcgccaccggcattgatgtgcaggtagcgacgaccgccggcgatgcagccaccggtgtactcgccgtcgttccagaagtcggcgaagaagatgggcacgttgttgcgccagttgtcgcggaccttgtggtacatgccggaacgctgctcggcggtggcgaggagctcgacgggagcgcccaggccaacgggcatgtaggtgaagatccaggcgaagaggacgcccttgtccaccaggaactggatgaactcgtcagaggtgatggagtcgtagttctggctggtgtagcagatggaggcgccaaacgggagcctgcgctcgcgcagcaggtccatggcgtgggttaccttggcaaaggtgcccttgccgcggcgggcgtcagtggcctcctcaaagccctcgatggagaaggcgggcatgaagttcttgacgcgcgcgatctcgtcggcaaactcctcgtccaccagggtgccgttggtgaacgcgctgaagtagcagtcggggtgcagctcgcacaggcggatgaggtcgcgcttgcgcagcgtgggctcgccgccggtgtagaggtagacgtaggtgccgagctccttgccctgcgtgatgatggagttgagctcgtcgaaggtcatcgacttctgcttggagtcggtgtagttggctgcccagcagccgttgcagtgcaggttgcacgccgtggtggggtccatcaggatggcccaggggcagttgcagccctcgcgctcgttgacctggcgctggatgttgccgcccagggtgacggagttgacgaagaagttctgcacgaaggtgcgggcgacctcgcggtccacgttgttgatcacgttgtccacgagtcggcgccagttgttgtcggggtccttcatgtagcccatgaccatgttgaacaggcgcagctgggcgtcgttgatcttgtcgcccgagccggcgaacttgttgaccatcgactcgaccttgggaaggttgccgtcgaagtcgtcgtagagcatgtcaaagcccttgttcacggcgacggagatcgccttcgccttgagcgagttaatcgcagacacgtggttcccctttccattgcacgaccagacttccgggacaggccgagacgcgtctcgccggactcgacagggcatgtccatggtgtcgaattctgacaagtatagacatgccccacccgcttttgaccaggggttggaaagttgcccttaagggaatggcaacggtcatgtgcggcacgcggcgagcctcaggagggaggacgcccgaagcgccgagtgtgcccggtcacgcgcgacacgcgacccgaaggcgggcaagagatacctgcgttcccagttgagagggacgtggcaacttggcccccaccaatcgggctggcagaggctagcccaacttgccggcggcgatgaggtcccgtacctcgttgaggtcgcggcagatggcgacggcatgctcgcgggccgcgtcgtccggtgcgatgaggtcgggaaccatgaccggcaggaagccgccgcgccagcccgcctcgatgccgttgaggctgtcctcgagcacgagcgagcgccccggtttggcatccaggcgacgggccgcctcgagaaacacgtcgggcgccggcttgccgtgctcgacctcctctgcggagacgagcaggtcgaccatgtcgcgggctccaacgcggcgaagctgcgcgtcgatcatgtcgcgggggctggacgacgcgacggccgtgcggatgccctcgcggcggagatgcgcgagcagctcccccaggccgggcttggcggggacgccctcttcgcacaaacggttgaagcacgcgacctgacggcggcgaaactcctcggcggggacccttccgacaccgagctgcccgtcgagggcgcgccgcatctggtcgatccccgcgccgcggctcatgtcgatcatggtctggagagagtcgcgggggatgtcggtgactcccatgtccgccaggacggggacccacgtcctgtcccagatgggctcggtgtcgatcatgagcccgtccatgtcaaagattgccgcctgcagcatgggacccccggttcctctcgccttggtcatcctgtgccatggtacggcgagaggggcgcgggcgtggggtttggggccgacctccacgggacgaggggaagtcggggccgcggcgaggggcaacggaacaggaagctggtgcgacgggacggaacggccagggttcgcgcgactggcaccaccccatcggcagccgagacgattccgcccgccccgcgcagcgccgtccggcaaagggccgacgcgcctctcccctacagacgcctgagcagctgccagacccccatgaccaccggcgcgggcagtaccttgcccgcgatgcgcatgacgaaggagctcacggcacaggtggccaccgggtagttgatggagttgatccgccacgaccaccggaccacgtgacggggactcaggttggggaaggtgtgcctgaccgtggtctggccctccccggcggacgagcgggcaaccttgttgaactcggtcctgacccagatggggcacaccgccgtgatgcggatgcccctcccctgcagctcgagcctgaggccgcgcgtgtacgacagcacgaacgccttgctcgcggcgtacaggtcgagccccggcaggggctggaaggcggcgcagctggcaagctgcagcacgcggctgccgcgccccaggtaggggaggcacacgcgcgtgacgtcggcgacggcgcggcagttgaggtccacgagcgcgtcggtctgctcgagcgacatgtcctccacgttggcgaacttgccaaacccggcggcgttgaccagcagggcgacctggaagtcggggcggtccgactcccggcgcagctcgtcggcgagcctggtggcgctgcccctctcggcaaggtcgagcgagaaccaccgggactcggtggagagggacgttgccagctcgcgcaggcgctcctcccgacgggccacgagccagatctggtcgtagccctgggtgtcggcccagagcgcgtactcgcgccccaggccgctcgaggcgcccgtgatgatcgccactctcacctgcctgcaccgcccctttccgtcgtcgcgccgacgcgtgcccgatgccgggccgctactcctgcggaagctcgtccgcgttgggatcccagtcggtgaggcagtcgtcgagccccgccacgatggcatccttgtccaggttgcgaccgatgaagcagagcttggtcatgcggtcgccgcacacggggtcccagtcgtccatgacctgggggttctcggcgatgatctgcttgcgctcctcctcgggggccgacgccacgaacaggccgttctcgctgagcgtgacctgctggccggcctgctcgaacacgtagcacatgtcggggtcctgcgaggcccagaccattcccttggtgcggatgatgtcatcgggccaggtggtcacgtagtcggacaagcggtcgatgtcgaagggctggcgccgctcgtacacaaacgtcgagatgccgtactccagcacctcggggtcctcgtgctcctcggggtggtccatggcgtcgagccaggcggccgagttgtaggcgcggtcaaagtcgaagcggtcggtgtcgagcacctcggagagcgggacgttgccctgggtcgcctcgacgatcttggcatccttctgcaggctgcggacgatcgccttgagctcgctgatctgctccggggtcaccttgtcggtcttgttgaggaccacggtggtgcagaactccagctgctggatgagaagggactcgatgtcgtcctcgtcgatgttgtcggcaagcaggtccttgccgccgtggaactcgtcgaacatgcgggcgcagtcaaccaccgcgacgatgttgtccaggtcgagaggggccttgccgccgttcttgctctggtcgcagaaggccgagatggtgtaggcgatgggaatgggctcgcagatgcccgaggcctcgatgatgatgtagtcgaagttgccggactgagcgatgttgcccagctgcctggcgaggtcgtccgaaagggtgcagcagatgcagccgttggtcatggggatgaggtcgtcggtcttggacaggccgccgtcgcggatgaggctcgcgtcgacgttgacctcaccgatgtcgttgacgatgaccgccgcgcgaatgccctcgtcgttggacaggatgtggttgaggagggtggtcttgcccgcccccaggtagccggtgagaaggacgatcttcacgggcttgtcgctccttggcatgtgatgccttcgctttctggttgaggttgttcagcacctgcatcctacccaccgcgaggggcgcacatcgccctggcacggatgcgcacccaaatccctcacgccaacgtgaggcaggattaggcagacgcgctagtggatccccatgacggcgaggacgatgagaatggccacgccgacgaccaccgatatgaccgagctgcgcatcttgcggcgcaccagggcctggcgctcctcgtcggtgagcccgtcggagctgatggcccccggcgtggcctggctctttgccttggctggcccgctcgctgccggcttgcccgtctttgcgtgaccatgggcggacttgaacccctttgccatggaccctccctaccactcgacaggggtcgacgggcggaatccccgttcgtctcccctgcggaaccctgttctctggcagaccattctccacctttgtcaggccaggcgcgagggatgcggcatgcaggccggagggagagacgcgaggccactccctcgctccccgcccccttggcatccagcggaactttggaagccatcaatccaaacccccgcgtccacctgttcccaagcatcgtcaaaagaactctaggaagaggagggagagggcctgcgagccgggacggcagcacacgcgtccgtctctcccgtgccttccccgactccctgccggcaggatgacgggcatccaacatttggaggagcgtccggacgggtcacccgaagccaagatcttgcatcaatgttttaatcatagcggcaagctcccgaagtgagcactcacatcgggctcccaccgccattgaccccgagaggcagacgggtttccgcaggttagccatgttagagcttgcgcggtggcaggaaactcccgctatgtgtactcacatcaggctcccgctgccattcgagcctgggaacggagtagtttggcagcaaactcccggtgtgtgtacacatatcggtctctcgctgccaggccaggagcccggcgtcataacctcccaggacatttcaaatcagcattctaatcttgtcagcagactcccgacgcgagcactcatgtcgggcttcccccgccatattttgaatcctgatgccactaaggaacaggtccttggcttggagggcggcggggaggcaagccaggagagattggcggacgagggacaggcatggcctgcttgcaggggcacacccccctctctggactttggacgatcttggccggaaggacgttcggcgaaacgtctcacccaccaacccttgtccgaggggacggcgtcgattcgtcgacaaggacccgattccgagccgtcaccagcccgtgtccgagaggacggcgttcgggggctcattcatcaaggccctaaccttgacggcaagtcgctccctgtgtgagcaccttcacgcagctccctcagttgccgttctgcgttttcccagttgctaatcaatcaaccttttaaccttgacagaaagcaactcgcgtgtgtactcacgcgaggcgttctctgccacataggtcactttccggcacccatccggcagcaactcggtcgcatgtgtacacacgcgacgcgattgctgccatcgttgagagccccaatgtttcgatacctcgtttacctgcgacgattcaaaacggcgcagtcaccttggcagaaagtcccccatgtgagtacacacgcgacgcgattgctgacaaagttcatattttaattgtccatcgtgtcggttgccctggctgggcaaatcccgctccaggaaatatgacttggcctctcccttccttgagctctttgacgaaatcgcacgtaggaagatgccaacgcgcagcgagcccctcttgaggtggacccgaccggtcgagaatgcgggccagacgacgccggcggcaccgccgcggtggaccacccgccgaagaccgtacgttggcatgagcccgacgacgcctaccgccaacgcagctgcgaacagcacgcgggcgttcggagggaagcatcgacccggtgacgccagcccccgactcagcccgcccccaccgaccgcaccgctcgcgccagcacctcgacgacctggggaatgcaatcgggctccagcccgtcgtactgcatcacgaacctgcacagcccgtcaccacgcgaggcgttgcggctttcgtgagcgtagccgcagagcggggcgagacggacgccgccctctaacgccgcccgcgcgatggcgcgctcggcatccgggcttccgtcacctgacgggagggcgagcacgaagtggaggccggagtccctctcctccgcatgcgcaatccccgaaagcgacgactcccccatcgcggagacaaaccggtcacggagcgcccgctgctgggagcggtaccggctgacgtggcgctcgtagtccccggactcgagcaggcgggcaagggcgacctggtcaaccacgctcacggtgcacgagaggaacgacaggctcctctcccatgcctgggccaaccccgccggcagcaccatgtaggccagacgcagggccgagctcaggctctttgagaaggtgttgacgtagatgacgctgccggaggaatcggacgcgaggagcggggggatcgggcggccggacattcggaactcgcagtcgtagtcgtcctccaccacgtagcgggcggggccatccccgtccccgctcccttcggcagcccagccaaggaggcggtagcggcgggacgcgctggtgacgcagccggtgggaaactggtgcgagggcatgacatggacgagggtcgccccggtgcgtgacagctcgcccacgcgcatgccctcccggtccgtgggcacaaacgccacgttgagcccacaggccgcgtaggtctgccatacgcgcggataccccgggtcctccacggcaacggtccctcccgaccccaccaggcgggcgaccatggcatagatggcctgcgcccccgcagcgaccacgatgcgggaggggtccacgtcgacgccgcgactcccgcgcaggtagcgtgcgatcgctcggcgaaggcggagcgtgccctggggcggctgggcggcaaacagctcctcccgcggctcctgtgacagcgtctgcctcagggcgcgctcccacaggttggcggcggaggagtcggcgagggtggcgggcgacgagaagtccgcaagcagcctgggccccttcccatcgtccgtggggccaggcgagacggacgcggcgacgtgcggccgcacgccatgaggcacgggcagctcgttggcgtagtaccccctgcgctcgagggcggtcacgtacccctcggcgacgagctgcgcgtaggcgttctcgaccgtgacgaggctgacgcccagcgcgtccgcgagcctgcgctttgaggggagcctgtctcccgcggcgatggcaccagagaggatgtcgtcccgcatccgccggtagaggtactcgtagcggctgaggctgccgcgccgcgacatgtcgtacgagagcatggggccacccatctggtcttatcgagcttgttaaactgatcctattctggtcttacatactagtctcgtattggttattttgaccatcccagtttgcccctagcatctgccttgcgcaatttcgcagccaacgacgcaagggagacaagcatggcgcagcagaccgacaccacaccccaggagcgggcaaagctcaaccgcgagctggcacagatgctgaagggcggggtcatcatggacgtgaccacgccagagcaggcgcgcatcgccgaggaggcgggagcggcggcggtcatggcgctggagcgcatccccgccgacatccgcgcggcaggcggggtcagccgcatgagcgaccccaagatgatcaagggaatccagcaggcggtctcgatccccgtgatggccaagtgcaggatcggccactttgcggaggcgcaggtgctccaggccatccagattgactacatcgacgagtcggaggtcctctcccccgccgacgacgtgtaccacattgacaagacccggttccaggtcccgtttgtgtgcggggcgcgcgacctgggcgaggccctgcgccgcatcgcggagggcgccagcatgatccgcacaaagggcgagccgggcacgggcgacgtggtacaggccgtgcggcacatgcggctgatcaactcgcagatccgccacgttgcgagcctgcgcgacgacgagctgtttgaggaggccaagcgcctggaggtccccgtgtccctcgtgcgctccgtgcacgacgagggcaggctcccggtggtcaactttgccgccggcggcgtggcgacgcccgcggacgcggccctgatgatgcagcttggggcggagggcgtgttcgttggctccggcatcttcaagagcggagaccccgccaagcgcgcccgcgccatcgttggggcggtcaccaacttcgacgatccggagcgcatcgcggcgctttccgaggacctcggcgaggcgatggtcggcatcaacgaggacgagatccaaaccctcatggcggagaggggcaagtgatggcgaccgcggttctcgccttgcagggggcctttgccgagcacgaggcgatgctcgaccgcctgggagagccctggtttgagctgcgtcaggcacaggacctcaagcgcccctttgacaggctggtgctgccggggggagagtcgacggtccagggccggctgctgcgcgaggagggcatgctggtccccctgcgcgagcgcatcctcgccggcatgccggtcctggggacctgcgccggcctgatcctcctggcggcgcaggtgagcggcgacgcctcccgccagggcaagccccgcccggaccaggtggggccgtggctcggcacgctcgacgcgaccgttgagcgcaacgcctacggccggcagctgggaagctttcacgcgcgagcagagttcgacggggtgggagaggtgcccatgagcttcatccgagccccctacgtggcgggcgtgggcccccgtgcgaccgagctcgcgcgcgtggacggccgggtcgtggcggtgcggcagggcaaccagctcggcgtggccttccatcccgagctggacggggacacgcgcatccacgagatgttcctggggctgtgaggacggtgcctctcccctagcgagaaccccaaccctgcccgtggctcctagcgggcggggagcgcctcgccttcgggaggcaccgggcgcgccgcgggctcgtcccctccctcggtcggcctcacgggggcaaacgccagcccaacgaggaacggcgccacgtagatgacggggagcgcgtaccgcgccgtgaagatgggcgtgaggaggcaggtcgcgatgctcaggagcaccggcagcatgacgagggcaccgggtcccctgcggcgcaccaggtagcacagcacggcaaacgggatccagcaggagtacagtcccaccctgaacagcaggcacaggggaacgctgctgtcgagcaggtcgttgtagatggagtgcatcgtgaggcggtagcccgtgagcgccatggggtgccacacgtactttgccccctccgggtctatgtcgcccgtatgccactgtatggacacgatgccgtgggcgttgaagaacaggttcgccgtgcccacgatctggtcaaagtacacctcggggtgcttgagccccatctggaaccacacgcggatgtagcggaggaggtccgcccgggtcgccgtctggtagcggtaccaggccttgaccgtgtcggcgtcgtcgtactggtagttgatcaccagcgcctcgtagggcagaacggcgtcgatggcctccctctcctcgtcggtgacctcgtcgccgtggtacatcacgtagcgtgcggtctgctggaacagcgtgttgagcggctcctgcaccccaccggggatgatgtcgaacagcgggaagatgacgtgcgggagaatcacccacatgatgaccgcgacggtcgccgcctgggccacgaactgcctccacaccccgcggaaggcgaccgcgcacaccaggcaggtggggatcacgatgtaggcgccggacttcttggtgagggcctgcagcacgccgaggagcaggaagcacacggcgacccagcggtggcggcacagcacctctcccctggagcggaccacctcgcacaggaacaccaggtaggtgacaaacaccaggctgtaggtggagtccttgaccatggtgaaggcgtacatgccgtagaaggggagaaccgcgatgaagaggaaggcgccaagcctgaggggtgcggggacgccaaggcggcgcaggtaggcaatggcaagcgagaaggtcgcggcggtcacgagcccctgcagcaccacgaaggcgaacacgcccgcgttccagctgcccgtgaggtcgaggctcgtcttggtgaagaggccgtagaggaccgtgtcgaacacggggtggtggtctgagagccacgcgccctccacgatgctgtgggtctcgagccaggggatctggtacacggggtaggtgcgctggtacatcgagacctggtagaacgcgtcccagttcatggagcccgggaaggccgccagcaggtaggggatccacagcgcaaacagcacgagggcgaacatgacgaccgagcggggcgtcaggcgcggggtcaggcggtcgacgacctggagggcgcgatgccgacgggagacgccgcggccggcggtggccgcgtccctctccccctccgcggcctcggggatgaggccgatgggaaggccggacacgggatcccagcgtcggcgcctgcccatgcggtcagtgacgcgcacgacgacctcgcacaccgcgaagaggaagactgcgattattgccgtgagggagaggaactcccgagtggcccccgttcggtcgaggatgtagcccgactcgaacatgtactcaccgtaggtgaacgagaccgacgcgaaggcggcacacgccaccacgcacagcacgtagcccaacctgggcagcctgcccctgagcgcgtggatggtgaccacctccggaagaatgcctaaggttgcaaaaggaaaggggacaagacctgaccatatttccttcccccacaaacgtgcaggaaggtggcctgtcttgacaattctccctcacaccttaggggagcccaaggcggggggcgagacgcgcggcaggcgcgtgggacgggcagcccgtgccatggcgtcggggcgaggggcgacgcggctctcccccggcgcctcgcacgggacgtgcccggataccggcgctagaccagcttgccgcggcagtggtcgcacatgtgctggatcatctgggcagtccagccggtgaagtcgcgcgtgcgctgaaccagcttgccgtccaccagctcctcgtagcggaccttgacctttgcgtagcgggtggccttgacgggctcgtcgtgcgagaggcagctctcggtcacgcgcgccgcctgcagccccatcatgacgtgggggttgtacatgacatgcgcccctccctcgtcatccaggtaggcgacgacggacttggtgacgccgatctggtttgccgccaggcaggtgcagtcctcgaccgaccgcatggtgtcgacgacgtcctgtgccacgtccgcgtcctcggcggttgcccttgcgcacttcttgcccaggacctcgtcgtccttgcagatctccttgaccatgctcgctccctcgtgggtgcccgcgacgcgcgcgggacggtttgccatcagcctacgtatcatacgttatccgcggcggaccgccgggattcgaagcgggcggatggcgcgttggcccacgccacgggtggccgtacgacgtccacgctgccgtttgttggggcgctgccgccgcgggtgtcaactccccacgggcaattcgaaccaaggtggggcgcatgccgcagggaagggacgtcgactaccgggagtacgcgggacagatcgtgagcgcgatccccaagggggtgctcctcaccaccaaggcggaggggcgcgtgaacaccatgaccattggctggggcgcactggggaccaactggtcggtccccatgttcgaagcgttcatccgcctgcaccgccacacggtgtcgctcttggacaagaaccccgagttcacggtcaacgtcccgctgggggactttgaccgcaagatcgtcgggttctgagggagccaccacggtgacgaggtggacaaggtcggcgagctggggctcacgctggtggactcgcgcaaggtggacgttcccggcatcgcccagctgccgctgacactggagtgcaaggtcgtctaccgtcagccgcaggagcttgacctgtacacgccggacgtgctcgagcggttctacccccaggacgtggacggaagggcggtaggcgccaaccgtgacccgcacatcatggtcttcggccaaatcgtcaacgcctacgtgatcgaggaatagtcgcacgcggggaggagcgcggcgaagttgtcgcccctcccctgacctcacgacacacgtagccgtaacggtgcgggaaatcgtctaagaaggcgtcggaccaacgccacctcgggccaaggctctccgccttggcccgtttgcgacggctcccgcacgccaggcgaggcgcacgccttccggacaagccggcttcctcggtgtgtgacgggtcacaatgctcccttcttagggctctttcctgcaagcgaggacaatgctgcggttcagacgcatcccacggcgggcccactggcaaagggctcccaatatgtgcaccttctcgtggcttcggctgccgcgtcagcgatcggcatcgcgtttccccagttggattcccatcaggaatgcatccatggcagctgcttcccgtttcccgttgtgagtactcatatcgggaagcagctgccacccgaacccgtaaagaggcccgtctgccagcaaactcccgacgtgagcactcgcttcgggagtttgctgccatgaacaagttggcagacataccccgcttcattcccaactggggaaacgtctgtcaaccccagcacccgccccttccccctgacgggaaagtgctcacatcgggagtgcgctgccatgggtcacccaggacgacggacgaacgggagcaactcgctcgcgcgagcactcacgtggggattccgctgccgtgattcaggccttgacgcactaccggccacgacagggctacttgcgagggaacggtgcgacgtcgtgcccgaaggcatcgcgctcccgctcaccactgggaccccgctgacacccgctcgtagggattcccactcgcccttctatgaccctgaatacccctcttgtcagcggcagcgtggagcccctcgcttgccctcgcgcgaacggtcagtgagaaaacgcgacgactgttggagtcaataccgagcggatgagcgcgaaccgccctagcgatgctcccggcgatcagggcgatcgcccctctcgtccgcctcgcgttcgattcgctcctccgcttcgtgcaggccatgctccacgcgctcgccggcctcctgggcgtcgcgttccagcctctcccccgcctcgtgggcctcccgctcagccatgcccagggcgcgacgaagtcgctgggcggcggcgttcctgcgctcgctggtgaagttggtgacggtgcggagcgcgcggcgctgcagcccggacataccggcggcgatgcgcttggtgctctgcgagacgtcctcgccgagcggcgggcgacccgacgcgatgtccgtgactgccacgtccatgacggcgtcgaacgcggactgggcggactcgatgcgcttgcccaggtcggtgagcgccgagaccgtaagccccaggtcggcgcacatgagccccacgatgacgagggcaaagacctcccacgtcacgagcggcacgcccgaggacacggacgcgatgggtatggccaggtagtagtaccccagcgtcccggcgaggccaaagcagagtgcgaacggcaggcagatgcgcccgttgaggttgagggggatcttgctgtagtcccaccaccgcgcgtggaagaaccgctccagcaggtaggacgtgaggtactcgagcaccgcgctgcccacggagcagaacacgaacaccttccaccagggcatgctcgcagaggtggtgggaaagaccttgggcagccaggtcaggaggagcagaaccgcaacgcccgcaaacccatagatggggcacacggggccaaacaggaagcccctgttgtcccagcgacggttcttgattgcgcagaaggtgcactcgtacacccacccgcccaggctgaagacgccaaaccaggtgacgtagcagcagatgtccatgcaggccctctcaaacggttgcaacgcttgccccactaggctagcgcgggagccctgggcgcgcatcgcggattgggcgagaggagccggacacctcgcccgtcaccggcatccgtcggcatcgggcgcgccatcgcccccgccggatggacgccgcgccgcaaccaacacccgtgggtaggcgggacgcctactccgcgtcgccctccaggaacccgccggtctggcggttccacaggccggcgtactccccgccctgagccaccagctgggcgtgggtgccgtcctccacgattctgccgtgcgagaggaccacgatgcggtccagcgacgccacggtggagaggcggtgggcaaccacgatggaggtgcgcccgcgcatgaggttctcgagcgcgccctgcaccagtgcctcggactcgctgtcaagggcactcgtcgcctcgtccagcaccaggatgggcgcgtccacgaggatggcgcgggcgatggccacgcgctggcgctggccacccgagagcttgacgcccctctcgcccaccatggtgtcgaagccctgggggaggcgcctgatgaactcgagcgcgtttgcctcctccgcggcgcggacgatctgctcctcggtggcgtcgggccttccgtaggcgatgttctctcggatggtgcggtggaacagcagggcctcctgcggcacgtaggcgacctggcgcctgaggctctgctgggtgcacttgctcacgtcctggccgtcaaccagcacgcgaccctcctgcacgtcgtccaggcgcagcagcagcttggtgagcgtggtcttgccagagccggagcgccccaccaggcccacgcgctgccccgcgggaatgtgcaggttgaggtcgcggaacacgtcctcgtcctcgggtgcgtcggggtagtggaagcccaggtgctcaaagtcgatggcgccctcactcacctgcaacgggcgcgcgtcgggggcgtcggccacgagggtgggctcgtcgagcacgcgcgtcatctcggcggcgtcgccaaaggcgcggttgatgcgctgcatcatcgagttgaagtagttgaagcgcatcgtgaggttgtacgtgtacgtgaacatcatcaccaaggtgccggcgctgatgccaaaccaggcgttgcccccggccacgaatatcgagacgacgaacatgatcaccgtgatgagtgccgacgtggtgaagccacggcgcatggtcgcacgcatgttgcggttctcggccgccatcgcctcgcggtccgcgctggtgaacaggccgcgctcgtagtcctcgcgaccgtacgtcttcaccgcgaggatgtttgtcacggcatcggagaggacgcccgagagcttgttctgcgcggtcgacgcctgtgcggagaggggcaggatgcgcttgtacatgcgatacgccaggaccacgtagagcacgagcatcgcgcagagcacggccacgaagctgggcgccacggggaggagcatgccgatggtcagcaccacggaggcgatggtgggccacagcgagtaggtgaccacgtccaccaggccggagtagccggagacgaagcgggaggtctggctcaccaggctgccgccaaagcggctgttgtggaaggtcatcgactggttggacagggtgtcgaagcacaggcgcgagagctggtagtcaccgttgatctcgagcttgtacaccgagtagtcctggagctttgagagcgtctggcccacggcgttgaccacgagcagggccaggatgtaggggccaaagaccgcgaggacctggtcgccgggaaccggggatgcctgcacgcgatcgacgatgaggcccatcacgtaggtgttggcaaaggtgagcagggcgatgtagcccaccgagctcacgatggagagcacgaaggcacccatcttctgcctcgtgacctgccaaaagtagtgaagcgtccttctcatggtggaccggtcgttccgtcccttggttcccccgagcgccatgcgtccctcccctgcggcgcctgcgaccaaacgtggtcgacgcgacgccgcctcaatcccaaacgtgcgaagcctgaataaaagctatcggtacatagtcccactttgacccgcttcctatacatggggagagaagatgcgcatgcggcttgggacgcctcacgctggcagcaggccatgccgcgccgtagggcatgaggcggcggaggggcctccccccagcggacgcatcgccttgcgccgtaacagatcgtttacgcaatgtggcttgcatccccactcggcggggacgtatagttccacacaaccgacacacgccgcacgcagcggccgagcaatgtgagaggagcgccagagatgaaccgcaacgccgtcagccttgcaggcacgtccaacaactggtggtggcgcgattcgcattcgatcggtcgatcgtgagtctctcgcgccatacatcttgcgtacagagggggctccggttggaccggggccccctttatgtgttggcacacgcatctgctcgccacgatttccagacaccgccacaaggcacaagcgaaaggaagcaaccatgtccgagaacacccagcaggcacgcaccgtcacctccgcagaccacggcaagctcgacgtgagggcgctcgtcctcctcgccgtcctcctcgccgccggcttcatcctcaacttcaccgtgggcaaggccatctcgggcgccacgggcggcctcatcagccccgagttcatcatctcggccttctgcctcaccatcctcgtcgtgaggcccaacatcgcccaggccctggtgatcggcctcatctccgccgccgtcatccagatcaccaccacctcgccgttcatcgactttgccgccgagggcgttgccgccatgctcatggccgccatcgtcaacggcatgatgggcggcaaggccgccaaggtcgtgccgctggttggcaccttcgtcaccaccgtggtctccggcctcatcttcatggtcatcaagatcgcgatgatcggagccgcccagcagctcgccgccgccatgctccccgtggtcgtgctcaccgccgtgttcaacgccatcctggtgcaggcgctctacctccccatccgcaaggccctcaagctcaacgactaggctcgcccgcaaggcgtgcgccggcctcccgtcagcgcacggaaacacgggtcggctaccatggatgggccgttcggctggggccgggcggcccatccgcgcaacgcgggcagaaacgagtcatcaaggggtatccatgccatccagtgcagactctccaatcatcgagctgagggacgtctcgttctcctacgagggcccgtcgagccaggacggcgacatggcgctgagccacgtctccctctccgtgggacggggcgagttcgtgggcgtcataggcccgtccggcgcgggcaagtcaacgcttgcctccgtgatgtccggggccatcccccaccactaccgcggggcgctctacggcgccacgctggtggatgggagggacacctgcgaggtcacgctcaccgacatctcgcgcatagttggcagcgtgctgcaggacatcgacacccagatggtcgcgtcggtggtcgaggacgagatgctctttgggctcgagaactttggggtcccccacgaccagatagaggagcgcgtctcccagacgctccagaccgtgggcatctccgacctcagggaccgcgagatcgccaccctctccggcggacagaagcagaaggtcgcgatcgccgccattctcgccctgcagccgcgcgtgctgctgctcgacgagcccaccgcggcgctcgaccccgcctcgtccaccctggtgttcgacaccctgcagaaggtcaaccgcgaggccggcatcaccgtggtggtgatcgagcagaaggtcgcgctcctctcccgctactgcgaccggctgctcgtgatgagccgcggctcgctcgtgctggacgggacgccccgccaggtgtttgcgcatggggagaggctccgcggcataggcgtggacagcccccgcgttgcgcgcgtgtacaacagcctcgccaggcacgggctggtggaggggggcgagccgtgcctcaccgtccccgaggcggagcgcctggtggctggcctggtgggagactcgccccgccaggtgacggagggcaacttccgcgcggggtcgcgacacgtggccgccgcccgcccccactccgagggggcggaacccgtggttctcctccaggacgtgtgctttggctaccccaacggcggcgccacggtggacaacctggacatgtgcgtgtaccccggtgaggtcgtgggcatcgtggggcagaacggcgccgggaagacgaccctcaccaagctgctcaacgggttgctcaggccctcgtcggggtcggtgaggatcgccggcatcgacaccgcggacgtccccaccagcaggatcgcggcgcactgctcgaccctgttccagaaccccgacaaccagctgtgcaaggacaccgtgctggacgaggtcgcctttggcctggagctccagggcgtggggcaggacgaggcgtgccgtcgtgccagctccgtaatcgaccgctttggcctcccggcgaacgaggcccccttctcgctctcgcgcggacagcggcagatggtcgccctggcatcggtggtcgtaatggagcccgaggtcgtgctgctcgacgagcccaccagcgggctcgactaccgcgagtgcatgaccgtgatggaaaccgtgtcggggatggcggagcgcggctgcgccgtgatcatggtctgtcacgacatggaggtggtctcggactttgccgagaggatcgtggtcatggccgacggtcgcatcctgggcaggggccagaccacgcagacgttctgcgactcggacctgatgcggcgcgcctacgtggaggccccgcaggtgatcgagctgtcgcaggcgctggcgcgggacgtctcgcccgagtttgcgggcatcagccaggtctctggaatcgtcgacctcaccgaggagatggttggccgtgcttaacgccatcgactacgttcccggcaacacgctgctccaccggctcaacccggtcaccaagctcgcgctggcggcggcgatcatcatcgcgaccttcctggcggacacctaccccatgctgctggggctgctggcgctcacctttgccctgggggcgtacgccaagtcctcgtcgcgcctggtctctctcctcaagctgctggtcccgcttgccgtggtcatgctgttgctgcagaccgccttcgtgcgcggcggcagtcccgtgttcctgtggatgacctccgagggactggagaccggcaccaaggcgtgcctgcgcctgatgggcgtggcgctgcccctcatcctcatgctgacggtgaccaagctggtggacctctccaacgcctgcgtggaggtgctgcacatcccctaccgctacgcgttcaccttcacgacggccctgcgctttgtcccggtgttctcgcagcagatgaacgccatcatggaggcccagtgcgcccgaggcgtggagtacgacaccaagaacccgctgcgcaagctgcagctgatgctcccgctgtgcgtgccgctgctggtgagctcggtgggcaagacggacgcgaccgccctcgcggcggaggagcgcgggttctacctccgcacgcgcgagagctcgttcaagcgctaccccctcgtggcgcgcgacttcgccgtgctcgtgggttgcgtcgtgctggtggcgctgggggtcgtggcctaggggatgtaccgtggcgagacgggcggcggtcgcggctggcagccggttcgaccggctgcatgcgggcattgacggcatacgccatccgcctacaccgctgcccttcgcccgttcctcgaaggcgaggcgaaccgcccgtcctcgccgccgtcacgccagctgcctaccgcgtctggagcgagggctgcccgctgccagctagaggaggttgtcctgccaggcgaagttcttctcccccgcccccagctcaaagtgcaggcgggcgatgccggcgtcgatcttggcgcacgggcctccgccgggctggatctgcacgatgtcgcggctctgcaggtcgcgccttcccgtgagggtgatccagaacccctgctggttcatcgccgtgggggcgagaagcgccgcctcgacgccgcgggtgaaccacgccggcacgttgatggccggcttggagacctgcggcacgctcttgcacgggtgcatcttcccctccgtggtgccgtggcccagcgcgaccacgatcaccaggcggtcccccttgggaaggctcgcgcgaaccaggcgccgcttgtagctcatggcgacccaacagctgttgaggccaagctgctgggcgagaagcacgaccctctcgccaaagtaccccgcgcgggcctcgagccccttgtccgcgggaccggcgatgaccaggtagttgtgcacgccggagaagttgccgtagtgggcgagcctgctgtcgaaggcctcgggctcgtcccaggccaggcacatgtggagccggcccgcctcgttgccgcgcctgacctcgcgttgcagggcctcgcgggtctgctggtctatgggctcgtcggtgaagcttcgcaccgcatggcgggacaacatgagcgacaacgcggtctcggggtcctcgtcccacgggacggagcctggctttggcgcggcatggcgcggacgcgccgcctcctgggactcgcccctctccccctggccctgcgaccgagcctgggatgcctgttcctgttcctccacgggagcgtctcccttcccacacatgttcataaccagtcaattatggacggaaacacggccgttcgtccaagtattaggacggacggcaagatgggccctcatccgcacattccttgggcatagctgacgcacgccgcacgcggccggacacaacgcacccgacctcgcacgacgccgcccgctccgtccgttcccgcctactccgcccagaagaccctgtttggcctgcgcggcgccggcgcctttggctcgtcggcggcgtagcccaggatcacgtggccgatgccctcgtagccgcccgtcacgccgagctcacccaggagcgccttgaactcgccctcctcaaactcctcgcgcgcacgatggatccagcagctgcccaggccaagcgagtgggccgcgttgagcatgttgccaatcgtgagcgagccgtcgtacacgtgcgtcggacgcgccttgtcggcaaggacgaccagcacgaccggcgctccatagaacgggtcggtcccctcgggggcacccatgatcctgcggtttgcctcggcgagacggtcgcgcagctcggggttggtgactgccacgatgatgggagactgctggcccatgccgctcggggcccacagccccgcctggatcacctgctccacgagctcgcgcgggacgggacgcgaactgtagctcctgacgctacggcggtccatcatgttctggatgacttcgttcatcggtttcccctccgttggtgggacaggtggcgacgctaaacttggcacgcaaacgttggtatacccctggagtcctcgggatgtcgcggggggagagggacgtcgcccctcggtcgaggcccgtcccaccggctggcggaggacttcgcgcgcgaggggatgtccttgcacccctcgtagggagctcccacctcctcagtcccgcagctcctccctcctgcctcaagagaagtcgtggactttcggggttgcatagcagaaatcgattcggataagagctcagggaagggtggcgaagcgacgcgcgagctgcagccacctcttcccccctgggcttcggtggcagtcaggtcccgatatgagcgcttccccgtggaagggcgaaccaccccagccaagaccgctctgcgttttctcaggtgggaatgacctgaggggcgtctgctttcctatccgtggcaacgcactcccgatgtgagcactcatatcgggagtgcgttgccaatcggacccccttctaggtccggatggcagatctatccctctatgagcactcacttcgggagtttgctgccattgttgcaagactgatggagaaccaactggagaaacgcaaggctggcgcgctaccgtagcaatcgaaacctgatgcaggtacgcatatcggtagtttgctgccagtggacccgccacagtagttgcctagatgcgcggcgcgaccaatccccggaagaggggaagggctctgcgaagggcccgtggcagcctcacacacatgtgggcgttggctagtccgggcgagagacggcccgctccattctttgcctactggtcccccgtaggaatcatcgtggctcggaacctcgccggctgaatgcgagggaagattgcccccacgccgggaatcgcgtcccgcctttacacgtgagacggtttttccgtcgtgatttggttcctgatgcgttgagctgaggcgagatcttcagagtgcatcggggatcgcccgggacactcccctcagcttgcccgctgcggaggagatgacctcgtaccaccgttgatattggtctcctcctggggtcccatcgcccctctcgcctgaggaaaaccgcaggggagcgaagccggttccagaaacgaagtcggccagccccaggcaaaccggggctggccgactgaaccctcgcggggagaggcgccactcgctagaagctcagggcagccttctcgatgccatcggcatccaggccgtacttgtggagaagctccacggcggggccggactcgccgaaggtgtcctgcacgccaacgcgacggacgggcaccggatgacgctcggagaggacctcgcacacggcgccaccaaggccgccgaggatggagtgctcctccgccgtgaccacgcggccggtcttctcggcggacgcgcagatcgtgtccgcgtcgagcggcttgaccgtgtgggcgttgatgacctcggcgtccacgccctgcttggcgagagactccgccgcctcgagcgcagcgccaaccatgaggccgcaggcgacgatggtgacgtcggagcccttgcgcagggtgactgccttgcccagctcgaagtggtagtcgggcgtgtcgttgaagacgggcgtggcgagacgggcgaacctcatgtacacgggaccctcgtgctcgtaggcggccttcacgacggcacgcgcctccacgtcgtccgacgggacgaccacggtcatgcccgggatggtgcgcatgagcgcgatgtcctcgcagcactggtgcgtggcgccgtcctcgcccaccgagatgccggcgtgcgtggcgccgatcttcacgttgaggtggggatagccgatggagttgcgcacctgctcaaacgcgcggccggcggcgaacatggcgaaggtgctcgcaaaggcgacgcggcccgtggtcgcaatgccagcggcgatgcccatcatgtccgactcggcgatgccgcagtcgaagaagcggtcgggatacgccgccttgaagatgccggtcttggttgccgcggcgaggtcggcgtcgagcaccacgaagtcgtcgtggtccttggcgaggtcgaccagagcgtggccgtagctctcgcgggttgcgatcttcttgtctgccgacatgcctactcccccctctcgagctcggccatggcctgctcgaactgctcgtcgttgggggccttgccgtgccagcccacctggttctccatgaacgagacgcccttgcccttcacggtcttggccacgatgcacgtgggcgcgcccttggtggcgcgggcctcggcgaaggcgggacggagctgggcaaagtcgttgccgtcctcgacctcgacgacatgccacttgaatgcgcggaacttctccgcgatgggggtggcggggttcacttcctcgatggttccgtcaatctggagcccgttccagtcgacgatggcgcagaggttgtcgaggccatggttgccggcgaacatggcggcctcccacacctggccctcctcgagctcgccatcgcccaggatcgcgtaggtgcgccaggtctcgccccagtgcttggcggcaagcgccatgcccacggcggcggagatgccctggcccagcgaacccgtgctcatgtcgacgccgggggtgtcgttcatgttggggtgaccctgcagcctggagccgacgtgacgaagcgtctcgagctccttgggagggaagtagccgcgctccgcgaggacggagtacagcccaggcgccgcgtggcccttggagagcacgaggcgatcgcgcttggggtcatcggggttctgcggatcgacgtccatctcctcgaagtagaggtaggtgaagatgtccgccgcggacagcgacccgccggggtgacccgacttggctgcgtgcgtgccgacgatgacgccctggcgaacgcgagcggcgatcttctcgagctcggcgtcggtgtgctgagacctggtttcggccatggtgcccttctcctttctaggaaaacgagccggaaggccagctagcccccggctcgtctcagtctatcgcaccctacgccccggcggagaccttctcccagtcggcgtcgaacttcgccctgccctcggcggtgagcgggtgcctcacgcacttcctgagcgccgcgaagggcacggtggcgatgtcggcgcccatgagggcgcctggtgccactttgttggtgtgcgcaccgcggcggttatgatctttgttcccccgccctccgccgtcccagtagccgtagagtagttcttgacgcctgcaccacggtctcgatctgggctaggccggtcgtccgccgattgtcgtcgaagcggccgactaaggggctcacgtatcgcgccgccggcgcggtggcgcctcccgcctgcgggggcggagaaaaaaaaaaaccataacaaaacaacaagaacaacaaacaccaaaaaaaccaaacaacaaaacccccaaacaaaccacaaaccccccctcccccactccacccaacaaacacaaccaccccccaccaccaccaaaccccccccacccaccccacccccccccccccgcacaccccaccacaacccacacccagaccccccaaccaccccacacacccccacacccccccccacccccgtccaacaccatcaacccccccccccactccacccccccccccccatcaccctccccacccacccccacccccaccaccagtccccctcccccctccccaccgcgcccccctccgtccacccccccccccccaaccccccccctccccctcccccccccccccccccccccccccccaccccctcccccccccccccccctccccccccccccgctccccccgcccatcccctctcccccgccccccccccctcccccacacaccgcccccccccacacacaccccccccccttcccacccccctccccacctccccccccaccccccccccccctcaccaccgccccccaccccccccccactctctcccgcgcccccccgccgccccctcactgcccccacttgtcaccccttcccccccccactacgtcccccaccgccagcctcgctccccgcgctagtcaaccgccaccaataaaccccctccgccacacccaacacacccccaacactacctccaccccccccccacccccaacaaccaacccacccccacactccgcttaacctcaaaaaaccacaccaccccacaccctaccacaacaccccccccccgccccagccaaacaccatccacaccaaccccatcaaaccccccccctccccccaaaacctcctccccgcccctccactcccaatatactcccccaccacccgaccactcgcccgcccaccacccacaccgccccactacacaaatctcaaaatccaaagcccccctccgcgatggatcttctcccgccctccttcacacctcaaataccctaaaattcgttttctaccatcactctaccactacaaaacaacaccactcagctgcccgctctcatttctcatcaaaaaacgacatcactggtgctaactctcgcccggtcctatatactttctttaatatttatccttacacttctcctctacgccctttttgccttctacccctcattcactcactcctccagactctagtcagccgtccattctctcgtctttcagtaaattctctccctgaattaattatatactggttgtatctttgaaaaactggtctcctcccacactcctcctcaaaaaaaaaaaaaaaaacaacaccctatcgtcatgttgacgcggttccctcggaggccagctggtgggtccccggcagctctcctcgcagatgggcagcttcacgacgacgttgggggccagcgcggcgacctcctggcgtccttccccatgcccctcggtcggtggtctggcctgactcgcggctagacggggcaggccctcgcagacgcggcagatctcggccatgtggccactcggaagtcggcgagccgcccgccggtcctggcgtacagcgacgggttggtggtcacgcccgagagcacgccccagctcatggcctccctgatctcgtcgaggtcggcggtgtcgatgaagaacttcatgtgtccccctcttcctgttcactaatatccgtgcgacggggagaggaggggcaagcgtgaaccgcctctcctctcccctccctacgatgcctactcggcgagcgcgttcttgatgcgggtggtcacgccctcgaggttgaggccgaccacgtactggcgcagcgggcgcttgatgtgctcgacgacgaaccgctggccgtcgatgtcctgggcggcaaggttcttgtagagcttggcgacctgctccttgacctcggggtcattgaaggcgtagtggccggagatgtccaggatctgggacgagagctcgggatcctcgaggatgtcatcgacctggaggttgacgtcgtcaccggtcatccacttgcgccagcgctcggtcttgatcgccttgaccaggagggtgttatagaggtcggacgggtcgtcgcagaggccgttgtccacaagaagctgctcgaccttgcagagcttgaggtaggcgcgggtctcctcggtgccgtactgcggcgccacgttggaggcggtcacgtgcgcgggaatgtgctcgaggagcgtgacgtcgtccaggtagtcggcgttgtgctccttgaggccgacgccgtaccccttcgccatgtcggcgagctcgcgggcgttcttgtagttgtagtggccgacctgctcggttaggcgggtgagcgtaccggtctgaccgacgatgaaggtgggcatggggcagccgcgcctctccagctcgggcttgagcttggagatgaactcctcgtacttgtccgtggtggtgaggccaccgttggtctcctcggtgcccacctcgtatgcgacctcgggaaggttgtgctcgcggcggtactgctcgaggtagtcgatgaggtcgatggtgcggcgcaggacggtctcgagggggatgaccttgccaatctggtaggggtccttggtagggtcgaccatcaggaggtcaaagcctgcctccatgtcagccacgaaggagcggcgcgcgagctccatggcctcgtcctcgggcaggtgcgcgttgcgctcctcgtcgcgctgccagggaccgccgtggtcacggcagaggtagtacggaccggtgtagccaacctcgtcggcgaccttcttgatgtcagcggcgaagcggacctgatcccagccgttcacgtagccggcgccaaactcgtccttgtcgacctggttgcgcgaggcgatgaacatgagggggaagtcctcctccttggcgagctcgaaggccgcctggagcagattgggcgacatcggcccaatgcccacgagggtggcgtggtccccggtgtcctggagcttgagaagccccttcaccgcgtcatggataggaagctctgtgtacggcatttttctctccctttgttaggaaattcggcataagagaagccccacgcggtctcccggccacgtggggcgacccgattcgtagcaagcaatggatgcggttgttctcgcgcctttgcggtctacttgtcggaggtctctacttcttcgactcgagcttgggcttcattgcgaccaggatcgccgcagcgacgagcgagccaatgacgatgtcgaggcagtacaggccaatgttgttggttgccatggcgacgatgaagccaccgtgggggacgtagcactcgatgccctgggcagctgcgagggcagcgccgacggcagagccgatgcagattcccggaagcgtgtggccaaggtccttgaccgcgaagggaatggcgccctcggtaatgccgatgcagcccatgaagatcgcggagatgcccatctggcggtcggcgtcatcgaacttgttcttggcgatgaaggaggcgatgccacaggcgatggggggcacggcgacggcgacgcggaacatgccgttggggccatacacgccggcggtcatgagtgccatggtgaaggtggaggcagtcttgttgacggggccacccatgtcgaacgcggtcatgacaccgatgaccaggccgagaaccacggccgacccaccctgcaggctgcccagcacgctggtgagccagttcatgacgaggctcaggggataggcgagcacgtagatgtagaacaggccgaggacgagcgtggtgaggatggggatgatcaggatcggcatgatggtgcggatggtgtcgttgaccttccaggtcttcatccacttgacccagtagccggcgacgaccgccatgatcatcgcgccgaggaatcccgtcgagacgttggtgtcgcccacgggaacggggttgttgaccaggtatccaagaacgaagccaggtgccaggccaggcttgcccgcaagggagtaggcgatgtaggcggcaagcacgggaatcatcatgttgatgcccgccatgccgatgaggttcaggttctgcatgaaggggtcggtgacctccatgccgtttgccccggcctttccggaggcaagcgagaacgccaggaacacgccgccgatgacgacgacgggaatgaagtacgagacgccggtgttaaatgccttgagcaggtccttgccaaagttggagaacagccccttcttctttggagcgctcgcggttgtctctgccattacccatcactcctctctgtgattacagggcgatcagctcgtcgattaccttcttggcatccgcgatgacgtctgcggaaccgacggtgaggcacttgccctcgtcgcgcttctcgtcaaagcgctcgtccccctcgatccccacgtcaatggcgaggagcgcatagtccgcatccgcgatctcgtcctcgtccagctcgttgtcgattcccatgccgccctgcgtctcgaccttgtagtcgaatccacgacgggcgcactcctcctcgattgccttctgggccatgtacgtgtgggcaatccccaccgtgcaggcgcacacagctacgaccttcaccgctttctcccctctcgcattcgttcaaactttttctggagagcctttgatccgttggtggtgcgggcttctcctctttccttggaacccattattctcaggacgggatcaacttcaccctcatttcggcgaagtagcaggtagactaatatttttaacttggtttaaccaattttgttaagtagttaactaagaagatttcgtgatgtttcacggtcaattcgagttgtcaagaactatctcggtttttcggcaagttgcattcaccacacgccgatgtgccgccaggccaccctttgacatggacgtaccatgggggctggacggggaggagttgggcgaatgacgaagcgggtcaacatcacggacgtcgcgagactcgccggcgtctcgactgcaaccatctcgtactacctcaacgggcgctacgagaagatgagcgaagccacccgaaagagaatcgcgaagacgattgccgagacgggatacgtccccaacgcccaggcacgggtgcttggcaacaaggcgactggtgtcgtcgcggtcatcatctgcaacatcgccaacaactgggcgggcgaggtgctgcgcggaatggagtccgtcgcgacggagcacgggtaccagatcatcgtctgcgacacctcctttgacccaaagtcagaacgcctctgcgtcgagaagatgctctcgcttggggtggacggctttgtgatccagcccacgggtcaggtgcgcggcatcagggacaggctctcgaaggcggggaaacccgtggtgttctacgactacagcccgtttgacatgagcggtcactgggtgaagaccaacctgtacgacgccttctacaactccgtcacggagtgtgccgatcgaggctacgaggagttcgtcatccttgccgcggacgcctcgggtgcacgaacccggctcgaacgccttcagggaatcgaggatgccctctccgcgcagaaccttccctacagcgtcgtccccatctcgcacgaggccccaagcgtcgaggagctgtcccactactttcagtacaacctcaatcccgcacatcggaccctgctcgtctgcccccaccagtgggcgctcaacaggatctacgaggcgatgaaaccctgcatgcacctcgttccccagagaataggaatcctgggcatcgacaacgccagctggacgacgctcgtaacgcccagcatcacgaccatcaccgaacccgtgtgggaggagggtgccctggcgtttcagatgctggtctcgcagcttgagggcaaggcaggggtcccctcccagaaggtcatggagtgcaccacgcattggcttgggtcgaccctgtagcccccgattccgtttggccccctaggcgaccgtgccacccaacggattgggaaccatgtggacagcggaggctgctgaggaaatgcgagtgttggcaatccgcgggcgaatcccgctgaggaatgtcgagttctggcaatgaatgggcgtccgaggtccctctcgcaccgccaatactccgctttcctcggcgtcgaggcctcccaaattgccaatactcgatattcctcagcaggtggggaccagaatccctcccgaaggacattggggattgccacaactcgcattttctcagcacccatggggcaggcgtggcggaggggcggtagatctcggcgaggcgcacttgactgtgtagcggctatacggtggaacctagacgcaacgcatgcgacgacgatgggagagggcaatgggcatgagggttgggaccgtccgcgctggcgaggggccgtttgagctggaggctgcggtcgttgtgacgccgcacggcatcacggtcacggcgtgctcgccgcactacgcgcacctgggggcgacggcgcaggcgataccgcgcccggaggtcgaccgcacggcaacggtgagcatcctcgccgtcccctgccaccgcgacgagatccccgcccacgacatcgcggccaagctcgccacgcgctttcgcatgcccgttgccgcaagcacggggttccacgtggacggcgccaccgacgaggacctgcggacgtttctctcgaccacgaacaagctggtggagagaatcgcggactttgtgacccaagcccttcccgccgccagcgaggacgagctggtcgccgcccccgccaggccgcgggagtgatgcgggccgagcgcggctcgcggcacccggaaccgtcggcgacccgctacccccgcggcgggacgatgcagtcgtaccgcacggacttgcccccaatcgagtagctgggtctctcccccgccagccacggacccttggccgggcgcttgatcaccaccttgcggggatgcgcccccagcgcggcggagaggagcgtcgcctcgtcctcgcaggggctttcgaggcattggattagctgcagcttcttcttgaccgaggcgctcttgtggcgctcggggaacatcgggtcgaggaggaccacgtcgggcggggcgtcttgctccccgagcgcggtgacgctgtccccgtggtgcgggtgcatgcgcgagacgacatccgccagctccggcacgtcggcggcacggcgcagtccgtcggcgagcagctcgtacaccaccgggtcccgctcgtagagcgtgacctcaaagcccgccgccgccagcaggagcgagtcctcgcccagcccagccgtggcgtcgaacgccgtacgcggcccgtctcccttgaccctcgccgcgcgcaccagcagctcgtgggagaggttggagcgccgcagcctcgggagcatgcgcgtgaggtcggccgccagcgccatctccccacggcacaggcgcaagccgtcgggcgacaccacgagcgagaggcactcggagccggcgggtgcggcgtcgaccacgggggcgccgagcctctcccccagctcacgcgccctgcctgcaagggactggtcccccgcgcacacgacgagctcgccagccatccgtcctcccctcacgcggcccaagccgctatcgaagccagcccgctatgccccatacgccccgcgcagcgagtaccagccgtcgtgctcgtcgaccaccaggggcacgccgaagaggtcggacagcacctcgccgcgcagcatctgctccttgggaccgtccgcgtacacctgggagctgcggatgagaagcacgcgaccgatggcggggacgatgtcctcggggtagtgggtcaccaggatgatcgatactccctccgcggcaagcgtgctcatggcctcgcgcacgtggtacatgccctcgggatcgaggccggtgcacggctcgtcgaacacgaggaccttggggttgcgaaccagctctcgggcgatgaggacgcgacgcgcctggccggtggagagggtcttgatgtcctgctgcgccacccccgctatgcccaggcggtcgagagctgccagggcgagccggtagtcgcgctcggtgacctcgcgctgcatgggcaggccgagcgtgccgtacaggccgccgaccacgatgtcgacggaggggaggtgcacgcggatctggtcgtgcatggtggagctgacgattcccagcgtgcgacggatctcggccagctcgggacgctcctttcccctgaagcgcacgggcggctcgtcgcggtacaccgggaagacctcgcgcgtgagcagctggatgaaggtcgacttgcccgcgccgttgggaccaaggagggcaacgtgctcgccctctgccagagtgaagtcgtccacgtgcaggatggtcctgcccgacctcaccacgcttgcatcgtggatcctaaagagctctgcgcccggggcgcccgccgtctgtgccatgagaaactcccccgcctgcctgcgggacaagggcccgccttcacaattcgcgtttcatcccaaacgcgtgaagacctactataggcaaaatcgggtcgacagaatccactttgcgagagcccgaaacagtcgcaccatccgcatcacaaggtaaggggaacgtccatggcagacatgcttaccctcgaggcttttgaggaggcatcggagaaggtcagggaggtcacgctcgagaccaagctcgttgagagcccgtacctctccggcgtatctggcaaccgcgtgtggctcaagcccgagaacatgcagcgcaccggcgcatacaagctgcgcggcgcgtactacaagatctcgaagctgagccgcgaggatctggaccgcggcgtgatcaccgcgagcgcgggcaaccacgcccagggcgtcgcctacgccgccacgcacgccggcgcccgctccatcgtcgtgatgcccaccaccacgccgctcatcaaggttgagcgcaccaagggctacggcgccgaggtcatcctgtacggtgacgtgttcgacgacgccaagcagcgcgccgtggagctggccgagcaggagggctacacctacatcccgccgttcaacgacacgaccgtggcaaccggccagggcacgatcgccatggagatcgtgcaggagctcccgctggtcgacaccatcctggtccccgtgggcggcggcggcctggcctgcggcgtctccacgttcgccaagctgtacaaccccaagatccgcgtgatcggcgtggagcccaagggcgccgcaagcctcaccgccgccctcgaggcgggccatgtgaccaagctcccctccgccaacaccatcgccgacggcactgccgtcctcgaggtgggcgacaaggtcttcccctacctgcagcagaacctggacgacgtcatcaccatcgacgacgacgagctcgtggtctcgttcctcgacatggtcgagaaccacaagatgatcgtcgagaactccggcctgctgaccgtggcggccctgcaccacctgcccgccgagggcaagcgcgtggtcgcgatcctatccggcggcaacatggacgtgatcaccatgtccagcgtggtgcagcacggcctgatccagcgcgggaggatcttcaccgtctcggtgctgctgcccgaccgccccggcatgctcgttcgcgtcgccagcgtgatcgccgagcagaacggcaacgtcatcaagctggagcacaaccagttcgtctcgaccaaccgcaacgcggccgtcgagctgcgcaccaccatcgaggcatatggcgaggagcacaaggcccagatcgtcgaggccctgcgccaggcgggctttgccccgaccgtggtccagacctcgctgtagagtcatccgctaggtgagagatgcgggccaccgtggcgccgatggggcgtcccggtggcccgcctgctttttggcgaccacccggggtacgcacggagacgcgcagtcgttcgggggaacggagggtcgcctggctgccgcaaccgagggcccctcagtggtcagagagtggggcgggccgtccctcgcccgggtcagcaggcatcacgcgggcggcaggttcccgacgtccatctcttagagtccctctcccgtccgctggcagcaaactcccgatgtgagcactttcccgtggaggacctgggtcgcgggggccatacgcctaggcgttttcccaggtagggggattgggggaggcgaccgcgtccaacccctggcagctgattcccgatatgtgcactcacatcgggagtcggctgccaggcggctcacgttccgagtccgaatggcggcgaaagccggatgtgggcactcatttcgggagcttgctgccatggttgtgatgctggttgaaacccaactgggggaacgcgagtccagcccactcctcctggctgccggagtccgacgcaagcgctcacatcggaagacattcgccatccggagccgagaagggggctgttggcaagacccccgcgtgagcaccccccgatgcgcccgcaatggacctggccgcgtttgccaccgtgggcgatcctgcccctcttctatgagctctttacctgcacagatgttgtggcgatccgaactttcgtggctccccacgcggggagccccccggcggagaacggtgccgcgtcccctcgccccgggcggcttcgctctgaggccgcttcgtaaaggttgacgtgtttaggcggcgctaaacgcgtcaattcttatggaactccgagtctcgtaagattccacgcgtttagggcggccctaaacgcgtggaatcttacggagcccgggccctctgggcagcggcgcttcgggaccgatcgcggcgggcccctcctgcggaggttggctagcccctctcgacgtcagccgcccccttccattctttgatacttgaaagcccctctcggcaggcgcggaaggaggcgcccggccaccgacgggagaaacgcccgggcgaacgctcacgcaagccatccgggcggctgggagagctccgggctccgttctgcgtcccctctccctgccccttcttcgagttctgcagggggaaatcgggggcaaaccgagaggttgggccagacgcaatcgcggccaatgatcacgcccccaagcaacttccaaaacacctgaaaaacctaattgagctgcgacggtgaattaaccccgccgtaacagagaacggtttcgcaaggcgtagactcctccccacagttgagaacggcgatgacggggcgagtacgggccgcatccatcccacagaaagcggggggacctgagaacccgcggtggacggccaagaacattcccttgagccgctcggaagaaggtcgcagccggccatcgggcgatccccgatgcgcggagacggcagaaaccgggccggagcccaccgttacgggcatcggaggaaggcgcaagccaccccgtctcgcgattctcacgcaggggattgtgcagggaagcgggaagcgagaggtgaccatgcaacttcgaagcgatgccatcaagcggggcctggcccgagctcctcacaggagcctcctcaaggccgacggccttaccgacgaggaactggagaggccgctcgtcgcggtcgtctcgtcccagaacgaggtaatccccggccacattcacctggacaagatcgccgaggccgttaaggccggagtccgcatggcaggcggcaccccgctgcaggtcaacaccatcggcgtgtgcgacggcatcgccatgaaccacgagggcatgcgcttctcgctcaccagccgcgaggtcatcgccgactccgttgagtgcgccatccagggccaccagtttgacgccatggtcctgatccccagctgcgacaagatcgtccccggcatgctcatcgcggcgtgccgcctggacatccccactgtgctggtctccggcggccccatgctcgccggtcgcggccgccacggcgagcagaccgacctcaacagcctctttgacgccgcgggccaggtcacggcgggcaccatgaccgaggacgagatgcactggctcgagaacaccgcctgccccacgtgcggcagctgctcgggcatgttcaccgccaactccatctgctgcctggccgaggccctgggcatcgccctccccggcaacggcaccatccccgccgtgtactccgagcgcatccgcctggccaagcacgcgggcatgaaggtcatggagctgctggagaagggcatcaccgcccgccagatcatcgacgccagggccgtccgcaatggcatggcccttgaccaggcgtttggcggctccaccaacacgatgctgcacctcacggccatcgcgcacgcggcgggctgccccgtgaccatggacgactgggacaaggcctgctccgccacccccaacatcgtccgcctggcccccgccggcccgctccacatccaggacctcaacgacgtgggtggcgtctcggccatcatcggcgagctggggcgcaacggcctcctggacctctcggccaacacctgccacggcaccatggccgagtgggtggagcagtgcccgcccgtggacggcaaggtcgtccgcaccatcgacaacgcgtactctcccgacggcggcctcaaggtcatgcgcgggagcctcgcgcccgactgcggcgtggtcaagaagagcgccgtcgaccccagcatgtacacgcacaccggcccggcacgcgtgtttgactcggaggagagcgcctgcgacgccatctttggcggcaggatcaacccgggcgacgtcgtcgtgatccgctacgagggaccggccggcggcccgggcatgcgagagatgctcacccccacgtccgcgatctgcggcatgggcctggcaaagtccgttgccctgatcaccgacggccgcttctccggcgcaagcaagggcccgtgcgttggtcacgtgagccccgaggccgcagccggcggcccgatcgccctggtgcacgagggtgacgagatcgccatcgacatcgagggcggcacgctcgacctcctggtggacgaggacgagctcgagcgccgccgcgccgcgtgggagcctcccgcgcccaagtacaccaccggcgtcctctcccgttatgcaaagctcgtgaccagcgcagacaagggggcatacctctcatgacgcaagacgcgaacacgcttcaggacaagctcgcccgcaagcagaccgccctcgagggcaagccctttggtccgggcagccacaccgagcacgagggcaagaccatgaccggcgcgcaggcgatcatcgcctcgctcgaggccgagggcgtcgacacgatctttggctaccccggcggccaggcaatcaagatctacgacgcgctgtacgactccaagaagatccaccacgtgctggcgcgccacgagcagggtgccacgcacatggccgacggctacgcgcgcgccaccggcaaggttggtgtggtgctggtcaccagtggccccggtgccaccaacaccgtgaccggcatcatgaccgcctacatggactccgtccccctggtggtcatcaccggccaggtcacgcgcggcgtcatcggcaccgactcgttccaggagtccgacatcgtgggcatcaccatgcccatcgtgaagcactccttcctgctgcagtccacggccgacctcacgcgcaccttccgcgaggccttctacgtggcgtccaccggtcgccccggccccgtcctgatcgacgtcccgagcgacatctccggcgagcagatggtgttccactaccccgactccatctcgatccccagctacaagcccacgtaccgcggcaacgccaagcaggtcaagcaggcggcggccctcatcaccaaggccaagcgccccctcctctacgcgggcggcggcatcgtgatcagccacgcctgccaggagctggtggagcttgccgagcgcatgcagatccccgtggtcacgtcgctcatgggcaagggcgccatgccctgctccaacccgctcaacctgggccccgtgggtatgcacggctccaagtacgccaacatggccgtgacggagtgcgacctcctcatcgccgtgggcgcgcgcttctccgaccgcgtgaccggcaaggtctcggagtttgccccgcacgccaaggtcatccacatcgacatcgacccggccgagattggcaagatcatcaaccccgtggtccccatcgtgggtgacgcgcgcgtggtgctggcctccatcaacgagcgccttgccaagcaggacgccaagcccaacgacgagcagtgggtgaaggacgtgttctcgtggcgcgagcgctggccgttctacaccagcgactttgccgactatcccgacaagatcgcgcccgaggtcgtgctctccaagctctccgacaagcttgactccgaggcctccatcgtcaccaccgaggtgggccagcaccagatgtgggcccaccagaacatccgccgcgagcacgcgcgcacgttcctctcgtccggcggggcgggcaccatgggctttggcttccctgcggcgatcggcgccaagatcggctgccccgacgacgaggtcgtgtgcgttgcgggcgacggctcgctgcagatgaacatccaggagatggccaccgcgcgcgccgagaacgtgcccgtgaaggtcctgctcatcgacaaccgcacgctgggcatggtgtaccagtggcagtcgctgttctacaacaagcgcttctcgttcacgcagctacccgccaacgacccggactttgtgaagctcgccgaggcctatggctggcaggcagcccgcatctctcgccccgaggaggtcgacgccgccctggaccagatgctcgcctcggaccagccctacctgctggacgtggtcatccccaaggaccagacggtgtaccccatggtcgcccccggcgcccccatcgacgacataatcggcgccctggacgtgacgcttggcggcgtgcgcgtgacggagaagggctttggcgacggcaagaagcccaagtcgctggaggacgtgttggacgaagaggagagggagggtgacgagtgatgaagcacatcctgtctgtgctcgtcgagaacaagcccggcgtgctgtcccgcgtgacgggcatgatctcgaggcgtggcttcaacattgggtcgctcaccgtcgcccccaccgaggacgagaccctctcgcgcatgaccatcatcgtggaggcggacgaggtcggctttgagcagatcaccaagcagctgcacaagctcgtctccgtgttcaagatctcggacctgaccgaggacgacgccatcgagcgcgagctcgtgctgttcaaggtccagtgctcgcccgagcgccgccacgagatcatcgagattgccacggtcttccgcgccaacatcgtggacgtgggcaagaacacgctcaccgtcgaggcgaccggcaccgagagcaagctcgacgccatggaggacctgttccgcgcctacggcatccgccagctcacgcgcaccggcaagatcgcgatgtcgcgcgggcacgaccagtaggtcagcaccaccgtgcggggaacgccatggaagacgctcccaggcgagacccgcacgcatctctcacccggctctccccgcccccgggcggtgaaggcatagttgttctgcaacaggcacgaaagaaaggaagcaccagcatggccgttaccatctactacgagaaggactgcgacccctcgatcatccaggggaagaaggtcgccatcatcgggtacggctcccagggtcacgctcacgcacagaacctcagggactccggcgtcgacgtgcgcgttggtctgcgcgagggctccaagtctgccgagaaggcccgcgaggccggcctgaaggtcaccgacatggcgaccgcggccaaggaggccgacgtcatcatgatcctgacgccggacgagacccagcccgccgtctacaaggagttcatcgagcccaacctggagcccggcaacaccctggccttcgcacacggcttcaacatccactacggctacatcaaggctcccgaaggcgtcaacgtgatcatggtcgcccccaagggcccgggccacatcgtccgtcgccagtacaccgagggctccggcgtgcctgacctggtctgcgtgcagaccgacgccaccggcgacgccatggacctggccatgtcctacgcgtggggcctgggcggcgcccgcgccggcctcatcaaggcgacctttgccgaggagaccgaggaggacctctttggtgagcaggcagtcctctgcggcggcctcgtcgagctggtcaaggccggcttcgagaccctgaccgaggctggctaccccgaggagctcgcctactttgagtgctaccacgagatgaagatgattgtggacctgatgtacgagagcggcatccacttcatgaactactccatctccaacaccgccgagtacggcgagtactacgccggccccatggtcatcaacgacaagtcccgcgaggccatgaagaccatcctcaagcgcatccaggacggctcctttgcccaggagtttgtggacgactgcaacaacggccacaagaagctcctcgagcagcgcgagaagatcaacaaccaccccatcgagaccaccggcgcgcgcgtgcgctccatgttctcctggctcaagaaggacgaggactagtcttagcccctgtctgcgcgacgagcgcgaagggtcgacccagcaatgggccggcccttttcttgtgcgggtcgtgcgggaggcggggttggggttgagacgaacgatgcccttgagtgagcgggttgggcgtggggttgcctgcgaagtgccgccggctgccagagggacgactgaaggccacggggcggcacttctcccccgctagggcagtctcgtaagatttgacgcgtttaggggagtctaaacgcgtcattccttactggacgtcgaatctcataaaactttgcgcgtttaggagggcctaaccgcgtcaagtcttacgacgtggtgagaggggcgccgcctccggccatcgacgcccgggcccatgggagcccgggtccgtcgcgcgccgggcccgctggggctacctccggccgcccgcaccgagaccgtccccggggccagcgacgcccgggccatgggccccgttcccgcgcgccgggcgaaccgcggccgtcaggcccatcgtggccgcctcgtggaccgcgcgccgtgactcgggacccagcctggcgcgccgccgcgtcatccggcgctcggcggggcgcgcgtcgccccattggcataagctggaatgccggggagaggggcctcgatcaaggggcacggaccctctcccctggcagcaaggatcagcggggagtcccgacgaccaaagtggcacttgccgcgtcgggtgccttgcgtgggggcggtggcagacggggaggctcgatgaccggcaagacccacatagccgttggggcggcatccgccctggcgctcgcccacgctgggctcgcggaccccgccccggcgctggcatgcctggccgcaggggccgtgggtggcctgctgcccgatgcggacgttgcctcgagcgaggcgtcacgacagctcaggcgcgcgtgggcgctccttgccgtggtggttgcggccgccgcggtggcggacggggccctggggtttgcccttctcccccacctggccctggccatcgcctcgctggggatgccccaggttgccggcatcgccatcctcgtggcagtgtgcgcgtgcggaagggcgtcgggtcacaggggcttctcgcactccctggttgcccttgccgcctcgtatgccgccgtgcgtctggcgctgccgacggtagccgacgccgtcgcggtgggctatgcctcgcacctggcgctggatctcctgaacaagaagccggagcgcctgctctggcccatggcgagcggacagcgactgggcctcttcaagtcgggtgggctggcggatgcgctgctctttgtggcgggaataggcgccgcggcgctcctgcttgcgggcctgcgttagcaatgcaataacttccgggtcgcacgtcggcggatggcattcgcatcacagccggccacgaaagccagccggcccttggtgcgcccggagcgcgcagggccaccgtcctgctcgccgtcgcggggggtcagccggtccttcgtgcctgagcctatcctcggcacaagtccggagagccgaaaggccgatgttcggcgcaccaagggagcgcctcccgcgcgtgcgcgcatcctcgttgagcgtcgcgatgtcacgcacgcaggggagcgccccggaccccatccgagacgccccccaacggaacgtgcctcatgcgagagggaccttacgcctctcccccatcgctgccgcggcggcgcagcaccacgccgacggcgatcgccgcgagcgcgacgaggcccatacccatccaggcaccggacgagacgtcactcgtctgtggcagccggagcgacgagacgacggagctgacgccgctcttgggcgtggcctttgtcgtggccttgcccgtggtggtacctggcgtgtcgcccgctggcttgggctgcgacgggtcatcgtaggcgttggagaaggcgcagccctccgacttgaggccctgggagtcctccacgaccaccgtggtcctgatcgcctgggtggcgtcgtcccacatggcgtagacgcgcacgtcgtacacctgcgtgtcgtacgtccagccggcttcgccgcccgagacttgcgtaaccgtgtaggcgtgcaggccgaccccgtcgagggtgaggtcgaagtaggcggtcccctcgcccgtgacgctcacggtcgactgtgccggggcgaggtcctcgtcctccgtctggctcatgacgaaggtgaaggtctgcgcggatgccggctggtctcccgtgacgtcgaccgagacgggcaccctcacgttgacctgggtcccctcggcgagggccgccgacggcatggcgaacgtcaggatgcagagcagggagagggcggacccgatcgccgccaggaccctcccggcgacaccgccccgtcccgcatgtgcatgtggtgcttgcttgaacatgtctgacttccctcttccgtactctggtcggcggccccaaggccgccccgctacgcgttgtctgcctgctggcgacccgtgaccttgcagatgacgacgatcctctcgttggcgccaccggaggagcacgtggacagcgcgacgagctggtcactctcccccaggctcccctccctcaggtggatcgcctccgcctccagcctgtggatgacctgcggcaccctcgtggagtccgccggcgtggagaacagcacaccatcgtaggcatcggccttgatcaccgcgcacacctggaggccgagcgtctcgctgggaaggtacagggtggcgtcctggttggcgttgaagaagctctcgtccaagaacctgtccaggtcgccgaacatcttgcccgcctgcatgtggtgcccgtagaggacctcgtacgtctccccaaagtttggatcgcactcggagtcgaggaagatgctccccgacgcgctgtcgtcccccttggcgtccttgtccaggtactcgaagttgtcctccccctgcaccaccggatagtcgatcccggtgttgtcaacggtgagccacgccacgacgtcggggttgagcttcctcaggtccgcgaagccaaggcccggctcgtactgggagtagtccgttccccgcaggacctggttggcatcccacagggcgtagcccgccagcgccgccatgaggaggagggcgaccgcgatgacccaggtgaccacgtggtcgaccgcgcgggccgcccgctgcgagggtgcgggcgacccgttgcggccgtagtcgccaaagctgtcagcgaccgaagtcatgcccgctagaagtcctcgccggagctgcggcgacgacgcgagatcacgagggtggcaccgccgacggcggcaacgatgcccacggtgacgaagggcagggtgttcatggtgatgccggtgtcaggggcaaagcccttctcgttcttgaaggcgacgttgttggtggcggcgatggtgcccgaggcgacatgaccatcggtggaggcgacgtcgttgaccgtgttggtctcgtcgtactcggtgtcggactcggtcacggtatacgtggcgcccttgggaaggttcttgatctcgatggtctggccgtgcttgagcgtgaaggtctggccgctggagatctcgcccgtggagacggacgtgctgccgctcttgatctcgtaggcgtagttgcccttgacgccctcgagatcgagggtgtacgtgaaggtgtcagccgtgttggcggcagtgccggcgacggtcttggagatgttcagcgactcgttctcggactcggtgttctcgaacgtggcggtgtcgccgaccttggtgccatcggagtcgtagaccttgatggagcggatgacggtctgcttgccggcagggtagtcgtcgggcatggagacgttcaccttgaccgtgtactcggtgccgctataggtgatgttggggttggagccggcgatctccttgaccgtgaaggtgtagatgcccgggttgtagaagttggtgtcgccaaagagctgacgggcggtcaggctcgcggaggcagacgtgccgccgtccgccagggtcgcccagtccgcggtgaggtccaccgtcctggtctggaagttgagggtcgcgacgtcccaggagcccacctgctccgcgccgtcgtaggagatctggaaggtgaacgtctcgtcgttgttgagctgcgagttggacgcgacgtcccactgcttggtcacgagggtctggtcgcccacgtacgtggggttgttcgcgaccgcaagtgcggagacgggcgcgattgccatggttcccgcgaagactgcggcggccgcgatgcccttgaggttggtcttggtgagtttcatgtcatgtcccttctcttgtctgatgcaggtctgctcatatcccacgaagcctgaggagcgcgaccaccttgccctcgacctcgttgatgccaataggtccgtacgtgcgggagtcctgtgccgactcccttccatccgccaggacgaagtactcgccctctcccagcgtcagcgggtacgagacgccatccgactgcggcaacgtcttgaggccgtgctccgcaggctgcgtagccccgttgatcttgagctcgccatcccgcgtcacctccaccgtgtctcccggctgcgcggtcacgcgccccacggtctgcccaccatccgcctggtagaccaccacgtcgtctgcctgcaggccctgaacgaccctgctcgtgagggccaggtcgccgtcccccgcggtgggctccatgccgcctcccgtgatgcggaagagcccgaggacccaggtgaagagaacccagatcgcgagtgcgaagaccaggagctttgcgatggcgcccgcgagggtcgacctcgcgtcccgtcgcgccctcctcctggcgatggccttcgccgtcgaggcgagggcgacgctctccccgaactcccgcagccaggggtcgccccgttcccttgcgaccatggctactccccaccctgcgagccacgtgcctctcgctccgctcgctcgagcagggcctggtaccgaacctcctgctctcggtacagctgccggtacatctggtccagccgctcgatcacgtgccatacctgccgctcgtcgacccccatgggcctgtgccgccatttgagtctctggagcttggacgcgatcagctccagcgatacctcctggtcccccgtggcgttggccgatgcggagacgccttgccccttggagggctcgggggagtcagagtccctcttcctcatctcggcacctcctctgcaccgtcccgactgccagtgccgctccgcccatgaccgaggtggcgagaaggccgaccatcggggccgcattgacggtcacccctgtgtcggggacggcctgggccgcgttgttgacctggaccgtagtcgtcttgccctcggcgattgccgcctgcacctggtcagttgaggtcgaggtgctgccctcggacttgatcgtggtctcggtaccaccgttgacgcacgcagtcgcggacgtctttgcctggacccgaaggttgacctcgcggacgaggaccgtgacgtccgcgggaaggtcctggagcgtgacgctctggccgtgcctgagcgtgagggtggcgatgccggcaccattgaacgagacgccggaatacgacttgttggcaaggtcggcgcacgagagctcgaaggtgaaggtgtcgttcacgttggccgcgctgccgctcacggtcttggagatggtgagattgccgagctctggcacgtagcggccgtagtagatggtgttcgcggtgatggagccggcgaacgtggccttggtggtgcaggactcgtcggtgtaccagccgtcgaagcggtacgtcacgccgtccctgacgatcgtctccttgaactcgtccggcgtgttgtacgagggcttggtcaggctggactcggccgttccgtgctcaacgcgcttggcatactcgcccagggaggagaagtccgtctcgcccggatacctgacggcaaactgcacggtgtagaagttcttctcgttgaggacgatggcgtggtcgatgtggtaggtgtgcgtgctgtacgccaccacggggttgtactggttgttgccggcgttggcgccattggccacgcgggtgcgcatgtgcgagatggtgtagtacccctgcttgctggcgttggcgcttcccgcctcggcatacttgtacgtgacgccgttccaggtgaggtcggggaacagggtgtagccgttccacgccgtgtggctgatggtgcccgttccggtgatgtcggtgccaaccgagaggctggccgggtttgtgacgcccgagatggtgctgacgcccaggccaaaccaggtgccgtcgggattctcgtaggcctcgctatccgcaccggggatgagggcataccagtagagctggtacgttccgcttgccgggcgggcggcgacggaggcggtgaccacgttggtcgtgagcatcaggtcctgcgaggtggtctcgtccgtcgtctggtcggtcgtctcgcccgtttcctccgtgggcgcctcttgcgagggggcttccgtggactgggcctcgcccgactgtccggcgctggtggcgtcctgagtggcctggcccgtggttgcgccgtcttcggtcgaggcgctcggggcgtcgttgcccaaggtcgtctcctcggccgcctcctccaaggtcggctccgcgacctcttcggtagtgatggcaacggttgcttccggcgcctgctccgcaacgacccccatagtcgcaatcgcctcgccctcgtcggcaaacacgcgcgcgtcgggtacagccatgccaatgacgactgcggcggcaacgattgctgtaagaacgaacctctttgatagcctcggtttcctcatcgcaacgagccccttacctgttcgccacgtcggttcctgccaggcaaccgggtccgcaagtccatgtgctcgagacgcatcggctgcttgatgagaacttacctgcgatgggagggggtacatcgacgagaagtgtcacagacatctgttggtttgcataacaatacgatttatattctgtgttatgcatatagtccttttgttatgtgacaagacagggttagtggagcttacaggaaagccacaggtaggtagcacgaacccatggtcctgattcttgccgcgcgtatgctggattcaagccccaacacctgtcgttactaatagtgtgttttgtaccggggcatatgtttccctttgaccgcacacaaatctgagggtttgagacccaaaagggaggttccccgtcacccaacgggtagtgcgcatagacgtggtgtaagagctggcggggagcggggcctcgtgcccccgacccgacagcttgtggccaagggcagatgagggacatcgcctacaatccgtcgttgcttcaggtaacgatgaaggaagacgatgtccctcgattgagagtgtaatgccgatggcctccgaggaggccctaacacttccagcggctctggaacgagtgcgacgacgcccgcgagttcgcatgcagggtcctgtcgctggtcagaacggctggtgatggacgagcaggcccagctcgcctgcggggcggccaggggcgagcgcacgccggcccgcaccacagcccaggaacggctacaggccgcgcaccctagtaccgccacgggggacgtcgagctgagaatccccaagctgagggagggctcctacttccccgagaatgctcacccgctggtcgaggtggacgtttcggtggccgcgctcgttcaggagatgtagctctgggggtctcgaccaggaaggtggagagggtgccgagaagctcggcatctcctccctgtcgagctctgaggtctcgaggctgtgccaggagctggacctcgagtggaggccctgagagccgcgacctctcccgatgccctgctgctacctctggctggacgccacctacatgagctgcagggagactccgtcgtctcctcccacgccgtggtgacggccatcggctgggcggcggacgggcgcaagcacgtcctgggcgtcgaggccatggacaccgagagcgagtgagggtggaacggcttcctggcgggcctcaaggcgcggggactcgcgggcgtcaggctcgtcatctccgacgcccaggtggctcttggcggccatagcgcgccagctgcagggatgcgcctggcagcgctgcatcacccacctgcagaggaacctcctgtccgcccatgcggggaggcccgaggcctccaaggggtgcgtgacgaggctgtgcacgcgcctgctacgagagggacccgagctctccagggccatctgggaggaggccgagccctgggtcaggagggcctccccccaaggccgcgagatcttctccgcggccgaggactcggccctcgccttccaggcgttccccgaggcccactgggcgaagctcagcaggaccacaacgtcctccgtatatccgaaaggcccgtgggcgaacgagccgttcgtccctggtctatggttcgttccgcgcggcgtggtgaccccacaattgattgacgatcccgtccgggggctgtcctcctcgtgatatgtcccgcccgtcgccggcgtgccccgcgctgccgtgaccctgatagaaagcctggcgcggctggctcgtgcggaggcggccccacccatcggagccgcctgtccggctgccgcggggcatgttcggaatcatcaagcccggtgtgccgaagacggattggactgatggcatggaggtcagattgggaacgggtcgtcccccgggacgccgtgtgggccggagtcgaacacgcacgccgaaacgaactggctgagcgttgtcgaccgcctcgtgccgcagctcttctccggcgagttccccaccggctgcggaggatacgcgaggctcatcgcgagcgcaaccagcggagctcgggacgctcagtggcggccggccgtccgagttgcactgcaccttcgtggcggggctcgcgaggagatgcctccgacgggctccgctgctacgaggtcgtggtcccgactgagagccgcagaggtcgccccggcaaaggcagacgcggcggcgacgcgccagggccgccgagcgtgccttcgggccgatgacctgtcggttcctagcccaggacggctgggtcgaggatgttgagggccctctacgtcgccccagggagggcctcgtgagtctgtgcacttcgctcgccaacatcgccctggcgaacgtgaggaaggcccggcgacctgagggcccgctgagccgctcgtggagacccgtgcatcacgctcgcggtgccgtgcttggtggtacgattgctcggcctccccttcgtcgagatggcgcgccatggtccgcgctcagggctctggggaacggcctgggtcgcagcgctcgtcccccggacctcgaaggggcgatcgccgacgggcgtgtaagcccgtcagaaaagggaaaccccgcgctcgccgcgatgtacgggtggcggcgcgcttctcggccgcggcgctcgcgatgccgcccggcgacaacgcccagggagatgggtcctgcggagcctcgttcgccgcctctgcgtgcgcacgcctatagaggctccagcggcaggtcggcgccatcggctcaaccgcggcggcgacaggcgggcgaacagggccctgcctgtgatcgcgattcacagatggcgcaccgaccccagaccatcgcctacgtggagaggcgaagggccgaggggcgtctccgaccgagagatacgcccgctgcctcaacgctacatcgcgcgtgtcgtaccggctcctgagaaatccctaggaacgtgcccgccgagggaacggccccggctgagggagccaggatcggcgcgggcgtctcgcagaaggacgcggcgaaggcgctgggggtccacggtcctcgaccctctgcgaacctcgacttggccaccaccatgtttagaagacctcggcgctccgttacgaaagtgggtgacgatggcttcccattgatgcgtaagaacccccgacggcgtgcttgacaccatagagcatcaggagaggcgaaccgggtagctcacgcgctaacagggtcgtgcagtcctttccccggtcgatcgatggttcgccgtgagcgtgggccaccatctcctcgtcaggaggggcggcgggtccacccagcgcgtcttcagcatagagtccccgccgccccctcggctgcagggacccccggacccaggaggccccctcgaggggtgagggagggggcactcgaaggagggcccgcaacagctagtctcccggagatagccgagagctgcggacctccagaaggagtaggattctggcagcgtccggcagcagtgattgtgccttcttacccacacgtcgtgcgcgcgatccttgccgcacggggtttctggacgtgtcgcgccccccggggcttggcgctgaggtgtccgagttgtgcggaaaattgccctataccgattgccacaactcgcattttctcagcacccacctgagagggacccctggatgcccgcttagctttcccggggcccgacggacgggcggggacccctgcttaacgttccccggggcccgggcggattcttgcctcgatgcttatatcgccggggccacactggcaggggaggcgaacccgtccgcgccctcggaatcctaagcggggccctcccaatccccgcgagccccggggggccaggcgccggagccccgtccacccaatgggacgggggaaaccccccccatacagtcagagctggcccccgagggatcctccaagccgtagggtttttcacaatgctatttccttgatttccctaaccttgcagatggcccctctccggggccgctggccgaccgcccccggacggccctctgacccctgcctctcccagaaggcccggggggttgtgccgccgggggatggtgccctgaagggaacctgataggatgtgccgcacggcgtgccgcgcggcagggtaatgtgggtgttcgcccgaacgggacgggtggccagccgcctatgaggagttaccaccatgaagcgcatgcaggaagactggttcggcccccaacgagctgtacctcggcttgagtcgggaagtccttccactgggccgtcggactcaaccgggatggcgagaccgatcagccgccgcgtggagaaccgcccggacgacgtcgacgcgctgctcaggaggcggtggcgacccctgttcttcgtggaccagagaacacatcggctccccgtcgtgcgcaggtgccgggcgaagggggtcgacgtcggctacctgccggaaagtcgatagagcgcgagggacatgcttcccgggacggccaagaacgaccggatcgagcgcgatggtcatcgcccaggccgggatgagcccatcaggagcgctggtgtagctggaaggcaacccatcggcggacacggacggtcctgcggcgcatccatgtcgctgtcctccactcgcagctcgcatcgccacggatgcgggccaccatggccaggaacaggtgctgcatgccgtgctcctcgagtcagacacccccttcgaggctgcgcggcgcgccgctctccgccgcatggacgctggcgcgatgagcgccaccttctgagggcgccgccgtgcatcgcggcggccgcaggaggagctacgggcggcgtgcgcgagaggcggggccacagggggaggccagggacgcgctctggatctcggcgtgcgcctcggcggggtcggtgccgccatccggggagcgaggacctggtggtgagggagctcgcggacgagatcgccacggccgacgcggagcgctccgagctctccgccgagcttgagggcatctttccgaggacgagacctaccggtgcctgctcacgttgccgggcgtcggccccaagaccgccgccgccctcgtgacctcgatatacatcagcctcttcccgggcgacgggagcttgcggcatactgcgggctggcaccgaaggacagcgactcgggcacctgctgagttcgacgacgagcacccacgcgggaacaaggccctgaagaacctgctcaattcagctgcaactcgctcgtgggcaccaagaacaggttcggaaggtactaacgagaggtgcgtcgagaggggcataggcacaacaatgcgctcaggcattcgcgaggaagaggctgagggtgatctatgccatcatgcgggacagggtgccctacgtcgagccgtcggcagccgcagatgtcgaaaagcccccatctgctgcttgacaaaactatagggacaccccccaagcacaaaacggccccgacccgccgggttgccgacgaatcggggccattccccgaggaggctgcttgttgcgaggaggctactccgaggcacccgccttcgacttgccgaagcggtccttgagctttggccccatgatctggatgaggatgacgaggatcaggatgacgcccttgatggtgtcgttgatgagggagtccatcttgagggcgatgatcaccttgtcgatcaccgtgtaggacatggcgccaaacagcacgcccagcagcttgccgcgaccgccgctcatcgagatgccgcccagcaccacggccgcgatggcgtacatctcgtagctcttgcccgttgtcgcggggtccgagctcgcgttcatggcgatccagaggaaggcggccagcccgatgagggcgccggcgatcacgaacaccagggtcctcatgaggggcacggagatgccggcaagtcgcgcggcgcgggcgttggaccccactgcgtagaccttcttgccaaacttggtggaggtcagcaggtacacgaagacgatgatgaccagcagcaggatgagtcccacgatgggcatgcccccagggagacgaccattgccaaactggtagatggcctggtagctgggcagcgtgctggacatgcggtagacggagctgccgttgccgatgagctcggagggcagatgctggcactcgtactgcgagagcgagcggaagatgagcatcgtcgcgagcgtgacgatgaacgacggcatctcgaccacgcccaccaggacgccgttgagaagcccgcagagcgcgccgaggcagagggcaaacaacagggtgagggggatggacccctgagtctggttgaacaccacgaccgagaagcccgccacgaacgcgagcatggagccgaccgagagatcgatgtcacccgtgaggcagatgaggcccatgcccacggcgatgatgccgatgaccgcactgtggcggaagatgttcatggtcgcgccaacggtgagtccgccgctcaccaccgcgtagacgatgtagattgccagaaacacgaggacgaagctgtaccgcttgagcgcccccagcagggagcctcccgaccgggccttgccctcttccatggttttcactgccatcccaacgcaccaacccttcttatctcgcgctatgccgtggcaagcgagttcgtggaatagagcatgaccgtccgttcgtcgatctggtcatggggcagggccttgacgacctcgccctcgtagaacacgtagcaggtgtccgcgacctccttgagctcggggatctcgagcgtgttgatgaggcccgtcttacccgcctcggcgaggccgaggatcaggcgatagatctcggccttggcgccgacgtcgattccctgggtggggttgtcgaggagaaggacgctcgcgtcggtgttgagccacctggcgatgaagaccttctgctggttgccacccgagagggagttgatgtttgcatccggggagggggccttgatgcccaggagcctcttgtagtgatcgaacctctccacctcgcggctgcgcgagatgggcagcgacttggcggagagcacctgctcggagaggcacatgttctcgagcagcgacatgtcagggaccaccgagttctccttgcggtccgcaggcagcatggcgacgccggccctcatggcctcgtggatggagccgccatgcagcttggtgccagaaatgctcgcgacgccacccgtcgggcgcatgacgccaaagagcgtctgcatgagctcgctgctgccgcagcccttgaggcccgtgaggccgatgacctcgcccctcctgaccgagaggtcgacgttgcggaagccattgccggagtacccctcaaggcgaagcacctcgtcgcccagctcgcggggctgccacgagccgcgctgctccatggacgcacccaccatgaggctggtagcctcggccggggtggtgtccgcgattctcccgctcttgatgaagctgccgttgcgcaggatggtgtaggagtcgcagagttcgaagatctcgggcatcttgtgcgagatgaagatgaacgacgttccgcccttgcggagcccccgcacgatcgagaacaggtgctcgacctcctcggtgttgagggccgtcgtgggctcgtcgaggatgaggagccgtgcgttgcggaagagcgcgcgggagatctcgagaagctgcttctcgctgggcttgaggtcgtccaccaaggcgcaggggtcgatgtccaccccgagcctggtgaagaggtcgtgcgcctgcgagatcatcttccccttgtccagggagccaaaccggttggtgagctcctgtcccaggaagatgttctcgtacgccaggaggtcgttgaacaggttgagctcctggtggacgaacgcgattcccgcatcctcgacctgcttgatcgaggcgttggtgatgtcgttgccggcaaaggtgatggtccccgagtcacacgcgtaggcgccggtgaggatgttcatgagggtcgacttgccggcgccgttctcgccaagcagcgcatgcacctcgccctcctgcacgctcaggctcaccccgcgcaggacgggcactccagaaaatgacttgtggatgtccctcatcccaagaagttccatgggttctcctcccatccgcattcgtgcgcacgtgggacccaccccctacgggcaggccccacgtcttcacggggttgcgcacgaccccgatacgctcgttacttgaaggactggaacttgtccacgttgtccttggtcacgttctcgcacttgatgacgtggtcctgggtgacctgcttgccatcgagatggtcgatgaggtcctggatggccgtctggatcatggacggcgagtaggtgaccgacatgaccccgcccaggttcttgacgatgtcctggtaggagttgccgcggatgacctcgtagtactcgtcgaggccgccgcagccggtgatgtacggcttggtggcgaagatcttctccttggtggcgtcggagatgccgccgccgttgagcgcctcgaggatacccatggcaagctcgtcgtcctcggcgtagaaccacttgatgtccgcgttggagtcgtcgctcatgagcgactcgaaggccgccttggtgtcggagcggctccagttcatggcgccggacttgctgatggaggcggtgtcggagtcggaccacttggaggcgtcgtcgatcttcttgccgtcgaactcgagcttgccggtgacgaactcggtgaagcccttgtcacgcagcgtggtgacggaggaggtgtcgccctcgtacacgtagaccttgtcccccggcttcatgccgttgtcgacgaagtacgaggcggagccggcgccaatgccctcgttgtcgcccttcacgttggagacggcggtgctggcgacggcctcgatgatgcggtcgaacgcgacgtacgggatgcccgcgtccacgatggactggatggcggactgcaacgtgtcgtccatgggctggatcacgatgccggcaatctggctggtgtcgcccgccaggatgtcctcgacctcgctgatctgcttggaggcagagtcggcggtctggagctcggcggtgtacttcccctccttgttgacctcggcgatcttctcctttgcgaaggttgcgaccgagccggtccagccgtggtcctcggagggcgtgaggacgtagatcttcttgccgctaccggacgcgctggaggagtcggacgagtccgacgtgccggcgttcgacgcaccacagcccgcgaggaaggcggtgaggacggccccgcccgtaccggcgatgaaggcgcgacggctgatgttgtggttcttggtcatgatgagtctccctttctcccctaaatcacgaactgacgcatgtacctgtacgagagcgccacgctcttcaccacgcgctccctgctgccctcgaacgcgtggtcctcgacctcaatgcaggcgtccccgtcaaacccaacctcggtgagcgccgagacgaaggcgccccagtcgacgtctcccaacccgcagagctttggcaccatgtagtccagcggataggccatggtcccgcaggctgcgagcttgtcgggcaaaagcttgatgtccttgaagtggacgtggaagatcttgtcgccaaagtcgtagacggcacgggaaatgtccatctgctgccacacgaagtggctggggtcgaaggccaggcccaggttgtcgctgggcaggagctcgaacaccctcttccagttggccggagaggtcatgatgttctgaccgccgggccagttggaggcatcaaagagcatggggcagttctcgatggcgacgaggacgccctcctcctccgcgaccgccaggatggggttccagacctccgggacctccgcgaggttctcctccaccgtcttgtcggtcacgcgaccgatgaaactggtgaccttggggaccccgagcttcgccgccgcgcggatgaccgcgatgaggtgggcggagaagcgggcgcgacgttcggggtcggggtccatcatgttggggtagtacgcgagcacggagagtgccacgcccctctcgtccgcgtagtccctgacgtggcgcgcgtaggcgtcgtcggagagcacccgctccgcgtccacgtgggagacgcccgcgtacttgcgctccgccttgccctgcggccacgcggccgcctcgacgcactcgtatccctggcgcgccagctcgtcgatcatctcctcgtaggtccagtcggagaggatcgcgcttaccaatccaagcttcatgtgcctatccctccaaggtcgagacggtcttgcccgtcttgctcgactcgatgctcgcgaagaccgcacgcatggcagagagcacgctcgcgccagggaccggcggctccacgtcccgctcgatgcagtcgacgaacgcgtcgatgacgccggacttcgtctggttgtcgttggtctggatggcctcgacgtcgtagcactcgcgctcgccgttcctcaggtccacgacgatggaatgtgcggggtcgctgtagatgcgcatgacgccatcggtgccgtataggacggtggagttgtcctctccgccgtagtaggtccagcttgcggtcatggtcccgaccgtgccgtccgcaagggtgtagatgcagaccgcgttgtcgtccacgccgacgaggttgccctcaggatcccgtttgtccagggtcgtcaccttggcggtggtggagacgacctcccggcccaggagccactggatgaggtcggtcttgtgcacgcccaggtcggccatcgcgcccatggcggcgcgcttggggtcgaagaaccagctgccggtcccggggtcgacgctccaggtctcgggcccgccgtggccgaaggtggtcttgaaggtgaggacgcggccgatcttgcctgcgtccaggagttccttcgcgcgctggtgggcgcgcgcgaagcgctggttctggtcaatcatcagcttcttgccgctcgcgttggcggtgtcgaccatgcggacgcactcctcgagcgagattgccatgggcttctcgcacaggacgtgcttgcccgcctggagcgccctgaccgagacgtcggcgtgcgtggcgttggaggtgcacacgctcacggcgtcgatgtcgggcgaggcaaggaggtcgtccaggttgtcgaaggcgacgcacctgtagcgctcggcaagctccgctgcgcgctgggcgttgttgtcatacaggccaacgatcctcgcgtctgggtttccctcgtattccgggagatggcgcacctgggcgatctttccgcagccgactatccccacaccaaccatcaagaaccccctctgcagtcgagacgaacccgttgggacacaagcggcagccgcgcgatgccaaagggctcggcatggtgccgttgtgaaaacttttctctcgattactgaatcgctttcattagctgtgatgctatgaccacgacggcgaattccccaacacgagagcggcaaacggttacaaaacagttgcgaacgttacatttaagcatttgtttaaatgtgttcctccttcgtaggggacagacgccaccactgtctgccacaaggagaaactcttgcagggttcaaggattctgactattgtgaatgaaaacttttcttttcaaggtggtaagatgcagaagagagaatagtgcttggcaagcatccctatggctacggaggggatcccatgggcagaggagacaaggcgacggtcgccgacgttgcgagggcagcgggcgtctcccccgccacggtctcgcgggtgctccaccaccccgagctcgtcaacggcgagacgctggagcgcgtcaggcgctcgattgccgacctgggctacagcagcgtgtcgttcgacggcatcggcgcgagtggcgcccccctcgtcgtcatcagcatcccctggctggacaacccgttctacggcgagatagtgcgcggcgcacgcgtcgcggcgcagatccacggggcgcagatcctcatctcgtggggtaaccccgaggacccgtcgcttgatgacttctgccaaatgctgaggtcatgcggcgcccaggggatcatcacgtgcggaccgctgtcgctggaggcgctggggcagatcgagggcaccgtgcccgtagtccagtgttgcgagttcaacgaccggtccagcattccctacgtaagcatcgacgacttctccgccgcgcgcacggccactgagcacctgctgtcctgcgggtgccgccgcctcgcgtttgtgggcgggccagacgtgtacaagtacacgagggagcgtcgtaggggcttcctcagcatggtcggggagcagagggtcgacgttcccgatcgctgggtgctgcagatccccaacaacagctttgggctggcatactccgccgtctgccacatgctcgagtcggaggaccgccccgacggggtgtttgcctgctccgacacctttgcctccgcggtcatccgctcggcgaggaagtctggcctggaggtccctggcgacctgatggtgatgggctttgacaacaccgacaccgcggtgatgaccacccccaccatcacgacgatcaaccagccccggtacaacatgggcttctccgcctgcaacctcctgttcgagcgcatcgaggggtcgggtgaggcaacgtcgatgacgttggagaccgagctcgtggtacgagagtccaccacgagcaagaaggagctcccgtaggcagggcgcgcggagcgagggtgctgagaaaagttgagtcgtggcaatcggaacggcctagccaccctttccgcgcgggttttctggacgtttgcgcccccgggggcttggcgctgagggatgtcgagttgtggcaatgaaatttcccgaccgattgccacaactcgcattttctcagcacccacggagaggaaccccggatgcccgcttagctttcccggggcccggacggacgggcgggacaagctcatcccccaagcacaaaacggccccgacccgccgggttgccgacgggccggggccgttccctgaggaggctatgcgttgagcgaccactaggcctcgaagctcacgtccttgccctccttgacgaggagcagagcgacgagggcgacgacggacatggcaacgaggtaccagcccacaccctggatgccaaaggcgagcacgagtgccgtggcgatcgtgggggcaaaggcgccaccgaggatcgaggcgaggttgtacgccaggccagatccggagtagcggacgttggccgggaacatctcgggcaggtaggcgccgcagggcccaaagaggctgcccatgaggcagaagcccacggagaggaacaggaacacgttggtggcgttctgggtcgccaggagctgcggggcgaagaagctgaacaccacggtgagcagcgtcgcgaggagcacgacggggcgacggccgtacttgtcggcggcaaggcagccaacgacgatgaaggcggcgaagaagaacacggcgccgagctcgagcttgaggtactcggtctgagcaaagccaagggtcttcacgccatacgagagagaccaggttcccagcaggtagaagagggtgtaggtgatgcccatggcgcaggtgccgaggacgacctgcttccagtacttggcgagctcatgcagcgggctcttgaccacgcggtcctccttgacggccttctggaagacgggagtctcgctcatgcgcacgcgaacgaccatgcccacgaccacgagcaccgccgagaggaggaacgggatgcgccagccccaggagaccattgcctgctgagagaggttgttctcgagcacgaggttgactccgtaggcgcagaagaagccgaggggtgcacccaggttggggaaggagccccacagggcgcgcttgttggcgggtgcgttctcggtggcgacgagcgcggcgccggaccactcgccagcaaggcccaggccctggaaggcacggcacacgcacaggagcacgacggccatggggccaagcacgtcgtagccggggaggacgcccaccacgaaggtggagatgcccatcatcattagcgcggcgaccagcgtctgcttgcggccgagcttgtcgccaaagtgaccgaacaggagcgagccaaacggacgagccaggaacgagacggcaaaggtcacgaacgagaacagcgttgccaggaaggggttctgcttcgccacgttggtgaagaagaccatcccaaagtagcttgccgccgcgatcgagtaacagtagttgtcgtagaactcgattgcggtgccgaccatcgaggctgccatgacctcgaggacggagtccctgtgcggcgcctcggctgctaccggggcagatagcgttgcggcttgcgatgacatttcgtctctcctctgctggagtcttgggcgccttcgttgcgcccacgctggtcgttggttacatgggttggtatgggaacgttcccatctacccgtggcggtgcttcctgcgtctttgctggttgctcctctcgcctagccgatgttccggatcttggtggaagctggaatgagggtcgacgtcgaaaggaaaagggcccgacgccgtctctgatgacagccccgggcccagagggtccacggccgcccgcgggtgcggacggccggaaatgttggccacccgcacctagataatgttggtaatcccgattagtgagtgctttctggcctggaacatctttggtctcccttggtttcgaacgcgtctgcgttgcgtggctgcgactatgcgcccctggagttcaccctgcgatacaaatcggggactcttaacatgcgagtaacaaattcggtaggcggtgttgttttgtcggcgaaggctattgcatatcgtaaaggggtgccacattccactgcaccgcgcgcccacatctggcgagaaacccgtaccatcggagagaggttcgaccgacagtaaccacgcgacgagaggccaaccatggacgtgctgcttctggagtatcccaagtgctcgacgtgcaagagggcaaagcgctggctggacgagaggtccgtgccctacgctgaccgcgacatcgtgacggacaaccccacggcggacgagctggcaaggtgggtgaatgcgtcgggtctccccgtgcggcggttcttcaacacctccggccgcctctatcgcgagctcggcgtgaaggcccgccttgacggcgggatgacggacgaggaggcaatacggctcctctccaccgacggaatgctggtcaagcgccccctcctcatcgtggacggcacgcccacgacccccggcttcagggaggacgtctggtcccaggcgctggggctggactgagtcgacgtcatcaggggagagacaagaccgccccgggccggaacgctccgacccggggcggctcatgacgcatggcgtcgcccgcgagggacgacgccatgcgcgaacagctagaacgtgatgttcccgaactcggacaggcgcaggtccgggttgttctcgatggcccagtccaggttccactggctcttgaacagcaggagcctgcccccgcgccagtcctccacgcggcaggtgtcgcgcgtgaggttgagcgagcgcacgtccagctcgtccgggctgttctggatccagcggatgatggtgtacggcagcggcgagcggctcacgcgcacgtggtactcgctctgcaggcgctgctccagcacctcaaactgcagcacgcccacggcgcccacgatcacgctctccatgccggtgcccagctcgcggaagatctggatggcaccctcctgcgacagctcctccatgcccttcacgaactgcttgcgcttgagcgtgtccacctgcgtgatgcgcgcaaagtgctcgggcgcgaacgtggggatctgcgggtactgcacgcggtccttcccggcgcacagcgtgtcgccgatggagaagatgccggggtcgaacaggcccacgatgtcgcccgcgtacgcctcgtccaccgtggcgcggtcgtccgccatcatcgaggtgcccgtcgcgagcttgatcctgcggtccccctgcacgtgccaggcctccatgccgcgctcgaacttgcccgagcagatgcgcacgaaggcgatgcggtcgcggtgccgctggtccatgttcgcctggatcttgaagacgaagccagaaaactcgtcgcgcgtggggtcgactggctctcccgagatggtgtccacgtacgagaggggcgggggcgccaggcgcaggaagtccttgaggaagggctccacgccaaagttggtgagcgccgacccaaagaacaccggcgtcaggcgcccgtgttggaccgcatcgaggtcgaactcgttgtcggcgccatccagcagctcgacgtcgtccaccagggtgcggtggttctcctcgcctatgagctcgtcgagctggggatcgcccagctccgcctcgatctcgcccacgcgcttggtggcgttggcgtggccgtccccctcaaacgcgatgaccctgcgcgagttgcggtcgaagacgccgcggaagttgcgcccgctgccgatgggccagttcatggggtaggtgccgatgcccaggacggtctcaatctcctccatgaggtcgaaggggtcgcgcgtgtcgtgatccagcttgttcacaaaggtgaagatggggatgtgacgcagcgtgcagaccttgaacagcttgatggtctgtgcctcgacgcccttggcgccgtcgatcaccatgaccgcggcgtcggctgccatgagcgtgcggtaggtgtcctccgagaagtcctggtggccgggggtgtccaggatgttgacgcaggcgccgttgtaggtgaactgcagcaccgatgacgtgaccgagatgccgcgctccttctcgatgtccatccagtccgagaccgcatgctttgagctgctcttcccctttacggagccggcggtctggatgctgccggtatagaggaggagcttctcggtgagcgtcgtcttgccggcatccgggtgagagatgatggcgaaggtgcgccgagaggcgatctgttgcgacaggcttggcatgagagtcccatctgccgcggccgaagcgaggcggcagacgcatccgcgcacccctcgcgcgccgacggcttgacgcgttgcgattgacctcgggtattgtaccgagcgcggtggcccccaaggtacattgcacaaaatggggagaagagcatggcccccccccgggaccacagctcatcccaccggccgtcggcgcgctccggccccgctgccaacaggagccctcgcggaggcggaagggcgcgcatctctccccttcctggctttgttgcgaagctctggcgccgcgacctgcgacgcggtatgtttcttgggtcacaagccagaggggaagcgccctctcaccaaccagcagaaagcgagacccccatggaactcaccggaaaccagatcaggcagcttcgcagcctgtgcaactccctcaagcccaccgtcaccatcggcagggccggcgtcgaggcggtcgtggaggccgcggacgccagcctcgaggcgcacgagctggtgaagtgctcggtccagaacaactccgggctcgacgcccgcgacgccgcgatcgcgctctcgcgcctgacgcactctgaggtcgtccaggtcatcggccacaggttctcgctgtaccgcgagaccagccgcgacgacgtggagaagatcaagctggtctagccccggagcccccggggaggtcacaacacgcgaggaggagacatgcaggcaaagttcgtccaccgctgcacgcacgtcctggacaagcaggcgaccatcgccttctacgaggaggccctgggcttccacgtggtccgcgagatgggtcccgacgacggctcctggaccaacaccttcatggagaacgacgcgtcgccgttccagatcgagctcacgtggaaccgcgggcgcaccgaaccctacgccaacggcggcaaggacacccacatcgccttcgaggtggatgactacgacgcctaccaccagctccacgagcgcatgggctgcatcgtgttcgagaaccacgcgatgggcctctacttcatcgcggaccccgacggccagtggatcgagatcctgccccaggaccgatagcgcctctcgccagcaaccacatcgttacgcctgacccatcgccccgacggagcccccgccggggcgatactcttctcttgggggcggagggatgacgtcgagcagtccgcccggctggaggatgccatgctgctgcttgggcgagacgagattcgcgcgtgcttctccatgggagaggcgatcgacgccgtgggcgaggcgttctcgcttgccagcgggggcggcgccgacgtgccgcaacgcacggtcctggcccggcccaagctggacgcgaccctgctggtcatgcccagctacgttcctgcgggcggacgggagcgcgccgacgccgcgatgggcgtgaaggtgttgggggtctatcccggcaaccgggagcgggggctccccaccacgaccgcagtcatggtcgtggttgaccccgacaccggcgtagtcgacgcgctggtggacggcacttacctcacgcggcttcgcacgggtgcggctgccggcgccgcaacccgcctgctcgcgctgcccgccgcacgagtgggggcgctgctggggacgggagggctcgcgctctgccagctggaggcgctcctctgcgcgcgcaagctggaggaggtacgcctcttcagcccgcaccccgagcatgcgcgggagctggcgcgtctcgcccaggaggacctggacctgggtggcacgacgctcgtgccctgcgactccgcgcgcgcctgcgtcgagggcgccgacgtgatcacctgcgtcacgagctcgcacgagccggtgctggacgcatcgtgggtcaagcccggggcgcacgtgaacggcgtgggttcctacaccccgagcatgcgggagctgccgcaggggctcctcgctagggcgggcctggtcgcggtcgactccgccgatgcggtcatggtcgaggacggggcactgatcgatgccgtggcagatgggctggtgaagcggggtgacctagtcgagctggggaccctgtgggaccgggcggatggtggggcgtcctgcctccgcggaacgccgctgctgccgaacgacgccacgagcgtcttcaagaccgtgggcatcgcggtccaggacagcgtgtgcgctgcgcggatcgtgcgggcggcacgcgagaggggcgtgggccgcgaggtggagctgtagccccgctgcctcgggcgtctcgaccgctcgaactcgaacctcttcatgcgccttgcgggcagggtgcttagcatcgccggggcacgcatggtcggcgtgcgaccagtgcttagaaaacccgaggcgcgtatggattttgggacgaaatgcttagtcccgccggggcgcgcacgtctcgagcccacggaaactcgaacgggccccgagttctttaagcatctctcctatcccagtcgttcgagcaccgaattctttaggcgccctatggctgccgcaagacgggggcagggcctccacgtgaggggtgctgaggaaatgcgagctgtggcaatcgggagggccggacgcctggctttcccgatgcgcagcggttccccaggatggccaaaagccaagagacacctcttgctgctgaagtatttcgacctgtggcaatcaaggcgggctccaacggggggccgattgccacaactccacttttctcagcagcccaccgtgccgaggggagtgtgccgactgttttaccggattcttccgtgcgcgaggaggcttttctgcccgcgcaattgccacaactcgcatttcctcagcaccgcactacccatcaccggatgcacgagctccaagttgctccgaccccctggtgcgctacctcagccaggcggggagagacccgtcgtccccctgtgccgagcggaggttccgacgaattgccggcatcacgacgtcgcgcaccgttcgtatgaactccccggcgggaatcgagttgccagtggagccacgaaggcgaagcgcctcccccaccccacctgcagtgaacgcgagcagtgtgcgcgcccggttgccggcagcatcaggatccacgtcgagcgcctccgcagtcgcctgggtgagaagcccgttcaaatacgcccttccgcggccgctctcgttgagcaaggcaaaggcacacaggcgatcgagactctgcgccagctggagatcgtccgcaatgggcagggcctcgcgcccctcgcccaccatccgccgcacgaccagacgcgcggaaccgtcaatacccatcgctcccagcgccgtgtcgcagagagactcgagcgtctcgaagtggtagtagaaggtcgtcttgttgcatcccaccgagtcgacgagcagtcgcacgctgatctggtccacgggcatctgcgcggcaagctcctggaacctgctgatcagctggtccctggtggcaaacttgtcgtccgtacgcttcggtcgtgccatccccacccctctcatttattgcgactcatggtcgtgttatgacccattttacgagctcaggatatgggaaagcgacttgttatttaaatacaatcttaagtcgtattattttgtacggggtattaggcaaggagatgcgcccaggcggggccgggagcggtaagcgcacatcgtccgcagccgcacgggcgacgggttactcccacagccggcggcgatttggctgcggagccaaagaaatcgcccctctcgcacagcagatactggtgagaggggcgtgaatcggggtagttacgggcgcacgacgcctggggcatgggctcgctgccccccggggacgtaccgcctagcgcagcgacagcccgtcgtgccaggccttgcccacggactcgcccacaacgcgatactcacgcgcggcgggatcgaagatgatgggacgaagcttgcccaggtcaacatgcccgtcggtgatcacggagtcgtccgcgatctcgttcaccacatccccgaccaggattcccgtgttggggtcgtagctggcgaccgtgcactccatcgtaaccgggtactcctcgatcacgggagcgttcacgtgcggcgccttgtgcacgtggacgcccgccttctcgatcttgttgaccttggtaccggagtcgatgccaaagtagtcggaaatcgccacggtatccgccgttccaaacgcgaccgtgaacgcccccgttgcctgcaggttctgggtggtcttgtgcttgcccaggaagaacgtgatctggctgtagccggactgcacgccccaggctgcgttcatcgcgttgggcacgccgtcctcgtcgtaggtcccgatgatgtagacgccctccggggtcatggccgacttgcttccctcaaactccatgcttgcctccctgccaaatgcggtcactctcacctccattgttcccagtggggaggagtcgcccacatgcgagaagggcatcgtgccatgcgtgcgcggcatacggccacggggccattggcggcaatcgagccactgccgtaccctcgatggaggggacgcccccctaccggatgagccgagagcgggagtgaaacatgcagtggattgagaaccggctgcgcgagctggcggacgcgggcggcgagtaccgcgagttcaacgcgcggatcgtggcgaccgcagaccccgcgaccatgctgggggtgcgcgtgccgcggctgagggcgctggcccgcgaggttgcgcgctcggatgaccacgacgcgtttctcgccgagctcccccaccgctggtacgaggagtacctggtgcacgccttcgtgctcaacgatacgcgcgagctgggtcgcaccgtcggcctgttggacgcgctgctgccatacgtggacaactggtgcgtgtgcgatgccctcaacccgcgcgcgttccacgacggccgcgagctgggcggggatcccgccaggacgctcctgcccctggcacgggggtggatggcgtctccgcgcacctacaccaggcgctttggcgtgtcggtgctcatgagggacctgttgggcgagggatacgacccgttgcagctggaacttgcggtcttggcggacaacggggagtactacgtgcggatgatgatcgcctggtaccttgccgaagcgctcgtctcgcatgaggcggacgcgatggctgcgatcgcgtcacccgccaccgacccccaggtcaggcgcatggcgatacagaagggcgtcgagagccggcgcgtccccgatcggacgaaggaggccctccgccgcatgagacggagggcctagcctggattgacgcgggtctctcccctagttgtgagaggtgctacttgctcacgaccgagatgcgctggcggacgtggtcgccggactgggcctcgtcgaccatcgcgatggcgtagtcggcgtacgagatggtggactcgcccttggagttgagcgcgagctcctcgccggcgagcttgtagccacccgtgcgctcgccctccgcctggaagtctgctgcgggcgagatgtacgtccagcgcacgtcgtcgcaggtgcgcaggaagtcgagggaccgctgcgcctcggaagcaacccccttgaaggcgtccgggaagtcgggggtctgtgccagggtcatggtgtgctcggggttcacgaagagcgagccggcacccccgaccaccagcaggcggacgtcagtgtccgcgaggaccttggcgaggtgctcgacggcatcgggaacgaggtgaagggtatccgcggtccagccaccgacggcgtcgatcaccgcgtcaaagccctcgagctgctcgcgcgtgacggtgagggcgtcggccttgaggaagtgcggggcctgcgtgcggttgtcgctccgggtgatcgcggtgacgtcaaggccgcggcgcacggcctcctcgaccacaagacggccaactcgaccgttggctgcgacgactgcgatcttcttggctgcgttctggctcattgtgattcctccctggttgcgggacggcccgtcgccatcccctcctgacgcttgccacattacggacaatggtgcatattgggaagtaagcacaataaagtgctgtaagtaccttttggtaactattgggaggtacctgcggtggagaagaacagagaccttcttgcggagcttcccgcgtgccccgtggagactacgctcacgctcatcggcaacaagtgggaggttctgatcctgcgcgacctgatggacggaaccaagcgctttggcgagctacgccgctccgtggggcacatctcccagaaggtgctcaccacccagcttcgcgccatggaggccgccggcctggttcatcgggaggtgtttgccgaggtgcctccgcgcgtggagtactccctcaccccactggggcacagcctgcagccagtgctcgactcgctgcgcgactggggaaccgagtacaagcgccatctggccgagggcaccgtgatgaagtgagaggtgcgtgcttagcgttgccggcgcgggtgcggacggcgggacacccacgcttaactattccgaggcgggcacggatttggcggccaaatgcttaatccttccggtaccagcacggctccagctccccaaaacccgcacgggcaccgggtttcctaagcacgcctcgcgcacgagcgggacgcgccccggggattctaagcgacggcgccccaaaccaagcgattcccgccccccacctgtgcccgcgcgaatccaggggggttggtaccttgcagcaccattcctcgcgacgattccgaaaccggatgcttaacgccgctagccctcatacggattccgcagcgtgatgcttagcgccgctaggcctcgtgcggatttgacggcggaaatcgacacgagggctaggttcgctatgcatcaggcccatcaatccatgcgggggctaggtttgccaagtacctctcgcgagcacgcggcaggaagggatgccgcccccttacgagaggaactggtctgccaggagctgccgcccggtctttgtgcggaagaccctctcccctgccgacgtcgccatcctgcggcgagcggccgggtcgtcgggagcgtcctcgtagatgttcacgagcatgtccgcctcgatgagaatctgcaggtcggcgtcgtggtcgcccacgtaatgatgatggtgcgccacgagccagcacacccggtccacgacctcgggatggtagcccaacccctccatcatggggcgcgcgatgccggggccaagctcctcctggtgggtgcccgacgtgtcgccgtacacacgctcgcactcgtgaatccccacgtcatgcacgagcgccgccgcctcgatcacgtagcgcgtcgcggggtcgatcccctccgccagtgcgatggtgcgggcaagggcacgcaccttcacaaagtgctggatcctccggggatcggagcgatcgtacctaaacatcgcaagctcgagcgcaacgtggtcgctgggcacctctggcatgggtcctcctcctgtggccgggacgctcatgccagtctaggcaagtggcgggcgagagggacggcacgaccctcactcgcaacaacgccgggcggcaggcgcatcgcccccgccgggcccggagagtcccccgaagaagcccgtaaggtcgtgcgccacctggggatccaccgagtagtagcaccaccggccctcgcgacggcagcgaaccaggccgcaatcgcagagcacgcgcatgtggtgcgagagggtcggctgcgagatgtccagaccgtcgagcagctggcaggcgcacatctcgccctgcccggcgagggcacggaccacggcgaggcggttctcgtccgccagcgccctgaacgcgttgaccagctcagcctcggtcatcgacatccgccccatcctcgcgcgtctcccctgcagggaacattctctcacgcagggagcccagccgagcgacgattgcgtcggcgcacgcggcataccccgcggcggggccgcccatggggtcgtctagcccccagtcctcgcggtggtcgcaggggaacgtggggcacgagacgccacagcccatggtcacaagccagtccacgcggggcgggagctcgcccaggaccttgggtctaaggtcattggcatcgacgccccgacgggcgagctcgacgagcgcccccgggtccacggcctcggcgggatgcgtgccagcggagagaaacgttgcctccccgggcatcaggctcctcgccagggcctgcgccatctggctgcgacatgcattgtgcgtacacacgaacgcgacgatgggacgctgcctcatctctccccttcccccaaggcgggccacgagagcctgcgacgcatggcggtggcggcattcaccaacagtatgagcgacggcacctcgatgagcggcccgacaacggcggcaaacgcctcgcccgagccaagcccaaaggttgcgacggcaacggcgatggcaagctcgaagttgttgcccgtcgcggtgaaggcgatggcgctggtctgggggtacgggaaacccgtcgcgtgagccaccgcgaagctcgcaaagaacatgaccgcgaagtagatgacgagcgggatcgcgatccgcaccgcgtcgagcgggagctgaacgatctgccgacccttgagcgagaacatcagcacgatggtggcgagaagggcgacaaacgagaccggcgatacgcgcgggaggaacacgccctcgtaccattcgcgacccttggcgtgctcgagggcgagacgcccaagcgcacccgcggcaaacggaatcccgaggtagaacaggacggtgcccgccacgtcctccaccgagaggctcaccgcgacgaccggtgcgcccaccaatgccgtaagcctggtcgcatagagccaggcgagagggccgtacagcaggacctgtaggatcgcgttgacggcaacgaaccccgcgcagtactcggcatcgccgccggcgagcccgttccagacgatgaccatcgcgatgcagggcgcgatcccgatgaggatgagtcccgtcatgtagttgggatggtcttcgaggagagtcgtcgccaaggtgaacatgaggagcggaccgatgaccgcgcagaacaggagcatgagggcaagggcacgaccgttgcgaaagacccttggcagctccgagtacctcaccttggcgaggggcggatagagcatcagcatcatgcagaccgccagcgggacgttggtggttcccaccgccacggagttgagggcgtcggccacccccggggcaatcgcccccagcgctatccccgccgccatcgccaggaagatccacagggtgagaagtctgtccctcatcccaagacgcgaggccgtgcccccttgtgccacgtttttctcccctgtcatcggaaccgccctcccacgccgagcgcattggtgcgttcgacttatttacgcttatcaatacgttgcggatggtagcacacacattgacgtttttcgatatgatgggagacgaactttgaggtgggagacgggcaggccgtcgtaggtgcgcggtgagcccgatggcgccagccgccggatggcgcagcccgtgccagcaaaggagggagaggcatggatgccatgaccacgtatgcccccggggagcgcgaggccctgatcgtgcgggcgtgcgaggagtccacaagcaccgatccgctcgaggtgtttgaggaggtcgcctcgctccccttcgtgcgcatgcacggaccggagcaccacgtgctggacggagcgtgcctgctcgccgcctaccgcaacgcggggggcaagatagacctggacgcggcgcttgccgagctcgcgtcacgggggctcaagatgcccggggccatgtgcggcatgtggggggcctgcggctcgacgacctccgtgggcgccgccctctcgatcatcgaaggcacaggtcccctcaccaccgacgagtcctggggagggcacctcgccgcctcgtcgcaggctctcctcaagatggcagaggtcggcggtccccggtgctgcaagcgggacgcctacatctcgctgcgcgagggcgtccgctacgtccgggactcgcttggaatcgagctgggctggcacgagccgcgctgcaagttccaccagcgcaatgcgcagtgcctgggggagaggtgccccttcttcccccttgcctgaccccagggccgtccgcacatcccaagagaagcgcccccgcggctcagttcaacgagaccgcgggggcgctgctgcgcgggcgaacaggacgaacgccgcaagccctacttacgcgtgagcagcagggccatcttgaaccggctgctcgccttcacgtagtggcggccgcccttcgcaaagcggatcgcctcgccggcgcgcagcctgtgcacggtgccctcgtagccaatgagcccctcgccctccagcgcaaggacgatcgcgtcgccaggcgcggagtgctcgtccagcccggtgccctcgtcaaagctcatcacggcaagcttcacggagtcggtgttgacgacatccttgctcacgacctcgccctcccggtaaggaacctcgtccgcaagcgagaggacctttcctgcctcgggaaacgcttccatgtctcctccattcgcaaccgatatctcaaggtagacgcacccgtcgtcctcgcagccaatgccaacgggggcgtccgcgggaagcgagacggcgctgagcctcgtggcgcgcagcggttcgggggcgccgggaacgctcgcgagcaggctgcccgccaccacgacctcgagccgtcgaaccggtgatgactccgcgctgatgtcggttcccccgctcagggagaaccgcgtgacggtggcgctggaaagctcccacatcttgcgcgaggatgtgcatccgggaatcggtgcccactcgtctgccatcgagaacggctcgcctgcgtcgtgtgccatcgtttctctccttccgtgcgtcggccattgtcctccacatacccaatgccatctgttatgtaacagttagctctcggtctcgcaccggcttgccggagcaccggcatcggcttcgcaacgtttttcgccgctggaatgagccgcgtcagcaggacacggataaggagcctcacatggagctacagcaggtccagcgtcaatcggccgagatacgcgccctctatcacgggctggagcgcaaggtccatggctccgagtggaccgttgaggaggacgccctggcctttctcaccgacgccggcctggtgggccgcctggtgatggacgagcaggggcgctggccaagctccgatggccccacgctccccgcgaagatcggcgagtgcgtgtggtggctcgccgtgctcgcggagcggaccgggctggacctcgaagcctgcgtggaggacttcctgcgcgagcgatcggcggcgctcggcgcccccaacacgccgtcgggcgagtaggccccttggggggcgcccgcccccacgcgtgatggggagttcgtgggcaatgaggcacaggccttcgataccgtgctaccctctgtgagacaaattgcatagcaggtacgccttggaaacgcacaccttctggtgataacgaacaacactgcgcaatctaccaggaggtttatatgccagagagtccgcttcagaaggccgtgttctccatcatgatggtctgtgtgatggtatacggaatgatttgctataacatcgccctcgaaatggggggactctccaacgagacgttcctcgccgccttccacgagctcgtcttcatgggacccatcgcactcattcttgagacagtgctggtctcccccattgccagcaggaagtcagccgatatggtcggcgcaaaccctagcgccccgttcgcgagaatcgccgccatgtcggccctcaccgtgtggctcatgtgcccgctgatgagccttgtcgcaacgctccttatcaagcagcccgcaccttcgcggctcgtcgcgacatggattcagaccatcgctctcaaccttcccatggcgctcctgtggcagttcttcttcgccggccccgtgatccgttccgtggcccgagccatctttggcctgggaagggagcgggttgcctgcggggagcttgactagtcgcaaggccgccaacgtccttggcccccggacgagcggctccatatgcacgcgccctaccggcgatgggccttttgctggctttggctatcggtcgatttgccacacgaacgtccccgttgctccacctatgttagatttttctaactaaactgcgccgacgcgggcgggaccagggcaaacggggccgccccacgaccgaaggctgggacgccatgggactgcttcgctcgttcttcaacaacacccgcaagcccaagggagcccttggcagggggatgctcgcgagcatgaaccgtggccacgccgcggtgtcggactggggaatggagcaccttgggggacgtgcgccccagagcatcgtggagctgggctgcggcggtggacgcaacgcgcgcaggctgctggaggagtatccccaggctcacctggtcgccgtcgactactcggaggagtcgctcgcgaagaccgagcaggtcaaccgcgactttgtggcggagggacgctgcacgctggtggaggctgacgtctctggcctgccgctcgaggacgactccttcgacctggcgacggcgtttgagacggtctacttctggcctggccccgtggagagctttcgcgaggtgaggcgcgtgctgcgggacggcggcaccttcctcgtcgtgaacgagtcggacggcaccaacgaggccgacgacaggtggacgggcatcatcgacgacctgcgcatctacaccgaggggcagcttcgcgcctacctagcggaggcggggttctcccgcgtggaggtcaaccacgaccagcaaaggcaccggctctgcctgcttgcccggaagtgaggccgcgccccggcgaggaggcctcgcgtcgcagggtttgcggtgggcgacagctgaggaatgtcgagcattggcaatttggggggcacggctgctgaggagaacggagtattggcagtcggagacgcccattctctgccaacactcgcatttcctcggcggaatctgcccgcggattgccaacgctcgcatttcctcagcagcctccgccgtctggcggtagagggaccccctccgactgccacaactcgagatttctcagcagccagccctcgggatcgcccgcacgtgcctcacgcgagctccgagcgcccccggctcctgccaagcacaagccccacgagcaggatggcaatcccaaacagcgcgcatattccgatgtcgcccacgagcggcatcacgtttttcgcggtcacccgtcccatgcccgcggcaccctcgaccacccgcgtgacccagtatgccggcgtgaagtgtgccacggcgacgagctggtcgggcaggagcgagaggcccgtccacgccccgccgagaaacgacatcaccatgcccaggatgttcgccagcgcgttggcagcgctctcacttactccaagctgacccgcaaggaagcccacgctggctgccaccagcgcgtatgccaggagcgccgcaccaacgagcgcaagctgcacgggagagtccgcgagcgaggagcgtcccagcaccaggacttcgagaccaaaggtccatgcccaggtaaccaatccaatcgtggcgcaggcgcccagcagtgcgaggttgcgggtgcgggcagactcgggggaggcgagccggcggtcgcgcacgggccggcgctccacggaggacatgagcaccgcgatgcagaccatcgcgctggagaagatggggtacgacgcaaactccgccgccgtgacgaggctcgcgggcaggggcgaggcgacctgctcgaccatgcttacctgggtggacccctcccacgcgtcgtccgtggcggagacaacctccgcggcgccgccacccagcgtcgccgccatgccatagagtccgtcggcgtagcccgtcacctcgatgtccaagagcctccccatgccggagtagtacgacacgtaggtctcgagctcaggcgccttcccgccctggcgggccgcgtccatgaggccctccccccacccccgggggatgacgagcaggtagctgaccctgtcacgcgccacgctgtcctggatggcgcgcctctcgtccgccacgtccacctggttgttaccggcgagcacgcgtcgggccagggctgacgagagctcggagccatcgcggtcgatgacggcaacgtttgcggaggtctcctggtactcgcccgtggcggcagggctcgcggagaggccgatgaacacgccaacgagcgagagcatgaccagatagatcgcgatatacactcgatgcgagaggaagatcctgaggtaggtcctaaaggtggtcatacgaggtcctcctcatgcgcagggacgccacggcaataaacgcgagcgccatccccaggagcgcggcacagcttgcgaggaacgcgtcgggcgtgtcgtagtagagaagcgcgtagaagcagttggtcgtctgccagagggggttggcgtgcgcgagcacgggcatcgctgcctcgatggagtccgccagctgctgcgacgccgtgccgtacaggcccgtgaagagcgagagcaggcaggtgatgccggatatcatgcctgtctccatgcgagggacggtcccgcacagggcgccggccgcgcacgccatgagcgacgaggccgcgattgcgcccaccacgcccggggcgttgtcgccaaatgggacgcccgccgcgccccacatgaagagcgccgccacgaggaggcacacgaactcgcagagccatgcgcccaggagcgcccccacgagcatgcgccagcgtggcacggcggcaagcgtctgccgcgcccccagaggaccggccgtggggaggagcctgcgcgccgactccatgcccgcggtggcgcccatgccggcggccatggcgaggagcgcgtagtagtagcgcgcgtcggggcttggcgggttcttggtagcggagagccgcaccgtttggacggccccgctggtgaaggcctcgatcgcgcggccgttggcgaggagctccggtcgcgttgccgcgaccctctcgaccgccgaacgcgtgtgcaggtaggtgtccaagacctcggagaggaccgaggtggggaggctgccgccctccgccacgctcgcctgggtcacgtggagctgcggcatgccgtcgccactcacggtgaggtaggcatccacgtcgcccgcgctggcagccgccttggcgtccgccgcaccgtcgtagtaggtgacgtcgcagacgtggtcgctcgactcggggcccgagatcgcctggatcgtctcgtccaagcccaccgcggcatcgtagttggcgtcgcgcaccacgcccagcgtggagcccacggccgagtaggcgccccctatccccgagaacatccccatgaagatgagggtcatgatgacggggaacgcgagcgcccacacgaggagggccttgtcgcgcacgagcgagagcacgcagctcctgaggcttgcgagcatggtggccccctatgcctcgtcgcgcagggcgcgaccggtgatctcgaggaagacgtcgttcaaggtgggcggctcggagagcacgcgaccgtacgggaggcccgcgtcgcccagcacgcccagcacgtcggccaggttgtgcgccccggaggcgcactgcacgcgcagcatgcccccgtccgtctcggccgtgcgaacgtggtcgagcgaccgcacgcgctcgagggtggcctcgtccatccgccccacctcgacggagatcttctcgcccgtgccgatcatgcccttgagctcgtcggcggtgccgctcgccacgctgcgcccgtggtccatgatcatgatgcgcgagcagagccgctcgacctcctccatgtagtgcgaggtgtagatcaccgtggcaccctcggcgttcaggcgctcgatgcccgagaggatcgactcgcggctctgcgggtcaacggccacggtgggctcgtccatgatgatgagttcggggcggtgcgcgatgccgcatgcgatgttgaggcgcctgagcaggccgccggagagcttcttggggcgaaagccctcgaacttctccaatcccacgaaggcgatggcatcgtccacaagctcgcggcggcgcgcgcggtcgcccacgtagagcgcgcagaagctgtccacgttctcgcgcacggtgagctcgtcaaagaccgcgacctcctgcggaaccacgccgatgcggcgtttgagctggtagctcgtgggacgcatggcttcgccaaacagctggatgtcgccgtggtcataggagaggagctgcagcacgcagttgatggtcgtcgtcttgcccgagccgttgggccccagcagaccaaagacctccccgggcgcgatcgagagcgagaggtggtccacggcgaccaggtcgccgtagcgcttgaccaggttgtcgatgcgaacgaccgcgtcacgtgcacccatgttggcccctttccgaatgctggaaccagtctgagggagcggcgccatgggcggaagtgacccgcgtcatcagttttttggaggaccgtgacgtttgtcatgcccgcgggcggcccatgcggctgcagcgcacccgtatactctggagccatggagagaatcgcggacaaggccctcatgctcgtcgcctgccttggcgtcgtcgccatcgccggggacgcggggccggtggccgtcgtcgctgtggcactggcggtgtgcgcgtccgctgccgttgggcttgccctcccgtcacacccgggtgtggccatcgccacctgcggtgccgccacgctcctctccgccgccgtacccggcgcgttcgtggcattgccccttgcctcgtacgacctcgcgcgcacgcggtggagtgccacgtgggcgcttgcccccgtcgccgccgcgtgggcgtggcttgcgcagggacccaggcctgccgtcacctcggcgcttctcctgtcgtgctgctccgtcgcgctctcgctgcgctgcgggcgccaggtcgagcttgcgggcaaggccaaccggctgcaggacgatctgcaggacaagctgctcgcgctgggtgagaagaaccacgagctcgaggatgcccgcgagtacgaggcgcatgccgccgcactcgccgagcgcacgcgcatcgctcgcgagatgcacgactccgtgggccacctgctcacgcgcctcgtgctgcaggtcgaggccctcaaggtggtccaccggggcgatgccgccgccacggacgagctgacgcaggtctccgacggccttaacgaggcgctgcagaccatgcgcgccagcgtccacgccctggaggactcgggcgtggaccttggggtcgagctcaaccggcttgccgccacgagcggcatccccggcgtgcgagtggagtgcgaccctcacgggaccccgcccgccgaggtgagccgctgccttgtggccgttgcgcgcgaggcgctgaccaacgccgcgcggcacgcccatgcggaacgcgccaccgtgcgcgtgaacgggatgcccggcatctggcagctgcgggtgtggaatgacggcgaggtgcccggcaccgcctccggcctcgaggagcgcgggatggggctgcgcaccatgcgagagcgggttgagtcgctgggagggacgctccgcgtgagcgttggcaacgggttcgaggtgtttgcctcgctgcccaggggagagcgcccatgaggataatcgtggtggacgacgacgcctttgtggtccggtcgctggcgacgatcctctcggccgagacggacgtcgacgtggtggggaccggcaccacgggcgaccaggcggtcgagctgtaccgtgcgctctcccccgacgtcgcgctcctggacatccagatgcccgggcgagacggcctctccgccgccgaggagatcctgcggggcgacccgggcgcgcgcgtcgtgttcctcaccacgttctcggacgacgactacatcgtgcgggcgctgcggctgggcgcgcggggctatctcatcaaacaggacgttgccacgatagcccccgcgctgcggtcggtcatggcgggacagagcgtcctggagggagaggtgctggcccgtgccacgcggctctcgtcccatggcgccacggctgccgacgggcgggacgaggcggcgctcgccgccctcacgcagcgagagcgcgaggtggtgcgcgccatcgccgatgggatgaccaacgccgaggtggcaggcgccctgttcatgagcgagggaacggtccgcaaccacatctcgtcgatcctggccaagctggggctgcgcaaccgcacgcaaatcgccgtgtactactaccgccgctgcgcataagaacgcggcgcggcaccatcaggcgtagcgtcgggcaatggagagtgccaggcccacatacgcctccccatagaggatgcagtgcaggagcacgggaacgagctggtgaatctgcacccgctcctcccatccgtctgcgagcggcgaggtcgcgtcgtaggcggcaatgagctcgtccaggtacgcgcagccaaacagctgcagcatggcgaggtccgtctcggcatgaccgcccgatgccatggggtcgatcagcgccgcgcccgtcgcggcggcacggctgccagacgccgcccagagcaggttgcccgcccacaagtccccgtggatgcgcgagcagggatgtcccccgcgtcggaccagctcaggctccggagagtcaaactcgccccgagccatgcggcctgccacgcgagtgagcaggcgtgcctccccctcgtccacgagcccctggtccctgatcgccctgacgtgcggcatcacgcgccagcgggcgcaggtggctccccacgagagcgcctcgggggcaagctctcccgacgatgactccaccacaccgcgagggacgactgcggtgcgagaggggccaatcgcgtacgcgccgccctcccatcccggcggcgggcagccgtaccagtcggcgcctgcggcgtgggtccgagccagtgcctccccggcaaggcgggccgcctggcgcgtgggtgcaccggtggggatgcgctcctcgaccagccggtgggcgctcgcatcgcgcacgcgcgcgcatgcgatgccgccgaacgactctgcgtcggcaagccagcggagcccggcagcctctcccgcaagatccgccgcaggagcctcgtcgtgcttcacgattacgtctgccgccatgtggcgctccctccactcaagggtcatggtaccccccaaggggagaggcgcgctgccacggcgggccgggccctacggtgtaataagtggcgcaaaagcctcttttacctgtgtttatgacatgacgggcgagagccagccccctatgttgaggacacgtcccgagcacaccgaagggaggaaggccatgcgctacctatcgttgctcgtccactgcatcgcccggcaaccggcaactgtcacgattgcggtgctcctcgcgctcgcatttgccaccccgcttgcgcttgactgcgtcctgtggggagagagtatcgtcgccgcgaacgcgcagaacgcctacaccacgctcaaggcagccgaggacgctggcgcatatgactccgcccctgactacatccgaaccgagaacgagcgcgacctcaaactgctgaggggagtagtcgacgccaaggacccccacacgttctgggccgcagtggccaagcagtcgaaggctgagctcgacgagatacaggagggcacccttcagggcgatgcgctcaataccgaagcggagtatagacgggcagtcatcatgtctatggagaagaatccaagaaccatcaactacgtaggcgacctcccgccggcacaatacctccctgcggcaatcgcctcgcttcccagcgtggcgtggcttcttccctccctggtagtaggagttgggctctgccgcatcacctcgcctcaacggctcctgggagcacgcaccattcccgcaactcgtcgtgtccccaccgtctgcgtggcagcctccatctcgtgcgtcgcaattcttgtcgttgccttcctccctggaatggtcctctcgggacttcggaacggattcacctccagtgggctccctgtcgtattcatcaagaacggattcgtcgtcgtcgcatcctcgggccaggctctctcctcgttcctcgccctcgtcgtcctcgaaaacgtcttcgtctcgtgcgccatcgtgtgcctcggccagctcacggggggtgcagcagcggggggtgtggttggagtggcgctctgtctcctgcccctgtccgactcgtacctctcaccgtcttcccccctatctccattgctcaaatggcttcccacctcatacttcgacgcatcaaggctcatgggatttgccggagcttttggggtggacatctgcgagggaatctccctcgacacggcaactggctgcatcgtgctgctgtcttggaccgcttgcttcattctgctcacgctcgtcgtcggctttgccctaagcagataccatgcggcaaggcgtcaaaggaggggtcagacatgtccctcgacatcgagaatctaaccgttggctaccgtcgcgaaccaccactgctaaaggatgtctccctgcacatcgaccctggacagatatgggggctcatcgcaccaaacggagcaggaaagacctcgctcatgagagcgattgcgggcgacgcaaagccgctggtttgtggcagcctctgcgccgacggtatgacgcccctcaaacccaccccctacaacaggttcgtgagctacgttgcctgcgacgattcagccctcgaccgaagctgcaccgcgcgcttccatctgaaggcggcgtctgacctttggggttcgcgcctcgatccatccgagaccgcccgcctcttcgagctcgatggatttctggacaaacccatccgctccctgtcgcagggcatgcgccagcaggtcaccattgccctctgctatcagcaggatgccccatacacgttattggacgagccactcaacgccctcgacccgctcaagcgcgagatggcatgccgcaaccttcgcgacatggcacatcgcaactgttccgtattcgtctcgtcccacatcctgagcgacctgaacgggctctgcgacaaagtcgtcgtgtttcggtcgggaaccgccgtcgtcgtcccagccacagcgaacatgcaagaactcttcgaccggtgctatggaggtgagtcttcgcacccctcaacggacgggaaccgaccaccacaacacatgaatcgaaaggagaaccttcaatgactaatctaaagagctcatcaatcaaatcgacttttctaattgtgccattgacccttgctttttcgatagcctgcacgcttttcccagtaccggcaattgcaaccacagcggagcaagatcaaagccagattatcatgcgggcaaagtcaaacagtgtaatcgatacttataaatctttttactgtaataccttcatggttggtcagtatgacgtgaagtacagaacaatcagctttcacacgagctactcattaaaagaggataaagtaatttcgtactatagtggtgtatataaaacttttcatggaaaaatagcacagcacaaatgctattaccgcacttggtagagaccttcgcggcgggaggggggcaaccttcaccccctcccgctcaccttctcgatgagggcacgctgactgtgaactccagcctttcgatacacctccctcttgtgcgatgcgaccgtctcgggcgacaccaccagctcatccgagatacgcggcaccccgtacccaagtagaagcatttctgccacgcgcatctgcacctcagtcaaaccatagccgcgcagggctttaccaagacctccgcatgcatactcccgcagcaccgcctgccccctcgcggcatctcgcctcacccgcagcgcaacagcaatggcaagagactcccccaggcaccacagcagcacgatggcccactcgccaaggcgaatcaggggtacgccgagaagtccgatgctcccaagcagctgtccaaccccatagacggagagggcgtgcgagggcatacgcgtcacgaccctcccaccagagacttgcgacaccacgagaaggcaatacgggattgccgtcagcggctgcgccagagcgagatactcctccctcatctggcacgccatggtgcacgcgaccgccagtccctgagcgaaccccgcagcaacgagcaggagggtcctgtcccagaggggaacgctccgaacgagtaggtcggtcggcaagtatgacctcaccccaaccgccgcaaccatacccgcgacgagacagagcgcccacccccacccctgaagccaatacgactccacgtcacgggcgcttgccacgcaggagtacagcatcgccaggaggagtaccgccgcagtcgccatcatccccacgcggcgtctttcgtcataggctcccagattgacgagagagcaccccagaagcatggcgaccacagccagcgtcttgacgcgctcgatagagcgaggaagccatgccattggggcactgggaacggacgcgcaggagtacaggagaagaaccacgcaagccagcactatggcaaggggatgggcatccagaccctcctcctcgtcgctcaacagctcgttcacctgccttatccgcagtcgagcaaggagctcagtcatggtgcggacccccagtttgcgaagcccgcgcgagcgataggtgctcacagtgccaggggaaagccccatgcggtccgccgtctgccggaccgtctcgcccgagacggcaccctcaatcgcatcgagctcgcgggtggaaagctcttcccgctcctccgccgaaagaagatagcgttcgcgctgcccctccttgtcgtcttccatacgcccacgacgagccagaagaaccagggtggccacactggcagcaaggcatcccagtgtcagcggtgtgaggtagccatacccgcccgtagagccgtaggggcgcccgtccccatacgctccctcgtttgcaacgagcgccgcaagggtcatcgagaggaggagctcgacgagcgcggtctcgccattgccgcaccatcgacagcgaatgaccgcgagctgagagaacaccacaacgaggcaagacaagggaatcaggacggcagcagcatcaccatgacccaatccaaccaggagcaaggcgcatgcgacaagaccaacgttcgcaatctgcgcaaaggcattatgtctggttggcagggagcagaactcgatcagagaggcgccggccacgaggacagccaccccaacaagatcgaaggcgacaagaatttgcccggtacccacccgcacgatgcttatcacggaatgcagtgcgtagagctcgaccatcacacacgcagacagaaggtacgcggagcagaccctttgcaaacggggctcccgccgccctccatcatccgtcgtgacgagggtcgagagggcggagacgactgcagaggtcaggtacatggcaacctggacgaactctccccagggggagttcgggaggaggaaggccgcctgtggaagtgtcgcaagcgcccagacgacggcagcggcaatcaggcccctccgcagcatgacgctgctggccctcaccctgccggacatccgcaccacacaagccatggcaattccaatcgcggacgcgcagagcctctcagccgcatcccaggggccaagcgcgactgccgaggcaagcaccagggcctgaatgagccagggcgcccaaccccagctctgcacatgccgcaaccccacggagcacctccccaagactttgaacactccgcaactgtacggcagggagggcgcgccgacgtccacacccccagccaaaacgacaagcgacggcaggaggctcaggagcggatggctcggcgaagccttgggccccgaggaagagggcgggcatgctcggaggaaagggaggcgtggtgagcctgactcggaccccaagggggagaggcgcgcggccgcgtcggggcgtccctctcccctgccggcggcgtcacgcggcgtccgggcccctgcccccggagagccggactcggagctcgcgcaggaacgccgctgcatcgccgtccaccagcacggtctggtcggcgatcgcggagggagcaatcgtctcgcccaggttcacctgcacgtaggtggccttggggttctgagacgccatgcgccagaaggggtatttgatgatgaccggcgtgttggcccccacgcccagctccagcagcaccacggagcccgactcgtgcgccgccacaaagccctggtagcgcccgagtgcggcgtgccagccctcgtcctccacgaacgtgtcgtcgcagcggaggttggggaccatgacccggccgcagcgggggcagcggggcaccagctcgctgggcacgcacatgtcgcgctggtcgcgcaccatgaggcgcacgaggtcctcgttgtcgtaggttgcctggtggcagggctcgggacactgcagcagtccgtagtccccctgcgtgtagaacaggcgcgaccggtcgattcccgcgcgctggaactggtggtcgacgttggtggtgagcacaaagtgctcgcgcccccgcagcatgcgaacgaggtcctggtacggacgccccacgggacacgcgtagcggttgacccagatcatgcggctccaccaggcccagcgggtctcgtcgtccgggaaggggtagaacccgcccgcatacatgtcggtgatcccaaaccggtcgcggaagtcggcaaagtccctctcgaaccgcggtcccgagtactggaaccccgcggcggtggagagacccgcaccggctccgaccagcaccgcgtccgcatgctcaatcgcctgagcgaccctatcgaccgactccgagaagctccccgtagagccgctgatccactggcttgaagacatcgaagaccacctccgtctggtttttcgtctcacgcttccacgcgcgcaccgtcgacaccgcgacctccgccgcctcccagttggggtagcggaactcccccgtggagatgcagcagaacgccacgctgcgcaggcccctctccaccgccaggtcaaggcacgaacggtagcagctggcgagaagctcgcggtcgcgcgccgtgggggcctccccgtacacgatcggtcccacggtgtgcaggacatgccccgccgggaggttgtagccgcgcgtcagcttggcccctcccgttggctcctcgtggccctgggcccgcatgatgcgcgcgcactcaaggcgcagctggacccccgcgtaggtgtggatggcgttgtcgatgcagcggtggttgggcacgaagcagcccagcatctggctgttggcggcgttgacgatggcgtcgacctggagcgtggtgatgtcgccgtgccacaccgcgagcccgtcgtccgtgaacccgaggtcgtccacacgcgtgacgccgccgcgctcggcgaggcgaccttgcaggtactcgtcctggacgcggagaaactcgtcgcccacgggccgcgggggcctcacgttgagaaggccgcgcagcaggagccgctggccctccccgtcgggaggaacccgaatcccgccgaggtcgtccctctcccccatcagcgcgtctatgagccacaggcgcctctggtcctgcgtcatcttgtcgtgcatgtggcctccccccacgtcccgaaacagggcgcacccaacttgtcatatcgttgttgacaggttcttgtaattattgactttacacgttttgtccacgcagggctccgtggaggcgctggcgacctttgccagaacgcccccaccggagcagcggtcacaagcagagcaaagatgggtgagatgagaacggtcccagtcaaacgaaacggggcccgcaagacggaacgaagagaaatcgcttacgggtttataccgtttaccgtcgaatactgaccgttcgcagtcaattaccttcgcttttcttcgcttttgtccgtttccttcgctgcgtgctatctttgtgaaggactcgtagtggatgcgtgaagcatccggacgaaggaaaggagcgcgagatggcagaagagcaggccgagacctacgacatcatcgcagcaaccggctgcccgaccggcatcgcccacaccttcatggccaagaaggccctggagcaggcagccgaggccatggggctcaccatcaaggtcgagacccacgggcaggttggcgtcgaggacgagctcacgccggcgcagatcaaggcggcaaaggccgtcgtggtcgcagctgacaaggacgtcaacgccgagaggtttgagggcaagcccatggtttccgtgggcgtctccaagtgcctgtcccaggcggcggcggaggacctgatcaagagggccatggccgccaagcccgagggcaagctcgccgaggaggttgccgccgccgagcccgagggcgaggaggagaaggaatccgtcggccacgtgatctacaagcacctgatgaacggcgtcagccacatgctcgtgttcgtggttgccggcggcgtcctcacggccgtctcgttcctgtggggcatcacgtcgtttgactccaccgcctccgactacaacagctttgccgccatgctcaagatcatcggcggcatcgcgatgaacctcatggtgccggtcctctcggcctacatcgccgagtccatcggcaagcgcccggcgctggtgcccggctttgtcgcgggcatgatcgccatcaccggcctgcccgtctcccctgacaccggcctgatcgacgccggtggcgccggcgtgggctttggcttcctgggcggcatcgtcggcggcttcctctccggctacgtgatcctgggcctggagaagctgctctctggcatgcccaagaacctcgacggcctcaaggccatcttcctgtacccgctcctctccaccttcatcgtcggcctggtcatgctcggcatctccggccccatggccgccatcaacaccggcatgatggacttcctgaagggcctggagacctccggccccatcgtcctgggccttgccattggctgcatgtgcgcgtttgacatgggcggccccgtcaacaaggccgcctacgtcaccggcaccgccctcctgaccgaggcgtcaccgccggcatcgtgaacatcgtcctgggctgcacccacatcaccgagggcgccatcccgttcatgaccaagaacatctggcccgtgatgcccatcatgatgtgcggctcgtccatcgcggccatcctcaccatcatgtttggcgtccacgaccccgcaccccacggcggcttcctggtcctgcccgtcgtcgacggctggtacctgtggctcatcgccatcttcgccggcgtgatcgttggtggcatcctgtatgtcatcttcaagcgcagcgagtaccacaagaacggcgacaaggttgtcgagtaggctatctctctgaacgccaccagcacgagccggatcgtctccccgtgggacgtccggctcgtccctttaacgacacgcttccccgccggcacggcggggacccatgggaaggacgaggcacgatgggcgcggcacgacgacaggcacgcatgatcgcagccgagaggcatcagcacatcctcgatacgctcgcagagcgctccgcagtctcggtgcaggagatatgcgagagctgcggggtgtcggccgtgaccgcgcgggcggacctcagcttcctggaggaggagggcaagctcaagcggacgcacggtggcgccgtgcccgtgagcagcttcgtgattccccgcgtaccccagcgcatccgcaagaacgccgccgccaagcacgcgatcggcctctacgccgcgaccatggtgcgcgacggcgataccattttggtggggtcaggaagcacgacgctggagtttctccactgcctccaggacctgcgcgagatcacggtcatcaccgatgactactacggccttgagtacgttgagcagcacctcctcaacgcgacccccgtgtgcacgggcggcacgctggggcggcagtactgtcacttctatgggcccatgctcgccgactcgcttgccaacgtctacatagacaaggtcttccttggggcggacgcctttgagccggactttggcttcctcgccgagtttgagcagacggcgtcggcgaaggccgagttcctgaggcacgcccgcaccagggtcatgctcatggactcgtccaaggtgggggcgtcccggtcgttcgtgcgctttgccggtcccgcggacatggacgtggtggtcatggaccgcgacccctcgggcatcgtgggggatgcgatgcgcgaggcaggcggcacgggacgcgtcgtagcgaccatgggttagggtcgcgacaagggggcgtcgcccctctcccccgcgcgaggaaaaagcgggaccccggctcattgcgagctggggtcccgctttgcacaaggagactattctcttgcctagccccgccccagctcctccgccaggtagcggcccgtcaccgactccgggcagccgcacacctgctcgggcgtgccggcgcacaccacgcgcccgccgtcctcgccaccacccggaccgaggtcgatcacgtagtcggagttgctcaccatgtccaggtcgtgctcgatcacgatgaccgtggcaccgtgctccaccagcccctgcaggaccccgaggagcacctccacgtccaacgggtgcaggccgatggatggctcgtcgaacacgtagagcgcgcccgcctggtccctgcctacctggctcgccagcttaaggcgctgcgcctctcccccagagagctccggcgtggcctcccccagcgtgaggtagccaagcccaatgtcagagagcacctgcagtcgcctcgagacgctgcggagcccacccaggcgctccagcgcccggtcaacggtcagctccatgagctgggggagagacgcgccgttcctctcgcccgcaacccctccgcctgtggggcggcgcacctcccacgcgacatcggcgtagcgcgagccccggcagtcggggcaggtgatctggacgtcggggagaaactgcacgtcgagcgagatcacgcccgtcccgtcgcaggtgggacaccgcagtgaaccggtgttgtaggagaaatcaccggcacgcagcccgcgctccttggcgtcgggcgtcttggcgaaggcgcgccgcaggtcgtccatcacgccggagtaggtcgccaccgtcgagcgcacgttggccccaatcggggtggagtcgatcagctccacgcgcgacacccccgccgggtcgcacgccacgaccgtctgggggagcgtcccgcccgccgccgctgcacgcagcgccggtgccaggcactccaacacgagcgtggtcttcccagagccggacacccccgtgaccgccaccatgcgccccacgggcacgtccacggagaggggtcggacggtgtggacctggttcgtctccaggtgaatcctcccgttctcgaaaacgtcgtcgggagtcgcgcggtcccgcacccggatgcgtctcttccccgataggaacggtgcgatgcgagagttgcggtccctctccacctccccgaccgtaccctgggcgacgaccgttccgccgttggcgcccgacccgggaccgacctcgatgatgtggtccgcgtggcgcagcacgcggacgtcgtggtcaaccagcaccaccgagttgccgtctgccatgaggtcgtcgaccactcccagcagcccctcgacgtttgcggggtgcaggccgatcgagggctcgtccagcacgtagaggacgcccgtggtgcggttgcgcaccgccctggcaagctgcacgcgctggagctcgccgttggagagggtcgagctcgcgcgatcgagcgacaggtaccccaggccaagctggcggagacgggcgacgggctctgccatcgagtccaccacctggtgggcgatgggggccacctcggcggggagcgttccctcgacccccgggagccactcggcgagctggtcgagggtcatcatggtggcctgcgccaggttgatgccacgcacctgcgggtcacgcgcggcggaggagaggcgcgtcccgtggcagtcgggacagggcccctcgcgcaggaacctcgcgatgcgccggtacgcgctctcggtcttggccttggccagggcgttctccaccgccgcaacggccgagtagtaggtgaagtcgagctcggtggcggtgtcggtcctcttgttgtggaccacgatgtggcgcttctctgcgggaccgtggaacacgatctcgcgctcctccggcgtcagctggtaaaaggggacgttggtgcgcacgcccatctggcggcacacgtccttcatgagcgaccacatgagcgtgccccacaccaccacggcgccctcgtcgatggtcttggtctcgtcgggcacgagcgcggactcgtccaccacgcgcatgaccccggtgcccccgcaggtggggcaggcaccgtcgctgttgaaggccaggtcctccgcgccgcgaccgtagaactccgccccgcaggtggggcagacgatgggacgctccagcgccacgttcatggtgggtgggcagcggtgcccattggggcaggtgtaggagcccacgcgcgagaagagcaggcgcagcccgttgagcagctccgtggacgtgccaaaggtcgagcgcacccccggcacggcgggacgctgccgcagggcgagcgccgccggcacgtactcgaccaggtcgacgtccgcgcgggcgctctgcgagatgcgccgccgcgtgtacgtggagagcgcctcgaggtagcggcggctgccctcggcgtacagcgtccccagtgccaggctcgacttgcccgagcccgacacgccggcgattcccacgagcttgcccaacggcacgtccacgtcgacgttcttaaggttgtggacgcgcgcacctcgcacgcgtatgcaggtcggtccatcctgtgccatgagccctcccctcacgccccggccgcaggcgcgaggggaggcggccatcagccctcgaacgggaagcgatacggaagccccagctcgtctcgcacctcgacgagctcgcgctgcaccgcctcgccaactggcacgcccttgtccttgcggtcaagccaggcgagatattccttctcccccgcagtatagatgcgatcgtatccgggggccttcttggaggcgcgcagctcgcggcagatgtcgccggcgatcttcctgaacgtgtcgcgcccgcagaaggcatcggggtcaacgacgaagaagaaatggcccaggtggtacatctgcggggagccgtcgggcgagacgcccgtgagcgccttcatgaactggcctccggcgagggcggcggagagtatctcgaccgttgccgcgtaaccgtatcccttgtagccgcacatcttgtcgtccggcccgcctccgagcggtgccagggccgccgtgccctccacgagcatcctcaggatctccttggagtcggtgacggacgacccatcctgcgtcacgaccatgcccggaggggtgggtttgccctcgcgcgcgtagtactcgatctttccgcgctgcacgatcgaggtggcgcagtctatgcagaacgggaactcctcgtcggtggggagcgcgaaggtgagcgggttggtgcccatcatgttctcgacgccaaatgtcggcgcgatcgacgggcgggcgttggtgcccaccaagccaatcatgccctccttgctcgccatcgtggcccaatagccagcgatgccaaagtgggtggagttgcggatggccccgcccgccatcccattggtgcgcgccttctctatcagcatcttcatgacgcggtacgaggcgaccatgcccattccgtcatgggcgtccgcgaccacggtggtgggcgtttcccgcacgatctcgaggtcggtcttgggcaggagggtgccacgcttgatgcggtcgatgtagatgggcttaaagcggttgcatccgtggctctcgatgccgcggcggtcgctctcgagaaggacgtccgcgcatatcctcgcatcgtcctccggcacgccgtatcccttgaaggcgtcgacgaggaacgagttcatgaggtcccagggcacgtatggtcttgtctccatgtggcactccccctttgggttggacagctcccacgattatcgccacgatcgggacggagggtgggcgcaccatgcgggagcggggcaaatgcgcaggcaagcgattgggatgcgattaatggagcttggcccaccacactgcatcaggcggtgcggtgggccgatgaagccgaaactatatgggcagacaaggcaggggttacttgtcaaagccctggaacacgggaatgcccgtatactccttcgcgtcttcctccctgttcagcacgcgacgggcaccggcagccatggcctcgagctcaaactcgccaggatacgccgtgaccggggcgatccaaccacacctctcctgaaccgcttcgacgagggcatcgctgtgcaccatcccgccgccaaggagaatcccgtcgacgtctccgccgagcacggcggccatggcaccaatccacttgcaaatctggtagaccagggtatcccagacccgggctgcctcggcgtcacccttctccgcccttgcctggacctcgcgggcatcgttcgtcccaagcaggttcacgaagccgccgttcttgaggcagagcttgtggacctggctcgcatccattccgctcttgatgagccccaggacctcgacgacaggtaggctgccgcaacgcgtcggcgtcatgggcccctcaccgccgacgatgtcattgccgtcaatcatgcgtccgtgctggtgcgcggaaatcgagatgccgccaccgatgtggcacaccacgaagttgcagtcctcgtacctcctccccatggaggcggcgtgcctgatggccgtctccttgaggttgagcgcgtgcagatggacgtgccggtacacgcccttaatgcccgtcatgcgcgcgcagtcgcagagctcgtcggtgtcggggggattcacaacgtaggcgggtttcccaccagcctcctctgcaaatgcggaggcaaggaggcttccgaggttggcggggtgctcaacgccgttggcccccttcgaggcatggtcgagcagcgtctggccaaccttgtaggttccgccctcgacggggagcagaccacctccacgtccgacgaacgcatcaacgtcctgaagcttgacgccgtacttgcttagcactccgagaatcatctcgcgcctgtagggaagctggtcgctcacatgagggaacgttgccaggcgcttcgcgtcgtgctcaatcgtagtggtgaacacgggcttctcgccttcgaacatgccaaccttagtggatgtcgagcccggattgatggtcaggaccctccatgcgcgctccgccatcagaggtcacctcccgcccggatgatcagcatcgcaacgttgccgagcatctcgtccactggcgcgctcctggagaagtcgcagactggcttcgcaaatccttgcaagaccgggccatacgcgttggcgtgtccaaagatctgcaccatcttgaccccaatgttgccggcgtgcaggttggggaagacgaggatgttggccctgccggcaacggggctctcacccctgaccttgtgcttcgccgccgccgggatgatggcggcatccagctggagctccccatcgcagaggatgtcgggccgaagctcgtgcacgcgctcgaccgcagagcgaataacgtcgatggactcgtgctcggccgagcccttggtcgagaaggccaggagggcaacgcggggctcccagccaaggagcgctctggcggtatctgcggatgagatggcgattccggcgaggtcggcagcgtcgggctgggcagtgatcgcgcagtctgcgaggccgagcattgagccctgcggaccctcgaagccggggatgtcggcgatgcccagactcgacggggactcgacgccatcagccaaccccacgaagctcatcgcggagaagactacgtcaccggtcgagcgctccttgccggctgcgacgcaatcgaccatcccgcacctgagcatgatcatgccgcagttgacggggtccttactcttgcgcaggattgccttgtggctgtactcgcccgcaccaagggcgtcgtaggcgttggcaagctcctccctgcacgcctcgtccgcgttgtcaaagtactcgaatccagtggactggattccgctctcattggcgaggctctccaccgtctccctgctgccaaccagcaccggggtgcccattccaagctcgacgacccttgcggcgcaggcgaggatatccacgctctcggattcggggaagcagacccgtgccggatgctccttggcgcggctcaccatcccctgaaggaactcgttcaccgtatcctccgtcctcgcatgcgcttactcgtcgagcaggtcagcgacgaacgccgccgcctcgccaacggtcttgcagcgcttgaactgcatgtagggcacctcgcagtcaagctcgtcctccaggtacgtcgtcatctgggagacctgcgtgctcttggtgttgtgctcggcgaatgtggtgtcgggcgtgatcgtggaggcatcgacgccccagaggtatgcgcagcgctcggcaagcttgttgaagatctcgtcactcatcgtgaatccctctcattcgttgtttgttatctcgatagttcgaactttctagcggtagatgtagtcaccgtcctgatagcggggcgggatgacgggaatctgcaggtaggagtcgtgctcgccaccggtgtagacgaggtggcgcccatagttgtccgtgtcccactggagcggctcgaaccagttctccctgatgtagcgaccggcgatctgcacgcggatctgctgccccttgtgccagaagcggcttgtcggccagatctcgatgtcgacggggacgatctcgcccggcttgaccttctcgtcgcaggtgtgcgcctggatgggctggaagtcggtcgagagcttctcgtcgagcttcctgcgagagatcctcatcttgccccaggcaccagggtgtggctcgccgaagagcgtgatcggcagccactcgccggtcgtcgagagcttctggacgttgatgaagaggtcggcgtcgttgtagctctcggcggcgacccagaggtgaagcttcatgtagcccgtgagctcggtgtcctcggggaagcgatagtcgaagcagacctctccgtcggcgctctcgtaggcagccatgccctcttccgcgacaggctccgccttcatcgacatgtcagtggcgtccaggtagagcttctcgtacttcgtgcgcttaagcgggaagctagtctcggggcggttctcctggtagttgtagtcaaaggcgtcctggacctcgagacggacagtcggggtgagctcccacccgttgcgctcgcctttgagatagcgcgcgaagaagcgctccagatcctgcaggttggcgttgttgtacgcgtcgggccactcgaagttgcggtgggcacgcagccacttcttgcgagacttgatcttgcggaacgcctggatggagccgcgcaggtggaagtggttccagcacgccgtcacatagacggggcacgtgatgttcttccagatggggtccttgtccttccagtaatcacagtcgatgaaggggtacttctcggagttcgccgcggtgtcatcgatgtagttcaggccgaccgcctcgcgcacgaccatgccgacgaaggtgtgcgcggggattccaccctccatgagggactcgcgatacatgtcactcgtgccctcccagggagcgatgcaggagaggtggggcggctgctgggaggcgatgcgccactgagtcatcgcgacgcaggagttaccagcaagggcgacgtgaccattgcaccaggcctgctgcgccgcccactcgatgaagtcgtagccgtccttgccctcctgggtgccaaactgcatgaagtcgccctcggaatgcccgacgccacgcggatcgacgttggcgaccgcgtagccatggcggcaccagtagccagggtcggggctctcaaacttggacatgttggagacagtctggggcggaacgcccatgatctgccagtcggactgcccgtcgaacggcctcttgccgtagaagctccaggagacgatcagcggcacgaccggcatgtccttgggcttgtagatatccacgtagatgtggatgccgtcgcgcatctcgacggacacgtcctgcatgcagatgattcccggctcgggctcatagacgcgattgttcagcggggtgaggaccttgtagtcctcgcgctcctcgggagtcatcgcgtcgaactcctccttggagcacggtttgagcatctgacgcatcagcacctcggtggggttgccgttgcagatgacggtctttgtgaccaattcacgagacatgtttcctccaaacgattgattggctatttgagctgatccctagtcctcggctttgctgccagcagagtgagagacgaggatgttgaccttgccgaagtacacaaagccgactatcagaaggaccgtgatgaaggcggcaccaacccagatcatcgaggtgatggatccacccaaaagggagccgagggctgccgtagtgaacggagagaggacctggccaagggacatggaggcatttaccagcgccatgttgaacgccatgcccatagcgctcgagaagttcgaggcgcccatgccgccaaagggggtgaagctctgataggcgagaccgatgaagaaaccagcaacgcagagcatgaggacgttggatgccagggcgtaaacgacgagtccgacgagagccatgaggaacgtgacggtaggcgcctgcttcttgaagatcttcatcagcggggccactatgatgccggcgacgatacccgaaagcgtgtaggcggaggagcccatacccgcctcggcggtaccacccatgccacgctcgaccacgagcagcgcctcgttagagttgaagagctggcagaaggtgtagagcgtgaatcccatgatgcagagcacgatcacctcgcggggaaccacgacgtgctcggtcttggtgggcttgggctcgagcttgcccttgggaaggcaaacgatctcgaggacgaagaagatgccaatcaggaagtaggcgtagaaggcgtgcgtccagtctccagagccaaatgcagtcgcagccgaggtgtagatgaagccacccaggcagacgaaggtggacagcaggccaaggaccgttccgcgctgctctccctcaaagtagtcggggatgatcgtcgtcatgctgttctggagtccgcccatggcaacgccgacgagagccgatgagaggagaagctctcccacggaaccgtgcaggtaaatgggcatggttcccgcaaagacgtagaaagccgtgaagaacagggcgctgtacttcttgtaaacgcgagaggcgagctttgagacgatgatgcccgtgggaattgcgatgaggctgggcagggtgacgatgagctggatctgggtgatgggcgcatcggggaagctctgcgcgatgtccgcgaggacggacacgggtacgatcaggcccatcagggcaagcgcacagctatagacaccaacgagcgtcttgaattttccgttcatgtgttttcccttgttagtgtttctcatagatcagaggggatttccgcgactgcgggggttaactgccttggacacctccccccaacttcgtgcctttgcgaatgaacaggcaatagagcacgaggccaatcaagagaagggcggcacctatgaggtacgagatctcgtagctacccgtgaggccagctgcctgggcaaacagcgccggacccgcagcacccacaagctggatgatgggctgcatgatgctgaaggagctggcaaagccctctcgcccaaattgctccgcacagatgttcaccggccagttgtccgcgctacccgtcacaactccgatgagcgcaaggcttgccatgacaagggtgtgctgacccgtgacgttgaggaggattccgacaatgccaaggacgaaggtgagaattaccccgacgcttgctccgtagcgatcgccgattgctccgcagacgatgcttcccgcgcaggcaaaaccggcagtcactatcatgccggcaagggcctcgtccatgctgtatccaagctcgaagaggcgcggcgcaatctgcaccataagcccgccggcaaagagaagctgggttccaaggatcagagagaggacgacaaaccccgtgcccacctttacatgtcccattttcggcaggtctggagagcagccctcggggcgtgccacagcaagcccggggttacgacgctcgcacggcatcatcgtatccggctcaaggcccatttgctcggggtagttcgtaatcccgaacacaagaaggagcagcgtgacgcccgcgatgatggcgaaggggaggtttgcgccttcaattccccagcgtccatatccgaacatgaagcaaaccgaggcaaagcccgcgcccaggggtatccccatggagacgattccctgcaccgtacccttgtactttgggaaccagttcgtgatgagcacggggttcgtgttgtagccccatgccgaggaggccgcgttggcaaggaccatagcaataacgaacagggagaagtccgtgctcacgcccatgaggagaatgcccaaaagatagatggcgccccaaatcagtgccatcatctttgcagagtggcgaacgcagagacgtccggcgatgaagccgcagagaacgttaccgaggctcgcaatcgagatcatcgaggtgattagcaccgcgtcccacccacgctccgaggcaaagacccctgccgcaacgttcatcgaacttgcaaccgtcgaggtgatgaagtagccaagtgtggaatagacgagcatcggccaggctcgccagattcgcgactgcttaaatattgaatgtttctgcataacctcccccagaactctctccgttgcttatcgttctgggggttattatgttgggcgtaacattgctggaacagaacgcctgaaccagctggtgttcgattcaaacatgcgatgaagtgcgtgtgcaaatcgaacactgcgtcatttacttgtcctgttcaaaatcagccgcttcatatctaatgaaacggtttatgtcagaggattcacatgctgaaacgagagcgcacgaagtcaaacatcatcgatgcatacatcaccctgctcggcaccactgacttcgacagagtgagcgtcaaatccgtctgtgagcaggccgatgtggttcgcagcaccttttactcctactttgacgacatggctgacgtgacacagaccgtcgaggacgagctcatcaactccttcaaggaggtcgtcgcctttgacctcgccaacctccaggcacccgtaacggagcaataccctgagggcggtgcccgaactgattgggggtttcacatcagcccgccaatcggcttcttcgaatggctcgatcgttgcgaggagaacggcgctcgtctcgccgcaatgcttggtcctcatggcgacgagtactttttggtcaagttccgcaaggtgctcagaaaccacgtgaatgctctcatggatacggacggaatgccgcacgatgagttacgcaacggattcacgaactcctttgtcgaagttcaccttctcctaacgaaggcatggctcgtcaacaaggaaccctgggcaaccagggatgcaatcgtgacggtactcaactcaatgcgcatagggggtaacacggcgggccgctttgaatccgacccccaaccaatttgatcagcggtattccttgcaatagcctcagtgataccccaattgaacgactggcacctgggagacgacatggtacttggcgtgggatgcgacgtcctcgacttcagcagaatgaagccgctggagggcaattgggacgacccgttctttacccgcaccttcaccgagcgggagcgacgcgactgcctcgcggcggacagccccctaacggcatttagcgcaaggttctccatgaaggaagccgtcttcaaggcgttgcgcatgaatccagacgacgcttcgttcggggagattgaatactctacggacgagctaggtcgtcccagcgtcaagctgttaggaaccatggacgtgcaggcaagaagccacggcctttatcggctacaggtttccgtctcctacgaaacgtcctgcgtcctcacgtttgccgtgttggaggcgtcgggctgacctcgcgaccacctctgcgccgatgcacatggacatcacccaacggcaccctcttgagccacgaaggaaaacgggcttctcccctgccctaccaattgccagccccatcgccgccgcatggagcgagcaattgtgtgccgatgaaggtcgattcaggtactcagataatacatcttgacctgaagttaggtttagattctaccttcatcctgtcggaagcaagagacaccagcgaacacggaggggaccgccatgatgaaggcagaggagctcacgctcacgcaggagtgggacaagacgtttccgcgcgacgagcgagtggaccatgacaaggtgacgtttgtcactcggtatggcatcacccttgccgcagacctgtacaagcccaaggacgcacggggcaagctcggcgcaatcgcggtgagcggtccgtttggagccgtgaaggagcaggccagcggcctgtacgcccaggagatggcagcgcgcggctttctcgccatcgcctttgacccgtcgttcacgggcgagagcggcggtcagccccgccgcgtggcctcccccgacatcaacaccgaggacttctgcgctgcggtcgattacctgagctgtcgcgacgacgtggacccggaccgcattggcatcatcggcatctgcggctttggcggcatggcaatcaacgccaccgccctggacccacgcatcaaggcgaccgctgccatgaccatgtacgacatgtcacgcgtcacccgcgagggttactttggctccaccgacagcaaggaggcccgggacgagcagcgctgcgcctgggccacccagcgcacagcggactacaaggcggggacgtaccggcgcgccggcggtgtcgttgacccgcttcccgatgacgcccctcagttcgttcgcgactaccacgactactacaagacgtcgcgtggctaccacgagcgctcgggcaactccaccgacggttggaacaccaccggaaccatctcgttcatgaaccagccactgctggacatggcaagcgagatcgacgcccccgtccttctcgtccacggcgagaaggcgcattcgcgctacttcagcgagggtgcatacgagcgcctcaggggcgacaacaaggagcttgtgatcattccgggcgccaaccacgtggacctctatgacaaccgcaacgccatcccgttcgacaagcttcagaagttctttggtaagaacctgtagcagcagaacgcacccgtcaggagggccacgcatgtacgaggaccaggaagagctcacgataggacagatagaagagttcctcgccgtgatgaacactggcgaagaggtggtcgcaggttccagaatccaccggatcatggtggctacgtccgagcgtgccatgcgaatcacctctcgcatgaacgctgagttcaagagcttgtccgatacccgggcgcagttggagaagctgtttggaacgcccctctccgagggggttgggctcttttcgcccttcaccactgactgtggtctcaacacgcacctcggggagggagtcttcatcaactccggacgccgcttccaggaccagggcggtatctacataggcagccgatccctcatcggccacaactgcatgattgccacgctcaaccacaacatggatccaactcggcgcggcaacgtcaccccctcccccgttcacatcggcgcagacgtctggcttggagcaaacgtgacggtacttccgggggtgaccatcggagatggtgccgtcgttgccgcgggcaccgtggtcgcaaaggatgtcgccccacggacgctcgtcgcgggggtgcccgcgcgggaagtcaggcgactctagcccaccaagtcggcaagggcatcgctcgggatacggaagctcgcgagccggtaaggcctagtcctctcgccgtcgatatgacgcctcgtccgccagcctctctcgctcaaagaccgaggccgctgccgcaacatactgctcgaccttccttaccttcctaacggcacgccagaccgagaccgggtcctcgaacgcatacttcgcgtaggaccaccactccttcatgcgcaagacggcattgccacccatctcgtcttcgtagccctcgaacaggaggccgtggaatctttcgagctcgtcgatggtggcggaggatccacccttcgccatccgtcccagggcggggttggcaaggatgtccctaccgagcatcactcggttcgcctccggaaacgcccgctcgagctcgttgatgtcgccgagggagaacatgtcgccgttataggtcacggggaagggggcccgtgcgagcgtctcgccaaacgcctcccagtgcggtgtcccgccatagccttcctccagcaggcgaggatggacgacaagctctgcgagcgggtgacggcagtagacgtccaagatcctctcgtactcatcgacactcgcgatgccaagacgggtcttcacggacaccggaatgggtgactcctcggtcaccttggtcagaaacgcgtcgagcccatctggatcgccgagaaaccccgcgcccttgccccgcgacgccacggtccgcgagggacatcccaggttgaggttcacctcgtcaaagcccatcttggcgagaagccccgccgcccaaacgaactcatccgcattcctggtcagcagctgggggaccagcttcggatcgggcgcctcgtcagggcagagctccctcaggtcgcgcttgccaaagccgcttcccacccgcgggggcttgatgaagggagagtagcagcggtcgagcgccccaaagcatgcggcatgggccgcacgaaacacgtgccccgttatcccctccatgggtgcgagcgacagaatcattagtccccctcgtacttgagacatccctctaccgaccccaagcatacgagcgtttgtccaacaatcgcgcgggctctccactcgccttttcaccccacgcagagaaaagcgttacgcccccgaggacgtctccggagaggtgccgctacaatggcagcgtattcgctggcgccccaatcgcctggcaggagggctcgtgaccagactgtacatcgatgccgacgcctgccccgtcacgcgcgaggcgctggcggccgcgagggcgcaccgcatcccctgcatcatcgccggcaactccacccagaacctcgaacggtacatccgcgcgtcggacccgcgtgagccaaaagacccctctcgccccgaccacggcttctgggtgaacacgattcaggtgggcgttggagcagactccgcggacttcgcaatcgcctccgccatcacccccgacgacgtgctcgtgacgcaggacatcggccttgctgacatcgtgctcggcaggggcgcacgggcaattggcgtgcgcggccacgtgtacaacccgctcaccatcgactcgatgatgttcatccgacacgaggagaagaaggtacgcagggccggaggaaaaaccaagggtccggcagccttcacggacgaggacagggagcgcttctcgcacaaccttgcccggcttctgcgagaagcgcgccaggtagagtagctagacgacagttccctacctcatagtcccaacaactcgctgtgactccccgtacgtgtggccacgagaacaaaaccctctaggtcaacgcgatagatgaggagccagtcaggctcaatatgacacccacggtgtccgtggtatgttcctccaagcgagtggtcacgcatcgcgtcgggcagcggttcacccctcacgagagtctccaggacgacttcgagctttgcgaggtctttgccttgcttctttatgcgcttgtagtctcgcttgaacttggacgtgaagctaagtcccagcatgactactcctcatcaagagcagctaaggcttccttgaccgagtcatagggaccagacagatttcttcccgtcaccgcatcatccattgccgctagggtatctgcactaaagccataggggtttgaaggatcaaacggaaacccccctcggcggttaaatgccgagacaaacatgcggatagcgttgctcggcgaggttccaatctcctcacacgtcatcgtaaagcggtctttttcatccttgcgaagctttgcagagatggattccgttgtagccgtagtagacatatctacttcttcctactttgtcttactttgtcacctaatgtattcccaccatctccctgatgcaacgctcaaaagccagatgccatgaggatgggtcttggccagtcttcgcactcgaaaaatgctctcaataacttctgtatccatggagttccacagaaaaccacgaacatgctgacaaccgttgaggccaactaggtgagcagcgtttggaatcctcgccagaaggcgccgcctccacctccgccatcgcctccgccaccgccgccggagaacccgtcaccagagccggaggacgaggatgtcgtggaaaacgccatgctcaggccagcccccattgatgtcgcgagcgccgaagtcccggagcccgcgccgcaccagatgtatgttgacgagaagtccgggtcatccaggatgtccggcacagcgaatccgagcttctccattacctgcttggagacacccagcacgacggccatcacgaggagacgattccatggagcaacgtcttgcaggatggcctcatcaaggttggtgaagtcgagaagccaccttctcggggcttccatcttggccttgatctcaatcgcgttgttggagagcttgggcatgcgcatgcttgtctggataaggataaggagcgcgatgcttgtccccagggtgacgccagagactatgaactggataagggcgtctctgccagaggcgccgccgagcgcaccaaagctcagcgacgagacgacaacgctcgccacaaggtagttctcgagctttccccggttggagcgcttgcgatcggtaaagaacctcctcgagcgcgccctctggctcacaagcttttccactctgcaacgtgattggcgtaggttcccttgtgacgccgagcagccctattcaggtcggacagcataatcgagtcgcacgtggcagccctaccctcatcggatgcgagcggacccagcttctcgaagaggagctcgaccgtctttacatcgatagggttgctgggctcgacaccggtcttcgtaatgcgatagtccgctgcgttcctgacgccgcgagccccttcgcccacagccttgacccgctcgatcttgacgactccgaggtcgctcagtcgcatgagggtggcggtcagctcgccccggtcataaattgcctaggcgagaaccgcctataggtagcgagccgccacgtggggctcgtttgtctggcaggcaacttgctgaatcgcgctctgacgtaaccggggagtcaggaccgcctccccccaagcaagcaaaacctgtgtgcctgtcatgaatagatcgctggatgtatcacttcctgatacattgttgagtgacacagagcacgccatcgcaacggcctttcagggacgggcaaggagacaggcgcatggatacaaagttctcgacggcaatccacatgctgattctggtgtccgaggccgaggttcccatgaactcggagcagatcgctcatagtgtgggaacaaacgccagctacatccgcagggtggctacccgcctaagccgggcgggaatcctcgagggacggcgcggagtgagtgggttttccctgctcaaggcaccagaggatatctctcttctagaggtataccgcgccgtggaacagaccgaggacgtccacgtgttcgacgttcaccagaaccccagcgacgagtgcatcgtggggcgcaacattcgccccgtgctcaacgggatgtttcgccaagcggagcaggtggtggagcacgaactcgcaggcgccaccctcgccgactgcacggcacggatgcgcgagcgaatcgagagtaacgagaaaagcgggaaaagcaccatgcgacaggagggcaaaggcagatgaaggctgcgatactggacaagtacgacaagaacggcacgactctggccgtgcgagatgtccccacccccgagccggcggcgcacgaggtgctcgtgcgcgtccacactgcggcggtcaacccgttggacaatatggtcgtccgcggtgaggtacgtctcatcgtcccctaccgcacgccgctcgtgatgggaaacgagttctcgggcaccgtagtgcagacgggtaccgcagccggcaagttcaagcccggcgaccgcgtgtacggacgcatgccgctcgcaaagattggggcgttcgccgagtatgccgcaatagatgagagagcactcgcgctcgtccccagctacctctccatggaagaggctgcctgcgtgccgctgaccgcgctcaccgccctgcaggcgctggacatcatgggtgcgcagcccggccagacgctgttcatctccggggggacgggtagccttggcgccatggcaatccccattgcagcacgcatgggcctcaccgtggcaaccaacggcagtgcccggaacgaggagcgcgtccgcaacctgggagccagcgtgtttctcgactacaagacccagcgctacgtcgatgagctgcacgacgcggactgcgtgcttgacaccctgggcgagcgcgagctgccggacgagttcagcgtgctcaagccgggcgggcacctggtgtcgctacgcggcatgcccaacgggcgctttgccaagcgagaggggctgcctacgctcaagcgggcactgtttggccttgcgggccacaagctcgacaagatggcagcgcgcaagcagcagacgtacgacttcatctttgtgcacgaagacggcgcacagctcgagcgcgtcgcggagctcttccccgccgagaagccacttgccgtgtcaatcgacggcatgtacggcctcgaccaggctaacgacgccctcgagcgcgtgaggtctggtcactcccagggcaagacgctgctgcgcatcgaggaggcgtagttggcgtaccttactacgggcaattcgtacgtggacgtaggcggcaagcacattgcataccgtgggcttgccgccggacggtccacaggctcatccttgttggcacggcacctcgtggcggcatgggggtcgatcgcgtaacgtccgtcacgtttcgccacatgctccacgcagttgccaggcgcaaggacatgaagcgctacatcttcttcacggacgacgcgaccggggaagccgcggtaaacgccacgttcgcgcggctctattccagggcattgtccaaccaggacgcgcccgtaacggtgcctgcctttctcgcccggctcggcgcaatcaagcgttggggcaaagcggcggaagacgacctgtcgttcgttcgcgttcccacgctcatcgcaaacggtgacaacgacgcgatggtccccacgcccaactcgaatgcgatacacgagaagatcgtcggcagccgactggtgctctaccctcattccggccatggatcgcacttccagtatccaaatgagtttgccggcgaggtcgacgaattcctgagctaacgccggcgtggaacgtgtcgcggccagcgttgcctaccgtttacccccacagaacgtaccgtgaagcgtggccactaaggacacctcatcttccatagtggcctcctcgtcacagagcgccgcaagcctcgcaatcgaatcgcctgggcagcagcccgcgaagacctttacgcgaacttcttcgtccaagaggcaacctcgtcccgcgactgcgtcgccccgtttcccgtgattgagaggcccttctcaaccgtggtgcccttgcagaccctcttcaggtgcctctcggagccatccatgccggagccctcatagcctctcagttccaccagccccgttagcttcatacttgatcacggccaactctatcccgcagataaagtccgctatctgctggagccggaagtccgcgggactacagttcctgcaggtatgaggaaggccgcctatcaacgtgataggcggccttcctccttgccgtgtgggtttgggctagctcagcggctccagctcgcggtagagcgggtctccgtcagccacgaggacatcccgccaccattgcggactctcgacgctcggctcgcaaagcgtgtcgaggagcttgctgcgaagctctggcggcatgctctctaagccttcgcgcatcgcgtcgagcatgtaactctcgggcgagtacaggcaaaggtctgcgcgtaagtaagccatgtcctcggcctgagtgagttcgatcgtctttgcttcgttgatgcatgcttaccatactgtgattatggcggttcaagttggcgaaactttcgctgggcagtccttaaggggcgtctccgttggtgctcatttgatgcttagatcgaagtggcgcccacgctctcgatgagattgcccgcctctccggcatcttgcatgctttcttgacaggtgaccgaacggtaactatactaggttaccgttcggtcacctagtatagagaggactgatatggaaccgagcacgaaggatcggatcacagaagcagcgctgcggttgttctccgaaaaagggtatctgggcgcgtctttgagcgatatcgcgaagcagatcggaatctcgaaggccgccctttataagcatttcgccagcaaacaagaaatcttggatcacatcgtcgcgcggatggatgagctggacactgagcgatcgcagcggttctccatgccggggaatgagctgggcagcactgctgcctataaggagattcccgccgagaagatccgcgcatacagcaaggcgcagttcctgcattggacggaggaggaattcccctcccgttttcgcaagatgttgacgttggagcagtatcgggattcgggcatggccgagctgtaccaaaagtatttggcaggcggccccgttgaatacatggcgtcggtgttcggtgagattacaggctctgaagacgcggcttggcagcttgcactggagttctatgggccgatgttcctgttatacggcttgtccgacgggggaatggacaaagcgcgcgcaatggagctgctggacgaccatgtaagccgattcattgaccagatagaagcaggaaaggctcgttgagcagcgggtaaggagggttcccaatgacaaagctttacttcggcgatacgaccaccatagccacaacgatcatgattcttggtcttgtcgtcttcatcggctacacgatcgtcaaccgcggcagtgtccagcactggggaatgcgggggctgctgctccttgcgttcggccttgtcgtttgctgtttcgcggcggctcgcgacgggttggacaagaccattcagtcctccatcgatgggagttgcgcggctgggttgttcccgttggtcagtatcccaaccgttgtagggtacattggcgcccttgtcataatcgcgtctgcattcgccatgctcatcgcgaactcgcaacaggctaaagaactctgcttttggtttatggcatcaggcgttgccgtgaagatcatgatcgtggaaatcgcgagagttattgcgctgtaaacccgaccgataacaaaatgcatggaaaggagcagccatgaactgccctgaatgcggcgcgagtatggaacaaggttggttgtttgccagcaaagacggcgctttcgggttcgcaagtcgggttcccagcgttttcgggaacgcgcggaatgccgagggtttcgtgcaaatcaccgaaccgaaactaggatgccgaaccaacgtgcgggcgtggcattgtaccgactgcaaggttgttgcattcaaacactagctcccgccacgctctgcgccgatacgcttgcccccgcccccaatcatgctcgacccgcaacgcccctctgaggccacgtgcaatctgcgcctactaaaaccgctcgtgctacaatacggccatcagagattaaaacacagtccccgtcgggtagtcgtgggcgtgcgggagtccgcatcagtaacctgcctccttggttgccccttctctgcatagtcatctacataggttccgtcaatagtttttcgcaaaaagccccacgggagctggggacgatatgacttcctgaacttgtgtccttagccccctgccgaccccctcacgtcccatcccccgaggaggctgacgtcgaggtacctcctggtaccccagtttccctcggctatgtacctgcaccgtgccgccgcgagcattgtgtttagtcaagcctgactttcgactttgagcatggatttctttcgggtccgtgcacgaaagtttttcgggtttcgtcacgggcccgccggcgcctccctaccttcccgacttcccgcccccggcataccaccccacccctcaccagcctgtggctcgggcccccgaactccacgagcctgccgtggtgacgacgcggtcgacgatcgccgccgcgagcttgtcgtccgcgaagacggtgccccactgctgaactcgacgttggtggtgaatatgacgctcctcctctcgtagctctcggatatcacctggtagagcagcctcgccccgtccacgtgaagggcacgtaagaattcgtccaggaccaggagcctcgcttggccacgtcggcgagcagcctgtcgagcgtcccctcgcgcttggccttgcccagctgcagcaccagctgggccgtctgccagaacctcacggggtagcccgcggaccgtcgcggcgatcccgagcgcggtggccatgtgggttttcccgcgccccgtctggcctcggtagaacacgaggtctccgcgtcgcgcacgaacgcgagagagcacatgtcctcgcgaccccagtcgtcggggggggaacgccacattcgacccagtcgaacccctcgatcggacttcggcacgggggaacctcgcctgcctgagcaggcgcgcccgcttcgccctcgtcgcggtgggcgatctccgactcgagcatcgccgtgcacgccgcgacctggcgggcgcgtcgcggagcgaggaaggcgcgatggtgtcgccggatatgaagagcgcccggcggcgtgcgtcgggaagggccgaccccccacctgcgccccggcgactccgctccgaggtccgcggcatggggtgttcgcctccctcgaggcagcctcagcgccccgtcgtagacgcccaggtcgacatactcgtcgtactcgaccgcgctcgtcgcccgcggcggaggcctggcagccgacagcgcgacgctcgcgcgatcgaggcgccctcgacgcggagcgagcgcgacatgccctcccacggcggcggccagcccgcgctcggcgctctcgtcgcgcaagcaccctcaggtcgggcggcgaggtctgccgggcgctcgggagtccaggaacgacacgagctccgccggcagcacgacctgacgctcgagtccctccaacccgcgggcctcgcgcacagcagcctgagctgcagggtcggatcggagctgtcggtcggggcctcgccccctcgcgctcgtaggtggcgaccaacctcaccgtgtcgagggtcgcagaccgtgacgtcgaaggagcacgccgggactccaccgccgacccggccgagcgcgcttaggcgggcccggccgagtagcggtgggggccgcctacggtgaaaggtgcttgcctgttgtgcaggcccctggtctccactcacgcacgaggaacgcggccggcccccccggcagcggcgagagaggtctttgtcgcccaagataaagtcgagctgggcgttgccgagcctgtagtggcgtttgccgcgctgagggtcgaggcagtcccgagcagcctgcgtgaacgcggagacgtcgggaacgacgggaagggcacgaagatggttcctccgtggccctgctccgatccttgttatcgacgttgccttctcgttgaccgagcgggggtggtgaaggtttagtcgaagccgtagtttgcgccgcgaagtgcgcggaagagctccgagagccgactcgcccccgaatcgcgccttgccgaccctcggttggcgtttgtcgaaagacggccctcctcggcacgccgccggcgaaactagaacacttgttgggagccgcctggcagacgcactcggcgtctcgcccaaagaaacctgggtgagccccacgtggcgtgcgggaggtgtacggtcaggtactgcccctgtgagggcacgccaccgtaaccctgaagtcgcctccccgagcgtcgatccaggactcgccgggcagccagctcagccgaaggaagccctgcggcggtccctgcggcacgctcccctggccatttccctcgggcggacgcctgacgtatcgctgcacgtgtgagtaggcagcgtgagcccagctagtcccgaagctctctacttacaccttcacggccgttggcgctgcttgagcttatagttcgtgcccagtcgtcgcgagccaggagtctatagtccccagtagggggggcgagcacctctgatctcggaggcttcctccctcgggggttcggggcgacaggtcgcccatttcctggccgtacttcctcgcagtgggctttacgtacttactgccttgtttactgccctcgcgatgcgccatcggcagcgacgccgcggccctccttgcgatatcctctatcttgtccacgccctattttttcatccctatggccctcctcacgtcgttaaccgaaagaatgaagcaacgactgatgggccaatcgcggcggtcgtttcgtgcccttaggttaacgaaccagtaatttttttcggctcagaccgaactttccgtacgctcaaacccgcaaaataaagaagcgatcaaaaaacaagcacgtggcgggcacggccgtaggggaagctgcgacgcctttttttgttttggtcctgcgctgtattttttccgacctgcgcgggcgcccgactcatgtgttggtgcggatttctcccccagcgctcgggagggaagcgcgagtaggcgaggtttctccatgccacccctcatcgggacgaccccagcggcttttcgtcgggggtgggcccccgaggtcctagtcgattcctcggccacctcactctgccttaggcgtgcggtacgccccgtgcgaataatggtgctgcatagcccctgagctgggcggcggtaaggccctcctgcgcccttcgggaccttcgcgaggcttttttttttttttttttttttttttacgtccccggggaagcgcgcaccgtgcggcgctggcgctccgcgctggggaggaccctctggacgggccccgaagcatccacgcgggtcgtcgccggcgaccagcaccaaccccgtgtatgaggccgcggtccccgaggcccagcaggaactcgcgccaggagccccgcgatctcctttcgtagcccccgactccatcgcagacacgacccccttgctgggcaaccccgtcctttgaggttgacgccgatggccacgagcgccgcgacgcccgcacgcaccgccccagtccctcctcacgaacgtcccgtcgagtggccggacgggttgccccgggggccagggggcctccgcccccagtttgtgttttttttgatgttcactaagaagtgacgcagatggtcaccggaaattgccgcatggtgagcaggaagaatcgcagattggcagagggaatgttgtttccgttttgtctctgttgcgcgtaaggggtcacggccagcactagtttttccgttcgtggcggagggaccatttggcaagaccctgcccagaaggaggaagggagcagaccgtgtggactgagactgtgtgagaaatgatggaaatcagacggaggacagggatggatttttccagtgcgagggcccaggacgccctgggagctccatctcagccggaaccaccgtcgccaataccgcggaccgcgagtgacatgtcgccgagcccgccgatgcctcagaggagggcgcatcccgagacgacggggatagagacaggtggatcgaagtctgcgtactggaaggcgcatgtagcgtttttttttttatcgtccgaggaagcagtgctaatacggccaggaggattcgacagtggcggtcgagagataggaattcggatcctactcgggggtccggaagagtatgtcgcagttcctggaagaaggagcggctccagggcgagtggttcggttcatcgagatgtgtgggccccagggaacccggcacaggacgacttcggaatacttcgttcgagtacatcgcagggcgcgcgtcacgctggaagctctgtggtcgtctgccgtcttccaaactcaccgcttgcatcgcacgccatgctagagggcagaggttttgatggggactgcggcaatagtcgagttgtgaatcgggcgcgcgccggcctgatagggctagaacaaggcaaacgaggaggggaagatgatgtcggcagggtcacggaattccgagctccttctagcagttccgggcaactacgctgcgagagccgcaatgcaacccagattccgggaacgagaagggatctgtggagaatgccgtcgggttctgcgacgaaactcctgtgccagtgaccgaggcatcgtcgcggacgagctcaatcgcgcatgctcagggcaaggcggcgacagagaatttttacgcgcaggcgcgtgaacagggagggaaggcatgcgcagaggttccagaggaggactgctgggcatgcacggcgttgcccggcacccttcgacgcagtgaatggacacaggcgaagtccgacaagctggatagtgcgcgccgacgccaacactaatgcgggacggcaaagatagggccgactgtcttgcttctggtagggatgcgcgaagcacaggggagctgctcgccgacccagcggaggaaggcagtcgccacgctcgcccgcagctcggggaagtcgatgcggttgcaggaacacacagatccctaagacccgcgctcgtcgcgaggccaccccgcgcgccttcggggcgtacgaccaaaggacgacatgcgca

SEQ ID NO: 418 - DNA, 24555 bp, Unknown
  Metagenome-assembled genome
acccggcacgaccttgtgggacgtgcctgcggcggttggccttgcggggagctttgcctttgtgggtcgggggcgcgacgtgagctcgcacaagcccgccccatgccgtacctgcgagtcatcgagcttggtgcgccaaacgagctgggattgtcgcggacggggctgggcggcgcggaccgtggtggtggaggactcggcccgtcccggctttgcctcgggggggctcgcggcggggtgctaacgtgtaactggttcacggggaactcgacgccgcatgacgttggggcggcggactaggtggtctcgcgctttagctggtgctggctataggtgatcgcggggctccgggctcgctgttgcaggcgctccggggggcgccgcccggaatgtctggctgaggaacttctcgagttgtggcagccgcgacggggtcccctggtgcttcggacgaacacctcttagaaatctctagtggtggcaatcgcggggggctaattccgctgaggaactgcgaccttttggcatgagggggcacccgggaccccgacaaaattccccggacctcgggtaggttccaggaaggagtccggtgatgtacacgagggatgagcgcgatggctctctgggagttccaccgagcggccctgatcgtgagccgcgccttcaggtatctcccgattttcccccaccagaacgttcctcgcggactggcttgctggccggaggcccctggcgagctcgtctcccgggagatgcccggcaggtcctgcctctggcactgcacgcacctagccttcgtccccacgatcgtcctgtcctcgtggctcggcgtgtagcctgcttcctcccccgtcgtggggacgggggcgagcgggacggggggccgaccttggcgtactcgagggccgcgtggcagacggactggcgcgactgggcgccgacctgccggaggacccgcggagcgggcgaaggatgaccgaggtaaagctcgccgatgcgctggcggtgttgacgtccctcaaagggcacccgcccctggctctttgaccagcgggggagaggtcccgtcgcggggcaggcggccatggaggccgagcccggcggtcaggctcgctgacgtctgcgagaacctctccatacccaagacacctacctcggccaggcggccaggctctcccgccccgacccgaaggcggccctcggcgcgcgtccgcgcgtccttcgaggcctcgcggcggcaccttcggctccgagagcgtcacaccgccgacctgaggcgcggcgagggcgagcccgtctcgtggccgacctcgcggaggcgtacgagggacgccggtcatcgcctccgagaagtcgtgaggccatcatgcggagagagggcccgtcgcgaggaaggcggcccagatgcgcaggagggcccagcacaacagctacgcggcgcgaactcgccccgaggcccgacaacctgccgctcggggaggacggcacgcacgacttccgcgccggcgagcccggcctgctctgcgtcaccgacttcaccgagttcgccctcgacggctacaaggcctacctctcgccccgcgagtcgactagctttcgacgaggcccgtctgctggagggtcccgcgctgcacccggaaaggagctcatggtgggcatgctcgggacctggtgggggccgtggagcgaccgaggcgcgcccgtctggtggtccacaaccgacgggcggggcggtgtacatgacgacgactgggcctcggcgtgcaggagggccacgtcacccgctcgatgtcgcgcaaggcgaggagccccgacaacgcaggtgcgaggcttcttcggacgctcaaagcgacttcttcgagggcgtcactgggacggggtccgcgttcgaggagttcgggacggctcgacgcctacttggtccgtggtctggtatcgtgacgtgaagccgaagaagtcgctcggctggaggacgacggcggagtacaggagggacctgggctacggctacacgctggcggcctaggtccggaaaatcgtccggggtccccccttcgcctgccactactcgacattcctgggcgggagcgggcctcggattgccacaactcgagattcctcagcacccagccgtccaagacggtcgggagacacccccacaggccacgcgaacgttggggaacgtagggggatggccccgtcgtaccgcgccaatgggctggtggcacgggcgaaagacgcagattgcggctgccagaggtaggagggtggggccgccggccccaccctccgcttttccgccctccccgcttcctacttcacgcggcaggggatggggcgcggcggcgtcttgggcttcttctcgcccgccatcaccacggctcccttggggcacacctccaggcagcgtccgcagcgcgtgcagctccgctggtccaccacgtggacgaagccgggcttgcccatgatggcgtcgtcctcgcaggcgtccaggcagtcgccgcagcccacgcacttggagaccaggatgtgaaacgtcatgaacgcccggcactcccccgcggggcaggtcttccttgttatgtgcgcctcgacctcgtcgccaaacgcgtccaggaactgcgtcgccgtccccgccatgcgccgccccacctcgcagagcgcctggtcggccatcacgggggccaggtcccggatcaggtccaggtcgcccgcctggcccctgccctcgcagatgtcggaggtgatcgccaccagctggtggccgccctcgtggccgaacacgcaacggccgcagccctcgtggtcgaactcctccatgaggtgcgcgagcgcgtgcgccatgcagctcttggaggtgtagacgcgcgcctcgtcgcacgaaagggtgacctcgcggcccaggtcggcggccgtcacgagctcgcactgcgggtaccccagccagacggccttcacgtcgcctgcgtccacgccagcggcggagaggagcgcggcgaccgtggtcgtggcgggcgaggtgaccggcgtcccgcccacgtacacgcgcttctccgcattgcccgcgagccacgcctccccgcccacgacaggagtggggccgacccccgtgacgcccgagggcagcggcttctcgcccgccagcacctgcgcggccgcagtgtcgttggcgtacacgtagccaaacgagtcatcgcacgcgacccacctgtcacgcggcaggtcactcatcagcccctcgcacgtgcgcgggaccagcagcgtcacgtcctcacggctcgcgcgccccacgacctcgcccgcacgctcgcgaaggaggtccgtcgcaaccggcgccgccttgctcgccggcatgaagttaacgatggtcatgctcgtcctccctcgctagtactcgttccaaaggcgcggccgctcgagcgtcaggcgcaggtcgcactgcaggcagcgcgacgcctcgcgcttggcttccccctcggtgaaggggcactcgtagggctcgaagccctggcgcctctcccccgccggggcgatctgcggctcggtcgggccgtcgtagaagccgtccggcgcgcggccaatgcgctggtccgccgcctcggggtccaggagcgtctcgcttatgtcgccgtccccgcccaggtagcggtcgatggcctgggcggactcgcggccgccctcgatcgcgccgatcacggacttggtgcccgtgacggcgtcgcccgcggcgaagatgccctccacgctcgtgcggtgctcgccgtcggcgaccaggtaggggccgtgcgtgagctccaggcccatctcgcgcgtgtcctcgggcctctggcccaccgcgaagatcacgtggtctgcgggaagcgtgagctctccgccctccaccagctcggtgacggcgcggtggttctcgtcaaagtagaacttggcgatcttgttgatcgtgatggagccgaccctgcccgagccctcctcggactcgttgatggacgtgaaggcgaaggcgtcgtggagagagacgccctcctcggccgcctcggcccgctcctcgggcgtggaggtcatggccgcctccgcctccaggcacgcgacgtcgacgctcgtggcgcccaggcgcaccgccgtccgggcgcagtcgtaggccacgtttccgccacccaggacgaccacgcgcccgctgacgtcgaggggctctcccttgcgcgccgccttgaggaagtcggtgttgcggatgacgcccttgaggtcgtggcccttcatgggcaggaccgtcccgtcgaaggtgccgacggtcacgagcacggcgtcgaagccgtcgaggagcgctcggacgtcgcggactcgctccccgcagcggagctcgatgcgggggtccgggtcgtcgccctgcgtcacctggaggatggtctggacctctccgtcgagcacctcgtcgggaaggcggtacgcggggatcccgtagcgcagctggccgccggcgcgaccctccgcctcgaacaccgtgacccggtgacccttctcggcgaggtagtacgcggcggtgagaccggcgggaccggcgcccaccacggcgacgcgcctgcccgtgagcgggtcgtgcctcacgcgggacctccactcgcccgtgtcgcgcaccgcggcggcgcgcttgaggcggcagatggagaggggcccgcccaggtggttgcgcttgcactccccctggcagttgtgggtgcagatggagcccagggtctgggggaacggcaccctctcgcgcaccacggccgtggcctcctcccactcgcccgccctgacgtggcggaggtagcgggggatgtcgatgtgcgcggggcagccggagcggcacgggaccacgttgtcctcgcggctgcgcccgggcttgttgaggcccaggacgtccacgatggagccggtggggcacacctccacgcacgccccgcagaagcggcagcccgcctcctcaagcgagacggcgccgtctacccctatgcgcacgccctgctcggtgcgctggtagtccaggacgcccacgccgcgcagctcgcggcaggcccgcacgcagcgcccgcagcggatgcagcgcgtgaacatgtgggtgatgagcgggttggagtcgtccgtggggacggtgcgcgcgcggcagcgccaccgggcgggcgagacgcccatgtactggtacatggactgaagctcgcacacgccgtacttggggcagcccgtgcaatcggaggggtgcgtggccaggatcagctccatcgccatcctgcgcacgcggtcggcgccgtcggagcgcgagtcgaccaccatcccctcgcgtgcggcggtcttgcaggcggggaccacctcgtcggacccgtccacctgcacggagcacaggcggcagccgcccacggcctccaggtcggggtgcttgcacaggtgcgggatgtacacccccgcggcgagcgccgcgtcaaggaccgagtcgccctcgcgcgcctcgacctcccgcccgtcgatcgtcaacttcaacgtgttcccctccgtctcgtgtccgcgccggcacgtggctcccccacgcccgtgccgtgcgcgcatgtggtgcggttggcaggcgagaggagcctcgccgccacggttgccgcccgacaccgcggggcgttgggggcacggtggcgcggctcctctcccccgaccggcggcacgccgccgacgcgtcaccacgccggcggcagtgctggcagccctcagtcagttagtcccactcgtcgtcgccggcggactctgctgcccgctgggaggcgttctcgcccgcgatgcggccgctgttgaggcagaagcccatggtgttgccggggatggcgtagttgtaggagtcgccgtagatggtgcaggcgtcggtgcccacgcagtacagaccggggatggccttgtactcgtcggtcatgacctccatgcgctggttcaccaggacgccgcccagcgttccgtaggcgcccaggtactgcctgcagcagtagaacgggcccgtctccaggggctgcatgaactcgcgctccttctcaaagagctcgtcgtagccctcgtggcacatctcgttgtactcggcaacgttctggacaaggccatcgggatcgatgcccatcttctgggccagctcctccagggtgtccgcctgcgcgatcacgtgctggccgttgccgtccaggtaggtgtccaggtcctgctgccactgggcgtcgaagccctggtacaggtccttggggtgcacgtggctcacgatgtcggggccatccttcttccagtgcctgagcatcttggagtcgaagatggagtagcccaccttgccgggcaggtggttgagcgcgttgcccacgaacgtggtgttgaagatgtcgtcctcgggcatgaagcgctcgccgttgcggtcgcaccagtagcagggctggcggaaggcgccctcaacatagaagtggttcatgttgtccgggagctggtacatcatctccatggtcacgggcgtgtggccggcacccacctcgtggcacatgttgaagccgtcgccgtccatgccaggaaccgcgaacgagtagaggttcttgccccagtccaggccgatggtgtccttgatcatcttggcgttggcgccaaagccaccggtcgccacgatcacggagctgcaggagatgtcgacctcctcgccatccttggtgacggccttgaccccgcagaccgcgcccgtctcgtcggtcacgagcgacttgccgggggtctcgaacatgaactccacgcccagctgggtcgcgcgctcggtcatgcgcttgatcatcgtggtcgccgcgcgcgggccgggctcgctgccgtcctcgggctgcacaacgtgccaggtgtactcgccgtcggcgtaggcgcgggtgcgctcgcgggcgcggaaggcggggcgcaccgagttgaagacgacgcccatgtccatgagccactggatggtgtcgccgctcttgaagtagtaggcgcgcaccaggcggggatcgacctggtagtgggtgtagaacatgtgacggcggaagagctcgccgggcgtgacctcgatcatcgaggccttctggacgggagagcccgccgcgcagggacccatgcccatgttggcggcgccgcccgtgttggaggccttctcaagggtgatgacccgcgcgccaccctcggctgccgcgatggatgccgctaggccggagaggcccgccgcgacgacgactatgtctgtctcgagctgctgtgccatgatctacctccgtgtttgggacaactgcatacgttctgtaacccacacatggataatttcgcagcactcgcccccggggactatgtgcgcgcgtacaaaagaaaggcgtctcgcgatgcgtttaccgtgcgagacgaccgtcggtttccacccgggacgagcgacacagagggtcggcgctcaaccgcccgctcttggtcacggggacgtcggtttccgctcggggcgcgccgccaagaggagacggaccttctcggacaccgggcgcaaagcgagggccccgcgctcgctcgcgcggggcggctgcccgccagcaggctctccctccgcgacccagctggcggtggaagccccgcgtgagcacttcttcgggagggctgctggcggactcccgcagccccatggcatctgcgcaggtaaaggactcatagaaaaacggacggccctgcccgggcagcagactccccgcgtgagcgctcgcgcgggcgacttcctgcttcggtccatcgccgggaccgcgtggaggtgctcacgtgggccaactgccgccagccggccgcccccctccccgccgacggcagccgcttcccgatgcgagcactcacgtcaggagtctgccgccgccgcggcttcctttctgatgtaaggccacctggggaggcgcgccccgccggggcctccgtggcggcgggagccggatgtgagcgcacacatccggagtttgctgccaaccgggccccctgtctggcccagatggcagctacttcccgatatgagcactcacttcgagagcctacttccatggttgcaagactgatggatatccaactgggaaaacgcgacgtgtacgagcagccgtggcagctagggtcagggagaagtgcgcacatccggagtctgctgccagtgggccttccgcgggaggcgcccagcccgtcgcggtggccctcccctgcgggaaggagccctaagacgggggtcacggtggcccgccgcgcatggaggggtctccttgcccggaaggcgagcgccccgccccattcttagcccgccgattccccgccgtggtcgtcgtggctcggggcccaggctgccggatgcctcgaggtgccccgtgtctaaaatctcgtcccatgtgtacgcgcgatgggcgaattccgacggggagggggctttccgccgcctggaggctgcccggatgtcagaaagtccgccccgcgtgtacgcgcggggcgaggtattagacggaggggagcctcgcggcccacggctgtcggaaatcgcgttccgtgtgtacacgcgggacgcgatttccgacgagggaacgccttccgcccatcgggaggtgggcactatgccagaaagcgcgtctcacgtgtacacatgcgacgcactttctgacggagggtcgtcacgacggggctgacgacggagcttgctgctccttgcagggaacctgccctgcgatggcacacttgcaagcccaggctaggcacgacccgccccattcttagcccaccgattccccatcgaagccgtcgcggcccggagcccggggtgccacgcgtcaggtccccgccgcgcgtcacccgaaggctcgaccgggcaggctcgtctcgccccggacctgctcgttcccgccatcccgaccatgctgtgcgtgcgcacaaacaacccagacccatccgagcccaattttggggccgggtgccatgggaccctccgcgcgccgaccgtaacctaaatgcccatgagtcctacgcccgcgtgacggaggggatgcgcaacggcgccgtctaccccgcacgcgcgacacccaccacgagagcccagggggcagccatgtgcgaatggaacaagcagatgatcctgaacgacctcatcctcgccctggtgatcaacaccagcgcgacccttctcgccggcgttccgctgacgtgggcgaactggtacccctacacctgcgtggcgttcaccaccaacgtcgtgggacagctcgtgctccccacgggggcgtgggcgcgggcggcaacgaggcgcatggctgacgggacgggcaggctgctggcccaggtgttcatcgagaacctgatattcgtcacggtcatctcgctcaccgaggccgtgacgcaggtcggcccgtcggggatgctcgcggcgtggtcggcgacctacctgcagctggtggcaatcggctacgttacgtcggtggcactcgcgcttgtgggcgagaggcgcgcaagggcgtagcgctgagaggtcgcccagcttccggcgcacactatgtcccgggacacaagggggcggcgcgcgggtgtctcccgcacgccgccccctctccatgccaactagcagggttcaaccactggcggagaggcgctagagaaccgccatcgccgcgttgtacccgtcgtggatggcgtcgcgcacaatcgtcgcgcggctggagttgcccacgttgaaggccgtagccccaacctccttcgccgccgcgatcaggtcgcccgccagctgtgagttgggctccatcccaaacgagtacatgtacgtgtccgcaggaatcaccaggcgctccccgccgggcgtgcccttgtcatccgttgccctctcgcagacgaggccgtcggcggtgaactccagaggcaccgtcgagagcagctgcctgatcccgcgcttgtccatctcgtcgaggagggcgttgcggtagtagccgaacgtgctcggggttatgcggggcttgcgcacgaccatcgtgacctcatagccaaggctcgccaggttgagcgcggtctcgcaggccgtgaggccaccgccggcgatcacgatggagtgaccaagctcgtccaggtggtagtagctatccgcggcgtccatggcaagctccgagccgggcagcttgcagccacggttgtgcgcccccactgcgacgatcaccgcgtcgggggacataccccggatgtagtcggcatccaccgtggtgttgagccgcacgtccgccccgctctcggcaagctcgcggcggaggaccccgatgaggtcataccactcgcgcttgtcgtggtcgtgctcggagaagaggaggacaccaccgagcctgtcggacgcctccgcgagcacgacgtcgtgcccgcgacgtgccgcggtgatcgccgcctgcatgccgcccacgccgccaccgaccacgagcacgcggcgcctgcccgtgggcttgggcagccggtcggggtagaagcccaggccagactccgggttgatggagcagtcgcccatgactgcgggactgtagaccttcatgaactcctcgggcggcagctggtaccagagggggatgtcggtcttgtgctcgcagaagccggggtagcagtggaagcagcgcacgcagcggtgcaccatgtcctccctgccgtcgagggtcttctcgatgaacatggggtcggcaaagcactggcgggcgtactcgacgaagtcgaccttgcccgcggcgattgcctcctccgcctgggcgacgctgttgaacccgccgatgaccgcgaccaggctcttgtgcaggtgtcccttgatggcggccgcgcgctcgaggttgacgccgtggacgtcgaagatgtcgctgaacgtgtcactgccgttgcctagcttcttgatgccgttggacacgtggaagatgtccacgaggccgtcgatctgctcggcgaagccgcaggtgtcctcaagcgtcatgccaccgggttcgccgtcctccgcgctcatgcgcagctcgatgaccctgtcctctcccacgcccgcacgcaacgcctggaggagcatcctcgggaagcgcgagcggttctcgatggagccaccgaactcatcggtcctgtggttggtcgcgggtgagacgaactgctggatcaggaagccatgccctccgtggaggaggaccccgtcaaaccccgccgcagtcgcgaagcgcccgaggtcgaagaagtcgtggcagaccttctccatcatctggaggtccatgccaaagacgtgcctgccgtcctcgcggaccatgtcgtcgggaccccagggctggtcggcgtcgtccgcctcgagcccctcgtgggagaactcgaagtacgcgagggcgccaccagcgtggatgcggtcggcgtactccttggccttgtcgaagtcgctcccgtagtagtggtggacatcgatggcccggtccatgaaggcgccgcggctctcctcgaagtttgccgggagctcgccggtggagacgcagccaaagccgccctccgcacgaatgcccaccatgcggtagatgttctcggcgatctgcgggatgaagtaggcggcgtggaagaacatcgtcggcgccgcgatgagcctgttcttgtagacgttcccgcgaatctcgatggggtcgaagacgtgcgggtaccgcgcggccccaggccttccctcatagagggcacgcgcctcgccgaggctcctgacgaccttgctctggacctcttccggaccttgctttcccctctcgggcatggatcctcacctacttccctgttgcgtccgacgcggcgtcgggggtctgcccggcgcccttcctgcccttttctccgtcctgcggaagcggcatcaacgccgccatcgcacgctcctttccaaagatcgcgccgcagactgccatcccagagagcaccagcgcggaggcgagcacgagcccgtagcagaagaagccgatgaggtgcaggggcgtcagcggcacgttgagcatgaacacgaagaacgaggtcgagagccccaggaagatgctggggacgttgccgaagatggtcccctccagcaggttctcgtgcgtggtcaggatgaggaagatgacgatgatggtgggcaggacgttcgagaggaacaggttgtctccaaacgccgagaagagctgcatgacgagggcgttcaccatcgcccagaggcagccgcagacatagccgacgaccatcgacgggatcttcttgaagtccgccccgagtgcgaagaacaggaggagcggcaggaagagcatccagatgtagctcgcgtacccaaggacgggcatgacctgcatgagcagcgtcagcacgattgcccccgtgagcgcctggacgagtttgatctttcttctatcagacatcacatgctcccttgaacgtcgggtttaccagctattagtacgcaactgcctattcgaagcaggcgaagccaccgaagaccggctcgcccgtgtatgccttgaccgtctcctcgcccgagagcgcgcggatggctcccgccgccatggcctcgagctcgaactcgcccgggtacgccgtgacgggggcgatccacccgcaggcgtcgcggatgtagtcgaccagcccctggttgtggaccatgccaccgccgaggagaatgccgtccacgctgccgtggagcgccgccgccatggacccgatgcacttgacgacctggtactccatggcgctccaggcgcgccgcgccgcctcgtcgcccgcgtctgcgcgctcgcacacctcgatggcgtccgaggtccccagcaggtcggcaaagccgccgctgcgctggcagagcctgcgcgtggagtcggtgccgtgctcgcgcaggtaccccagcacctccaccacgggcaccgcgccgcagcgcgtgggggtcatggggccctcgccgcccacgatgtcaaacccgtcgatcatcctgccgtgacggtgcgcgctgaccgagatcccgccgccgatgtggcacaccacgaagtcgcagtcctcgtatcgcctgcccatcgacttggcgtggcggatcgccgtctccttgaggttgagcgcgtgcaggtgcacgttgcggtagacgcccctcatgccggtcatgcgggcgtcgtcacacagctcgtcggtgtcaggcgggttcaccacataggcgggcctgccgtaccgctcggcgaactcgtgggcgagctggctccccagctgggcggggtgctgcacgccgttcgccccgcggcgggcgtcgtccagcaggcggtcgtccaccgcgtagacgccgccctcgagcgagacgagcccgccgccgcggccgacgaatgcgtccacggtcgagaggtccacgccgttctcgcccaggatcttgaggatcatgtcgcggcggtacgggagctgtgacgacacgtccccgatctgcgccagccgcttggcgtcgtgcgccacgctgctggagaacacgcactcctcgccctggaacaggcccaccttggtggacgtggaccccgggttgatcacgaggatcctgtaggtctttcctgccatcacttctcccccctcgcggcgagcgcctgggcgcgcacgcagctcatcacgacgttgcccacgatctcggacaccggggcggagcgggagcagtcgcagacgaccttcttgaagccctgcagcatgggaccgtaggcgtttgcgtggccaaacatctgcacgagcttgacccccacgttgcccacgttgaggtccggccagatgatcacgttggccctgccggcgacgtcgctctggcggtgtaccttgtgcgcggcgacggcggggcgcagcgcggcgtccagctggaactcgccgtcgatcttgaggtcgggccggcgctggttggcaatgtcgcgggcatcccgcaccttctgcaccatgtcgcccgcgccggagccgtcggtggagaaggacagcagcgcgcagcgcgcctccctgcccgtcagggcctcccaggtctcgcacgcggcgatggcgatggaggcctcctgctcgggggtggggtcctggcacacggcggagtcgccaaagcccagcagctggccgtcggggccctcgtagccggggatgtcgaagatgcccatggacgagacggtgtcgatgccgtccgccaggcccacgatggtctggccgcccaggatcacgtcgcccgtggggcagtcgatgccgccaaaggtgatgtccacgtcgcccagggcctgcatcatgagggcgcgctccatcgggcgggccacgcggcggcgcacacccttgggcttccaggggcagctcgggagcgcctcgtagcgctgggcaaaggcctcgttggcctcggcgtccaccaggtcgaccagctcgaccccctcaagcgagacgccctgggcctcggcgttgtggcgcacggcctcggcgtcgccgacgacgacgcacgccgccagcccctgcccggcgagctccgccacggccctgatcatggtggggttctcgccctcgaagaacgcgacgcgctggacgttggccctggcgcgcccgcgcatgtcttccataaggtccatctgattccctccgttttttatgagagggggcggcccccggagggaccgcccccaaggtcttctcaaccagtgggttgtgcgtgcgaccgaggcgggccggagctactcctctgcctcctcggcaactcggtcaacgagctcgccaaacgtcttcatgttcatgatctcggacacggtgacctcggcgtccagctcgttctcgatcatcgacgtgagggcgatcatcttcatggactgcttgcccagctcgtcaaaggtggtgtcgggggttatctggacgtcggtctggtaggcctccttggcgagacccgcgatggtgtcgaacagcttctcgtctgccatgatgtgacgcttcccttctcgttgggcgcttgggccccttgccttcctgatgccggcgggacgggccgctggggcggccggtgtccctctcccctactcggcgacctcgtcgagctcgaagcagggctgccaccactcgaccatgacgtcggagccctccttctgggggacgacgcgcttgatgggcctaaagtgcacgccgatggactcgtggcccttgtacaggcgctcctgcaggcccttcacgaccttcttcttgccgcagaacacgacgaacgagtactcggccccctcgtccagcctgaccttgccgtagccgtagggcgcgaccgccttgaggtagggcttgtcgttctggatgccgggcaccacgaacgactccagggtgccgtggcccgagagctcgacccactcggtctggtggtagccgcaggcgttgcagccaaggtggggcgggaactcgatggcgccgcactccgtgcacctgcgccccagcagcttgccctccgccactccgtcgtagaacctcttggcgatgggctccatgtcttcaagtagcatttctcgtacctcccaaaggggtttctcgctcggcgggctagtcgtgcgtgcgcaggatctggcagcggatgttctggccgccgccaaagccgcgcaggaacgtggtctgggggaccttgggcatctgcgtggcaccggcctcgccgcgcatctggcggaccgcctccacgatgtccgccacgccggaggcaccgtgcgcgtggccaaagttgcagcggccgccgtgggtgttgatgggacggtcgccgtcaaagcccatgcggccgtcgatggcgtactgccaggcctcgccacgcgggatgtagccgacctcctcggcggcgacgatgtcgcccgccaggaagaagtcgttcacgaacaggaggtcaagctcgtcgggcgagacgcccgtgagctcgtacacctgctccacgccgtcgcgggtgccgttgtactcgttgtcaggggtggcgccctcgtaggcggcggcaccggtgcccagcacgtcgatcaccttgtggtcgagcccgcgggcaatggccatgtcggtgggcatgaccacgatcgcggcggctccgtcgcacttgatctcgaaccccgtcacgcgcaggtactgcgtgaccttggggttgccgaagcccttgaggtaggcgtcggcgtcggggaggttgttctcggccgcaagctggtcgaagtccttggtggagaacgccagcgggttgaggaccgcgtcgcggcgcagggactttgacacgccgttgagcgcgtcgtctatctgctcggccgtgaggtcgtagtcccagcggtacttgttgatccagttgtcgaacgagatgccaaaggcggagtcgaacgggcggccgtaggcgcggtcgtacaccttggggatggacgggagcatctcggacagcgggaagtcgcggcggaagcagcccggggcgtcgaccacgggcagcgacgcggcgaggtcgacggcgcccgagagcaccacgtcgtacgtgccgcaggccacggcctgcacggcctcctgcagggcgacgtagccggtgcagcacgcctcggagtggtgcacggagccgatgccgcgcacgccaaaccagtcggccacctgcatgttgggggtgagggagtccccgatcatgaacgggttcgcggcgccgtggtagaagtactggatgtcgcggggctccaggccggcgtccgcgatcgcctcaagggccgcgtagccaaaggcgtccccctcgctcatccccttggtctgtgggtggtcctcgaagttcttgaacggggtgcagccaacgccaacaatggacacgctgcgcgcctgcttgccaagcttgaccaaaccgatcactcctctgctcgcattccgaagtgggcttctcttgcctgcgaggctcaggatacgggcggcaaaatcggacgcgcgggacatctgagcggaggctgtcccgcgatgcgggacactggcaggccgtttgtctcttctcgctggtagacggccctcatgggagacgcacaaagaatcgggcccccctgcgcccgccttcgtgcggtcgcacaaacgcgcaggtagactgtggtgtcttcggtcgccccggagacggcgtcgcggctcgcgcccagacgcggcacgcgcgggcgaacggggcctatatgcccgcgaacgggttgcaggggaagtcgctggcgctcttctcgtcgacgaagaacggagagtagtacaggcggttgagcatccccgccacttcctccggcgggatgtcgggccgcttctcgagccagtactggatgaggttgttgtggccggcaatcacgaacgcgaggtacaggtcgcgctgcacctccggcccgcccatgccctgcaggcgtatgcgaaagtactcgtgcatgagcatcgtcgccttatgctggaacgccgggtccccatgggggctgttgagggcgacgatcctgtcgcgcttctcccgcagcacctccatgcggctgatcatggcctgcgtcggccgaagctccgccttgtcaaactggatcttgagggcgctcttgttgatggttcgcatggtgtccaggatggagccctcaaactgcttcacgacgtcctcgacgctgtcgtagtgccgatagaaggtcgagcgagagacccctgccaggcgaaccacgtcgcgcaccctgacgctggtgatgtccgtggtcttgatgagctcgaagacggcgtcctcgatcctctcctccacagggggcgtcttgtctcgcctctcgtgagcacccttcttcaccacgcgatcccccgcccgtcgccgtgcctggattccgcccgaatatatcgcaggccgttcgcccgggccatgccttggtggccaacgaatgacgcccgatttagcctatcctttgtgtgtccgcacatatgaggaaagcgagcatccttggaactcaacgcactgttggaacgtctcccccaggactccgtcgccgagaagagcctctccgacccgggcgcgaccattgacaccatcgcgttcttcaccgaggtggacgacgggccgcagcccaacgtcctctacttcacggacgacgtgacgctcccgtccgagcttcccgacacgcgcatgtacaacgtggtgctctttggctgcgacaagatcccctccatgctcgtagagagcccctcgtgcaacgcggtgctgctccggggggaggtgaatcccttctcctgctacaaccaggtgcagcggttcttcctcgaggacgtcagggtgaccgacatcgtgcgccgcatgctcaccgcgcacttttccaaccgggggttgcaatatgtggtggaggaggcgtcccgcgccctgggcaaccccatcgtggtggtggacaccgcgtttcactacgtggctcgctactccagcgccgagccggacgccacgcaccaggcggaccgcgtgctctcacaggagtttctctacgagtcggtgctggaggagggcatcaacttcatcaagcgcgagaaggtcaccgagaggtgcgcccagcagagcggccccgtcgtcatctacaacgacgtcctgggtgcgaacaccatggtcacgccgtccgtggtccacggggtgacgatcgcgcacaccatgatggtcgagcgcaaccacccctttggcgacgtcgacgtcgagtgcatggcccggctggggcgcttcgtggcgcaggagatgcagaagaccagcctgtacgtggcaagccgcgggcagatggactcgtacttcctggtgaacctgctcaacgacgagcagcccagccacgccgtcacggcgaggaggctgagcgtcctcggcttcaggcccctccccaacttctacgtggcggtcatacggcccaaccacgccgaccttgcgccgcatgacttcgactccatcgcggcgcagctcacgggctgcctgcagagcagcatctacgcaacctacgagcacgcactggtgattctcttctcgcgcgaggacgacgccaggctggacgactacaccgacgggatgctgcgcaaggtcgccatggtcaacgacctcacggttggcgtgagcaacgcctttaacgacctcacgcacatccgcagccattacgagcaggcgtgcgccgccatcgactgcggcaagatcgtctccccctacctcgacgacgggtggctgtaccactactgcgactacgcctacgtgcagatgctcgcgctcaccaacaggcagctcaacctcatgaacttcgtgcaccccagcgtcatgcgcctcgcgcgctacgaccgcgagcacggcacggagctaatggacaccctcttcatctacctgcagaacgcgggcaacacgcatcgcgcggctaagatgctcaacctgcacaagaacaccctgctctatcgcatggggcgcgtacgcgagatcctggggatggacctgacctcgggcgaggaccgcttcctgctgcagctctccctgcgcgtgctgttccacctggacctgttccagtcccgcatctgcacccgccgcctggacttcaccgagtccaagcgggaggagcagcccgccaaggggaagggctaggctcgcgccgggcagtcgggcgcatgccaggggaaggggccgggcgcctgccgtggcacccgaccctctcgcctgtagcggacgtaccgtctcgccctgctatcccgttgacccgctgcgcctagacggtggggaacgtcagggagcggaagtggtcgaaggagtccttgtaggcatccttcttctggaagaactcgatgcgggtcttgatgatctcgttgaggtgctcggcgcgcgccttgtcgtcgttgcggtcgcggatgagcccgttctcggcgatcttgagcttgggacggccggtcttctcgtcggtcacgaggtcaccgccggcgccgcacaccgcgcactcccaggggaactcgatgccgtcccagtgcctgtcgccggggtagaccaggctggagtggcagttggggcacacgccgtcgtccgggtcgccgagccaggtgcgctcctcgaccggcgtctccatggcctcccagatgtgctcgcccatctggcggcagcgctccacctgctccgggaaggtgagcaccgagcccgggcgcgcggagcgctgaatcatgtagcggtcgaccacctggagggacatggtgaacatggtggcctgcaggctctcgagggagagcgtctgccagtcgtgcatggagccgccgacggagatgaggccggcgacggtgtgggggttctccttcacgacgccaatctggagcaggaaggagagctcgtaggcgaggaagcgctgcgcgaaccgcgtgtagagcgagctgggcgtgaggtcgtaggtggggacggcgatcaggacgccgttgcaggtgtgcatctcggcgatcaggcggtccacgtcgtccttgtccttgaggacgcagcccttgtactccttctcgggatgctgggcgatctcgcccatctgcatggtgcacccctcgcagccggtgcacgggaggatgttgtagtcaaataggttgatgagctcgcactccgcacccttgtcgcgcagcacctcgagcgccgccttgagcgcgatctccccgttgccgccgtgcatgcccgcgcagatgcccattaccttgtgctttgccatagggacccctctcctgggacgtgtagtggcgtgcgcggcctcggcaccggaatgcccgcggcccgtcacgcagtcggcttgatggtatgtggggaggacctcccggtaatcgtctgcgcagatgaaaaacggtgcgaaagtgatgcccgcgttgtgcgtgcgcacggtcttccgggcggcgggcgagcggaggggaggctcggggcgcgctgggacggcgccccgggcccccggcacggatggctgctgagaaatctcgagttgtggcagccgcgacggggccccgggggccattcgggacgacgcctgctttggaatgtcgagttgtggcaatctgaaagcgccaaacccctctgaaatcgagtctgttgtgtcccagagggccagatcattgccacaactcaagattcttcagccgctctcggcggaactgccccttgggattgccacaactcgcaattcttgagcacccaaccaccctggaggtggcgcgcggtgggctcggatggcatgggccaccggtttctcgtacatttcgggcccggcgcgtcggacccagcgaccgccatatcgggaccagcgcggcaagcgctcaggacagcagcgcgatcgccctcgccatgggatgccactcgaccgcgacggagggctcctcgcgcgtggcgaccgacacaacgtgcgcacccagcccaaatgtcgcgacccgccatccgggaggcaggtgcccgccgcgcacggggtagccgaagccgcagccctcggccttgagcaccgcctccacgcgcgtccaggcgcgggcgaacgcgagcgcggggtcggcggattcctcgaccagcacgaggtcgcgggccgagagcaccatcccaagggcgctccgctcgcgacggcagaaggcgggagggacgcactccacgtccacccccacgggtgcgtgggcggtggcgaggacggcgatgccgtcgtcgtgggagatgccgatgtgcgggtcgcccacgacgagctcgggtttgccgccgggcatcgcggagagtgccgcgtcgtcccgaacgcccagcacgctggcgagcagcagcccggcggcgaactctcccaggtgcgagggctccggcgcgggacccgtcgcgcgctcacggtagcgcggggcaaccagccgcaggcaagactcccagtccctgggggcgtcgcccagccgcatggcgtgcagcgtcacgaagtttgccatgggcctctcccccacccgtctgtctttgcgagacatctcctggcaccaagtgtaggcgtcgcgcctcgcatgcatgcggctcgagaggctctgcccccgacatcgagcggaggctggcagctaccgcgccgccccgtacgtcatctcgtggagccgggtttccatgggcactgacacggtcagatcatgcgcgccggaaaaatccccattttccagttgcgcggagcggttccttcctttatagtagctaacgcgctgtgcgaccccacgcaccgcgttcaacgttcgggcgtttagctcagggggagagcgcttccctgacacggaagaggtcagaagttcaaatcttctaacgcccaccacacattcgcaggtcagaggctatgttctctggcctgttttcttttgccggggggccgccaaagtgcgccgacaccatgcgccaaaaacgtgagtagtcggcttaaacaaagggaggaggaaccgctttcgcgagcctcctaccgatattttttggcgaacctaaacatcgccgttgcttgaggtctaccctaagccacggcagacctcagacgttgccccagacgctgccagatgtaggcgtcgaggttccgacactgcgggcgggtgagttgacaccacctcgccgaaagtggcgtacgcccagctctcgtctgaagcatcgaggcgcacgtctcgcgaggggtggtgagggggttctcgcagcgccgattgtagccgctgcaggcatcgtcgtgcattgtcgatgccgcactgttagcgatttgcgtagaccatgcgggcgagcgtgtagtgccgtccttctagttgacctccctgcagcggcacactgcgggccctagcctgcgtaggtcgtgaggggaagaggaaacggcagcgtctccgcgacctcacgtcatcggggccgggggcacgaaggggccccgcagcccgcgctgcgcatactgtccatcgccttatgggccagcgcgtcctttgaatgtagggcacgatggcgcgttggtcttccatggtcggaacggcgagagtcctacgcctcctaccagagggcgcaggttcggtgatgcaagaacttgcggaacgcagcggttcgcaggcgggacttcaccggacagaaccaccggagaacgcgaaccaccaaggtgctagcagaaacgaaacaaacacacgacacgctgcaggcgtagcgcgggtctagctcatggggcaggtcagggttgtgccaacgtgccgccagctaacatcgagcgacccgacgggagatacgacaggccccagctgattgggataggaagcgcgcacccaatgaggctggcgaggagaaggccagaccgcgagtaggggggcagtcaactcgccgcaacgaagggagctactgaaatgggcgaaatcaggtacatgaaggtgcgacgcgagttctacgaggggctgaatgcgctcccagaggctcggccggaagttgctctaacgcatgcgtgggctatttcttacgggcgagtgcgacctcacggggaagctgcggcagcttttcgacttctcgcagaggggcaaaactcgacaggtccgcccctcggtcctcaacggcatgaagaacggctcgaaagagagggaaagtcgatggaagtgatgggtttctgccaaaagccgtcacttgttgaaaaagcggcctcggaatttcctcgagttgatcgcacaccacagcgctctacctgcggaaaccagaaacccgggtacacacccagacccccacgatggtcggagaccagtatagtaagagcaagagtaatagcaaggtgaggtgagggcgtcgcacacacgccgtccctggaagaggttcagggagtacgccgaggagcagggcatgcgatcaccccggaggtttcacgcactactacgaggccgtcggctggaagaggacggctcccccacacgatggaaggctcttgagaggaactgggcaaggagcgagggcacctcgcgtgcgtggaacgggaagcccctagaggacccgacatgtccagctgtccgctgtctgagaggaaggcagcgtttatcggcgctatcggcgcgtcatgagaggaaaggaaggttggcaaagaggaactacgagaaggccgtgagcgccctgatggcggtgccccacggccaaggaggccgccaaggcggctggcatcggggaatccaccctccgtgcctacaagtcagaccagagttcgtggagctatacaaggcggcgaggcacgaactcatcgacgcgggggatgaaatccatgcaggagcggttctcggaggccgtggagaccatctgggaaatcagcacgacggggacgtgcccccaaacgtcaggctcggcgcggccaactccatcatcaaaactgcgttcgactccagggatgtggagcgccatggacggggacgccctgaaccgcaaggcgagcagggcaatgctcggagacacctactcgttcacaggtgtagtagcgacgattaaggagaacaccatgggctacagggattcggtcaacaaggctatgacaccatcagcaccgctgctgcgggcgtctaggcgaagattgacgaggcacgcaaattcaaggagggcaaccgaaaaaacctgcgtgaccgcatcgtgggagaggaggggttcaggctcaacgatgccgcctacgacaggcagatttcggacgccaattgcatgcg

SEQ ID NO: 419 - DNA, 142579 bp, Unknown
  Metagenome-assembled genome
ccggatactgcgatcgatgagatcgacaagtgacagcagattagcgaagctcgaacagaggttcaaacacgaacgtcgattcgggcccaagcgaattccagatcagcggttctcaaggttcgccgccgcccgccgggcccgaggcccccgtgcggcgcgaggaacaactatacgcggcgggccgccccgcggggccgggaaggcgcgcctccacgggacgcacacaactcggcactccttgagccccgtccaattgttccatatccttttgtacccctctctttatctgcccctttctttgtaattaaaagatggccgcccaacggcggccatcttccggctaacggctatctatcggaaagtgccaaggagcacaccgcatcgagcagtccatccctttgctccggagttggagcttcggcatatgccctgacgacggactgcgcccttgagggtcggagcatgacccaagagtcatcttcgaagccaagcttcagcccatccgcatggctgatggtcttaggcgcccttcccgccacctccctggggttgagccccggaagaacgtttctaaagctctgaaccagggcaggctccaggcgcaggtccttccttgcgtaatccatgtggccgttctcgcttgcgatctgatcaacaaggccacgaattcccttgccgcttgcgcaggccgcctcgatggcgagaagcgcgacgagcaggccatcccgttccatgaggtgggtcggaaaacatattcctccattctcgtcacttgccatgaggacgtctccgaccttcgcctccgcatagaggcgctggaagccaacgggtacggaggtacattccaacccgagcctctccgcctctcgactcaccctcgaggagctggccatggtcatcaccacgcgccctgacgcccccctttccagcaccacgtgtcgcatgatgaggggaatcgtgtcgtgaggcgagacgagcctccctcccccgtcgacgaccgcagaacgggcgcaatcgccgtcgatggcaatcccgaggtccgccccactttgcaggaccgctcgttcgcagtcgtcgacccatggctcggtcacgcggggatgaatcccctcgaagttgggcctgtcggacgagtggatctcagtcaccttgcaccccagcttgcgcagggcggacgcaaacccccctcgcgcggggccaaacatggcgtcgaccacaacgctgggggtgacgctggaaatcaacccgccgtcaacctcgcccacgagcgcccgatagtacggggagacgaagtccacctccgtgaacgccaccctgtcggttggcgcctccgccgaaatcccccggtctatctcgtttgcaaacgcctccgagatggcgccgccatcctcgccccgggcaaggatcccgttgtagtcgcagggagcatcagatgccgtaaccatgaccccgccacagcatgacgcatcgtttgcaaccgcccactcgagcgccggcagcgggcacggcacgttactcagacgcacgtccaggccaaagcccgcgacgacgcccgcgacgacacaggcgaacgagcgcccgtcctcgcgggtgtcataccccacaagcaccctggccccttcgtggcgagagccccaaacgagcccaaacgacgaggcgagacgcgcgaccgactcctcgtcaaagccgtcgcccacgcgttcacgccacccatttgtgccgaagtggatgatgcgcatctgccctccgggacttagcgaagctgctctatcgccttgtttccgagcgcctcgaggaagaggtccctcgagtcggggtcggcaagggccatccttgcgttcgtagccgcccatgccgcgggagtgcccgtgtcgcagccctccgccgggtcaacgaccagtgcatacatctcctcctccgcaagaaggcgctgcatcgcgtcggtcagctggatctctccgccggcaccgggaccctgagtggcgagaagctccatgaccctcggggagaggagatagcgcccgacgatgaagaggtgagagggggcatcctccggggccggcttctcgacgaggccagtcaccttccagaccgccccctccttctccccagtggcgttcctgtcgcccagggacccaacggactcgcccgcaatgatgccgtagcggctgacctggtcctcgggaaccggagcaacggcgatgaccgaggcaccgccgtgcatcttcgagacctctgccatcttcacgcacatctgacggtctggcacaaagtaatcgccgaggagaacgaagaacggctcgtctcccctgagcatcctgctggcgcagaggaccgcatggcccaagccctttgcctcgcgctggtagcagaagctgacgggcagggaacctgccgcatggatctcgtcggcctccttctccttacccctggcgcgcagggtctcctcgaagccgccatccacatggaagtaggactcgatctgaggcttctccggagagttcacgacgatgacgccatcgacctcctcgggctcgagcgcctcctccacgacatactggatgaccggcttggacagcacggggagaagctcctttggggtgcccttggtcgcaggaagaaaccttgttccaagtcctgcggcggggatgatggctttcatgggcagtcctttctgtcgctctgaattcttcagataatcgaggagccctactcctcgacgttgattccctgtgcctcaaggtactcaagccaccggttttgcgtgtcgagcgagagggcgtgctccatctggcacgcctccgcatccgccacgtcgtgctcgacgccaaggtcgcgctccaggaaggacctgagcatgcggtggcaacgccacacgtggcgcgcgtaagaccgcccagagggggtcagctgaacacgcccatagcggttctgctccacgtaccccgcctccttgaggttggcaatggccttgttgacgctcgccttcgatacgttgagctgctccgccacggtcaccgacttgatgccgtcgctctcgccggtctcctccatgatcctgtagatggattcgagatagtcctcgttcgccatcgaaaggttgtgctcgggcttctcgccctgagttctgggcatgcgttccctcctccggtcctcggggactcgttcgcgtggggttatacccaagcccccgcgcgacccgcacgccccattctatagacggatggcgacgttcgattatttttcattctcccagacggcaaacggccccccagcccgttcgtcgggcatggggggccatgcacttcacagtagcttcatggggcgagagggactagggctcctccggatccggcacctcgagcctctccacgtgcgcgccaagcgactggagcttggggacaaacctctcgtacccacggtcgatgtggtgaatctgggagaccgtggtgtagccatcggcaacgaggccagccatgaccagcgccgcgccgccgcggagatccggcgctttgacctctgcccccgagaagccaggcacaccgtgcacgatggcgtggtgtccctcgattcggatatccgcacccatgcgttggagctcgctggcgaacatgaagcggttctcgaagacgttctcggtgatgacgcagctgccatcgcccaaggccagcaggcacatggtctgcgcctgcatgtcggttggaaagccggggaacggaagggtctggatgtcgatagacctgatcgggccctctcgccaggccgtgcaccgatgcgcgccgcgctccacggaaagccccatgctctcgaacttcttcagtaccaggccaaggtgcaccggctcaaagcccttaaccgtgacgggccttccacagatgcccgccatcgcgaggaacgttcccgcctcgatgcggtcgcccacaacgcgatgcgtcacggggtggagctcctcctttaccccctcgacctcgatgacgggcgagccggcaccccggatctttgcccccatctcgttgagcatgttggcaaggtccacgatctcgggctccctcgcggcgttgtcgatggtagtgatgccatcagcatggacggaggccatcatgaggttctccgtcgcgcccacgctcgcgaactcgagtgtgaccgtgtttcccttgagtccattggggctggttgcatggatgttgccatggtctatctggaagttgacgcccagggcctcgagcccgaggatgtgcatgtcgatcttgcgggcgccgatgttgcaaccgccgggcatggctacgacagccttgccaaagcgggagagcagcgggccgaggacggctgtcgaggcgcgcatctgcgcgacgaggtgatagggcgtcttccacttggtgacctgggacgtgtcaatgactagctcatgctcgttggtcacgtcgatttttgcaccaaggtacttgagcacctttcccatgacatgaacgtcagagatgttaggcacgttggtgagcgtcgtgactcctggcgccatgatcgtcgccgccatgagcttgagggcggagttcttcgcgccctctaccgtgacctcgccctcgacgggaaacccgccctcaacccgaattacttccactcaatcctcccgagaactacgcctgcccattctcggcagccgtcttgagcaggagattacaccagttgatcttgttgtcgtagtacgtgcgcctgtgatcgccctcgggaatcttgtcccgggcatcaaaggcggcctcgcgcgtctgacgaaccacgtcgggctcgatgtcgttggtctcgcgggcgtggtcggcaaggatgatgacgccccgctcgttaatctcggcatacccacccgagatcacgaccttgcgggtatcgccaccatccttgtcgagcatatggagccgcacgaccccatcgcccagggagcagatctccggcgcatggccaggccacacgccaagctcgccactgtgcgtgaccaagacgaggctcttgacaggcccctcgtagaggagcctgtccggacgcacgaactgacagttgagctctgccatctgaccttccctactcgctgtccttcgcttcgtccttcatcttgcgggcgcgtgcgatgacgtcgtcgatggtgcccgcgtagcggaacgcctgctcggggatgtcgtcgcacttgccgtccacgatagcggcgaaggaacggacggtatcctcgacggtgacgtacacgccgggaacgccggtgaacttctgcgcaacgtggaagttctgcgagaggaactgctgaatcttacgggcacgggcaacggtgagctgctgctcctcggagagctcgtccatgcccagaatcgcgatgatgtcctggaggtcggagtactcctgcaggatctcctgaacggccatggcgacgcgatagtgctcctcgccaacaatcgaggggtcgagggcggagctcgagctggcgagcgggtcgacggccggatagattcccagcgacgagattgcgcgcgagaggaccgtggttgcatccaggtgcgtgaaggtcgtcgcgggggcagggtcggtcaggtcgtcggccgggacgtagaccgcctggacggaggtgatggagccctccttcgtcgaggtgatgcgctcctggaggtcgcccatctcggtcgcaagcgtgggctggtagccgacagcagagggcatccggcccagcagtgccgagacctcggagccggcctgcgagaagcggaagatgttatcgatgaagagaaggacgtcctgtccctggtcgcggaagtactccgcggtggtgaggcccgcaaggccgacgcgaagacgggctcccggcggctcgttcatctggccgtagacgagacaggtcttgttgattacaccagattcgctcatctcgagatacaggtcggtgccctcgcgcgtgcgctcgccgacgcccgtgaacaccgaggtgccgccgtgctcctgtgccaggttgttgataagctcctggatcaggacggtcttgccgacaccggcgcccccgaggaggccagtcttgccgccacgaacgtacggctccaggaggtcgatggatttgatgcccgtctcgaagatctcggtctgcgtggtgagctcttcgaacgcgggtgcgggatggtggatggggtagtactcgacgtcgtcgggaacctctcccccgtcgaccggctcgcccatgacgttccaaactcgaccgagcgtggaggggccgacgggcatcatcatgggatgcccggtgtccctcaccttgagcccgcgctgcaggccgtcggtcgaggacatggcgacggtgcggacgacgccaccggggagctgggactccacctcgaggacggtgctgaccctgccgacgggggtgtcgtcgtcgaccttgagcgccgtgtagatcgccggtaccttgtcgtcgaacttgacgtccacgacggggccgacgacccggacgatggtgccctggcccacgctcctgttcaactgcttgtaggcggcctcctcaaggggggtacgcgcctgctctttggtttctgacattacttgtcctccaatgcggaagcgccgccgatgatctcgttgagctcggtggtgatggcaccctgacgctcgcggttgtacgtgcggttgagtgtctcgaggaccgactccgcgttgtccgaggcggacttcatcgcacgtcgccttgccccgtgctccgccgcagcggagtcgaggagcgcatgatagatgaccgtcctgaagtatgcgggcatcagatagcccaggacctcggacgcggaaggctcgaactcgtagttgtgggcgtaggtctgcccgatctcggacatagcctcgggattgcggggcttgttgggcatcatcagacgctcctgcgagatggggagcagccgctccgtcacctgcgtctgctcaacgcggttcttcgcgtgccagtagagaatctcgacgcgatcaatctcgcccgactcgtacccggacatggcatacgtcgcgattcgatccgcctcgtccatcgtgggctcagaggagatgccaacaaaggagaggacgggcttcaccttgcgatacgtgaagtactccgtcggcttgcgcccacaggtgatgacctgggacttgatcccgcgcgacgcgagctcgttcatctggtgctcgacatagcgctgctggaggatgttgaaccctcccgcaagcccacgatccgaggcgacgatgatgaacaagacgcacttctcctgttggtgaacggtcagcaggggctgcgacgagttcggcgcagagccagcgacgttcgagagcatgttggtgatagcgtccttgtaggccgtggcctcctccgcccgcttcagagccttctgaatgcgggcggtggagatcatctccatggtgcgcgtgatctgcatggtactccggatggagcccattcgcctcgatatttcgcgaaggttcgccatggtgtgctactcctgggcctttcctgcgtcctcgtcctcggcaacgaccacgggctccgcgttctgctccacgtcatcctgcttggccttgttggggtgctgcaggaggaactgctccttgaagtgagcgatgtgacccttgagcctctcggcgagtgcgtcgtcgatcttgccctggcggacgagctcgcggcaggagggatgcttgtcctgcatgtacttggcgagcttgtcacggaagagcgtgacgtggttgaggtcgatgtcgtcgatgaagttctccttggcggcgaagatcgcaatgacctggtccgccacgtcgagagccgagtaacggccctgcttgaggagctccatcatatgggcgccatggttgagctgatactgcgtcgccgcatcgaggtcggagccaaactgcgcgaaggcctgcttctcgctatagctcgccaggtcgaggcggagcgtaccggcaacctgcttcatcgacttgagctgagcgtcgccaccgactcgggacaccgaaatgccaacgtccactgcagggcgctgtccctggaagaacaggttggtctgcaggtaaatctggccatcggtgatggagatgacgttggtcggaatataggccgagacgtcgccctcctgggtctcgatgatcgggagtgcggtgagggagccaccgccgttggcgtcagacagcttgcacgcacgctccagaaggcgagagtgcagatagaagatgtcgccgggatatgcctcgcgtccgggcggacgatgaagcgtaagcgacatctgacgataggcgacggcctgcttggagaggtcgtcgtacaccacgagcacgtggccgccggggtgctcggcgtcagcgggattgccgttctcgtcgttgtacatgaagtactcgccgatcgcggcgccggccatgggcgcgatgtactgcatgggtgcggaatcggctgcggtggcggagacgatgaccgtcttgtccaggacgccctgcttggcaagggactccctgatgcccgctacagtggatgccttctggccgattgccacgtagatgcagatgatgtcggtgtcgcgctggttgacgatggtgtcgatggcgatggccgtcttacccgtcttgcggtcgccgatgatgagctcgcgctgcccacgaccaatggggaccatggcatcgatggccatgaggcccgtctggacgggctggcagaccggctgacgctccatgatgccgggggccttgaactcgatggggcgacggtgcgtggtgtcgattgcgccaaggccgtcgatgggctgaccaagcgggttgaccacgcgaccgagcatggcatgccccacggggatgtccatgacgcgccccgtggtgcggcactcgtcgccctccttgatgatgtcgacatcaccaaagagcaccgcaccgacctcgtcctcgtccaggttctgggcaaggccatagaccgttcggccgctgctggagctcgtgaactcaagcagctcgccggccatcgcggtcctgaggccagagacgtgggcgataccgtcgcccacggcggtgacgaccgatgcctcctgctggtcaaccgtggcattgatcttggacagctggctgcgcagcgagtccatgatctctgtcgagctgatcttctctgtcatgtcacttatcacttccgacgaaggtcgaaccgagggtcttgcggatgttggagagctgcgccttgatggaggcgtcgaagcgctttccgcgtgcctcgatgactatgcccccgaggatgctgggatcgacgcgctcgacgaggtagacgggggccttgagttgcttctcggccctctccctcacctttgcgcgcagatggtcgtccatgggcacggacgtggtcaccgtgacggagaccgtcttgtcctcgctgtcaaggattgacttgtactcgctggcaaccttggtaacgaggtcgaggtcgtcgctcgcctgcattgcgctgagcgtctcgaggacctcgggtgagaacttgcgtgcatgctcccattggacaaggtcagcgttggccctgccctcggcacgtccagcctcaatgagggcgcgagcgtaggcttcgaccttttcgtcttcgctacgcttattgctcatcgggtgcgctcacttccgcgaggtacttctcggccagcttgcgctgctcgtcctcgctcaggtcgttgccaatgatcttgcttgcgatctcgaccgagaggtcgacgacggagctggagagctcgatcatcgccttcttgcgctcggactcaaccgcgccatgcgccttgacgacgatggcgcttgcctcgtgctgggccttggcgagaatctgcgaacgctcctcctcggcctccttcttggcgttggagatgatctcctccgcctcgcggttggcctcggcgatcctctcctcgtaggcgcgggcgctctcggtggcctttgccttctccttggcggcgctgtcgaggtcatcctggatcttctgctggcgcttgtccatcatccccaggatcgagggccacgcgacctttgccatgaccagccagatgacgaggaaagcgatgagcgccgggaagaactccgcgggcttgggcagcaggatgtccgggccactgatggatgacgccagcgcctgggacggaacagcgaggcccgccccaacggccgcgactccggcggccagcttgtcgccaagctccttagtgttcctgttcatattgcctccaactcggtgtacgtcgtgagggtatcgcacccgttaggaagcgatcagcgtcacgacgaagccgatgagggcgagtgcctcgacgaatgcggagcccaggatgaagaccgtgaacagacgaccctggacctcaggctgacgggccatggacgtggtcgcgccgtaagccgccagaccgatgccgatacccgcgccgataacgccgagaccataaccgatgactcccacgattcctcctttgttgttcgtcacaaggacgatttccaagctttcaaactatgcccaagcgagcgtggggctcgcatgaagccgatggtgaaatcccgtgcctactcctcctgctcgacgagctggatgtagacggccgagaggagcgtgaagacgtatgcctggatcacggcgaccaggatctcgaccaggtagatgatgatcaggatgagaacccagaacacggagcccgccgcactgccgagggcggcagcggagaagccctggagcaggggctcgaagaagagcgacgccaggattgcgaaggtccccatgacgacgtggccggcgaacatgttgcagaagagtcggacggccagcgtgatgaggcgcaggaacgtggagaagagctcgatgacccagaccatggcggccatgggcccgggaagacccttgggggccaggctcttgaggtacccgattacacccatgcgcttgcagccgaccacgatgaagtagacgaacgagcacagggcgagggccgcggtcacgcccatggtgccggtgccggggtggcaccccgggatgatgcccacgatgttattgaagaggatgaagaagaagagcgcggcgatgaaggggaagtgcttcttccacgtgtcaccgaggatggacttgcacatgtcgtcgcgcacgaactcgaccacatactccatgccgttgacgaagaagccgtgcggaacgaggctctgcgcctgcttcttcttgaagacgaggatggctacgacgaagagggcgagcgccacgaacatccagaagatgtactgggtcaggccaaccgtggtgttgccgaccaccgcgtgcgtcatgaagccatcgagcagctcgtccatggcctcgggcagcttagaaagcgcgttcactgttcgtccttccctccggcctggctcccgctgttggcggcccgccaggcccttagcgactccactccccaaaatgcgaggaatgtgaccacgagggcgcacccaaagcgcagggtcgccccactttccctcacgtacacggcgaagatcatcgccgacagagcaacgaacgagatgagaatggacgccagcccgacgcccacgctcacaccggcatttttaccccttttgagggcacgctcaaacaagaccgctggcggtatgcacccaacgaggccgcatgcgacccccgcaagcaccgtcatcgtctcccccaagccaggccccctttgaggagtaactcactgcaggcggagtgaatcttagccgtatttgcggagaaaagccataactcggattggcaaacggccccgccaccgatgaggaagtcagtggcggggccgtaaaaccgctggtattagcccaagttcaggaagcgagcttttttaaatgcgttttaaaaagacgattaacaactaaccgacacaatcccttccgttgggtgagattttggaagggcgggcttacttcgtgccgtagatcctgtcgcccgcatcgcccaggccggggaggatgtaggcgtcggagttgagctcgcggtcgagcgcgcaggtgaacagcctgacctcggggtcgaagtcaaggaccgccttgaccccctcgggtgccgagacgatggtgagggcgcggatgtccttgacccccgcctcgcggaggaactggatcgcagcggtgagcgatcctcccgtcgcgagcatggggtcgaccacgaggcaggtgcgcttgtccacgtcggcggggaacttgcagtagtactggtgcggctcgtgcgtctcgggatcgcggtacatgcccacgtgcccaacgcgcgcggagggcaccagcgtgaggatgccgtccaccatgcccaagcctgccctgaggatggggatgatggcaaccttcttgccagcgatcctcttgcagaccgtcttctcgaggggcgtttcgacctcgacgtcctcgagggggaagtcacgcatcgcctcgtagccctcgaagatggcgagctcggtcacgagctcgcggaactgcttggtgctggtctccttgtccctcaggatgtgcagcttgtgctgcacgagcgggtggtcgacgacggtgaacctgctctggtcgaactctgccatgggtgcctctctctgctcgacgccaagacgtaaggggcgcccgacgagacgcccgtcctctgtcgccttgggatgttagtccagattggggtacagggggtgactcgcgagcatggacgcgacctcggcgcgcaccccatcgagcctctcgggctccccctcctcgagggcgaacacggtctctcctatgagctcgccgacgcgctcgcactccgcctcaccaaagccgcgggtggtgatcgcggcggagccgacgcggatgccgctcgtcacgaacggggacctctgctctccgggaatggtgttcttgttcaccgtgatgcccaccgactcgagcgcctgctcggcatcgcgcccggtgacggacttcgcgggcgtgaggtcaacgagcaggaggtggttgtcggtgccaccggtcacgagccgcagcccctttgcctgcatgccgcggccaagggccttggcgttgacgagcacgccctggatgtaggtcttgaactccggcttgagcgcctcgccaaacgccactgccttgccagcgatgacgtgctcgagcgggcctccctgagtcccggggaacaccgaggagttgatgcgtttggtgtagtcggggtcgttccacaggatgatgccgccgcgcgtgccgcgcagggtcttgtgcgtggtggaggtgaccacgtccgcaaccggaacggggctgggatggagcccggcggccacgatgccggcgatgtgggccatgtccaccatgaggatcgcgccgttgtcgtgcgcgatctgggcaaagcgctcgaagtcgatggtgcgcgggtaggcgcttgcccccgcgatgatgatcttgggcttgcactgctcggccttcgccgcgacgtcctcgaagtcgatccgctcggtcttggggtcgagcccgtagctcaccacgtcgaacagcttccccgagaagttggcgtgggagccgtgggtgaggtggcccccattgctgaggtccatccccatgatcgtgtcgccaggcttggcgaacgcggtctcgacggcatagtttgcctgcgccccggagtgcggctgcacgttggcgtactgcgccccaaagagcgccttcacgcgctcgcgggcaaggtcctcgaccttgtcgaccgcccagcacccaccgtagtagcgcttcccggggaggccctccgcgtacttgttggtgaggacggtacccaccgcctccatgaccgcaggagagacgaagttctccgatgcgatgagctcgatggagtcgcgctgcctccccagctcctcctcgatgagggatgcgagctccgggtcctgtcgcctgagcgtgggaatcgtgtcggccatccggctccctacccttccatcccgaagtcggcggggacgcccccgaacgagggatcgtcctctcgcatgatcttctccacgcgaccggtgtggcggccgccggcaaactcggtcgtgaggaactcgtccacgatctgcctgttggtctcgaacggggtgaacctgccgctgatgcacaggacgtttccgttattgtgctcgcggaacagctcggcgaactgcggggtctggatcaccgcggcgcggattccgggcaccttgtcggcagtgagcgccatcccgatgccggtcccgcagatcaggacgcccctgtccgcatccccgcgcgcgacgcagcgtgcgaccttgtctgcgaagtccgggtagtcgcagcgctcggcgctcatgggcccgaggtcgatgacctcgtggccgagcaactccaggtatttgaccatccccggcttctggtcgtatccggcgtggtccgatgcaatggcaatcctcatgcgggagcccccttctgtttgcgtccctcgtgcgactccgcggggcaagcccgcaggcctaggatacagcgcggagggtccgcttccgtcggggagagacgcgcgggggacgggcgctcgcaacacctccacgggcgccgcgcgaccccatggcgagaggggaaggcggccgtcctagcggccggcgacctcggctatgcgcctggcgggaatggcgccctcgcggagcacctcgggggcgtccccgaggcacgagacgatcgtggaggcaaccgcgatgggggccgggccgccatcgagggtgaggtccgagagctcgacgaggcggctctcgaccgccatcccgctcgtggcggacggcgcgccatgcgtgttcgcgctcgtggtggcgaggggtacgccaaccctccgcgcaacctggcgcacgaggttggagtccgggagcctgagcgcgatggtcccgtcgccaggccgcaggtactcccctggaacctcgcgcgacgcatgcacgacgagggtgagggcgcccggccagaactcgcgcgcgaggcgggacgcccactcggggacgtcgcgaccgtagcggaggaggtcgtccccgtcggcgacgagccacggaagcgtctgggtgcgctcgcgccgcttgatgtcgaagatcctcccaaggccggggttgccggggagagccgcgcatccgatgccgtacacggagtccgtgggcatgacgacgacgcctccgcccgcaagcacctcgctgacccgcgcgacgcacccgtcgccgggatgctgctggtccaccctcatgaccttacccatggcaacctccaagtgcagaaccctgctaggaatcccggcgggcgagcctgcagacgagcacgcggggcctgtgggtcaggtcctcgcggatctcgacggactcccactcccccgtcccgcgagccagcgtcgcagcggcatcgagtgccccctcgtacagctcgacgcagaacatcccgcccggggcgagcgccctgggggcgagctcgaggagcctcctgaacacgtcgagcccgtcctccccgccgtcgagcgcaagcgcgggctcgtggtcgcgcacctcggaggggacctcgttcgcgaggaccttggaggggatgtacggggggttggagaccagcaccgagaacgtgcccatgagcccctggtccacgcccgacgccaggtcgcactccactatggcgaccgcgtcctggagcgagagggcgtcccggttgcgcgtggcgagggcgatcgccttgggcgagaggtccgttgccacgacgcgcgtgcccggtcgctcgccggcaatggagagcgcgatgcaccccgtgccggtgcccacctcgaggacgcgacagccggcgggaaggacctggaccggctcgccgcgcacctctcccccatcctcgccgccgttgtcggccgcagacccgtcttccgcgcctgcgtccccgccgtcagcgtcatccccctcggaggactcgcggcttggctcctcccccatgaccggcgggaaggtcatcggcgcctggtctacgccctcgagcgcggcgtcgaccaggatctcggtctcgggccgggggattaggacaccctcctcgcagcgaagcacgatgtggcggaagggcatctcgcccgtcacgtactggaggggctcacccctgccacgcctgacgaccgcctggtgcatgcggtcgagctcgtcgcgcaccatcgggcggtcgaagtccatgtagacctgcacccgcgagaggcccgtgacgttgcacagcagccactcggccgagaggcgcgggcgctcgtcacccttgcgctttaggtagccctcggtccacttgagcatcttgccgacggtccaggtctccgccacgctcactcccctccggggcacaggccccaactaaaaagcggcgccggcccagggccgacgccgcgacggcatcgtcgcctagcctcacacggtttccgcgagcttctcggccctgtcggccgcggcaagggcctcgatgacggagcccagctggtctcccagcaggacgccgttgtacgtggagttgaagccgatgcggtggtcggtcacgcggtcctggggctggttgtaggtgcgaatcttctcggagcggttgccgtggccaatctggctcatgcgctcggctccctgctccgcctgctgcctctccagctccatctggtagagcctcgcgcgcagcatctccatgcagaccgcgcggttctgtatctgggagcgctggtcctgcgactggaccaccgtgttggtgggcaggtgagtgatgcgcaccgccgagtaggtggtgttgacgccctggcctccggggcccgaggagcagtaggtgtcgatcctcaggtcctctgggttgatcttgatgtcgatgtcctccgcctcgggaagcaccgccaccgtcgccgtggaggtctggatgcgaccctggctctcggtcttggggatgcgctgcacgcggtgcacgccgctctcgtacttcatgaccgagtagaccttgtcacccgtgaccttgaactcgatcgtcttgaagccgcccgcctcgccggggctgctggagaggacctcggtcttccagccgcgcgtctgggcaaagcgctcgtacatggcatagaggtcgcccgcgaagatggccgcctcgtcgccgccgacgccggcacggatctcgacgatggtgttcttctcgtcgttggggtcaccggggatgagcatgatcttgatctcgtcctcgagcgaggggagcttctcctcgttggaggagatgtcctcctggagcatctccttctcctcgggatcggaggtctcgtgcatcatctccttggcggcatcgatgtcgtcgagcgcctggacgtactcccgcgccttggcgacgaggtcggcctggttggcatgctcctttgcgatcctggcgtattccttgggatccgacacgacggacgggtccagcatcttcttctcaagctcctcgtacgccgcgatgagcttctcgagcttgtctcgcatgtgggtctccttgatgcggccgcggcgctgtgcggtgacgcggcataggtgttcagcatgggaaagtctaccaccaagggggtattcgtagtcaggcggcggggttgcggccgcgcacggcacgggcggcacacggaagcaacaccgcatgccgcccgcacgacgcccgcctgggcccgactagctcgcctcgcttgccttgatgaacgagacctggcagtgctgcttgagccactcgacggtcttgggcgtgtacctctcgctcagggtgaaggtgaggacctggtagtcgttggacccgggtgccaccgcccccaccgagagggacgccgcgagcgccgtgtcgtacgtcccctgcatgtacgaggcggcatacgccccatgcgccctgacgtcctgctcgagaaccgcctcgagtgccttgtagtccgttccggcgatggactcgctgtgccaggtggtcgcgtctggcgatgggcagtagtcaaggctcacgtccgtggcgctcgtatccttgaccagggagcgctggagcatggagcacgtggcatcggttgccgcctcgctctggaggaacgccttgaaggcacttcccgtggagcccgtgtccgacaggctcttggacgagaggtcgatcgtgtactcccggctgatgagggtgccgtccttgagggtgtacgtgatgtccaccgtgttgtactcggctgaatcgtccgtggccgagccgttcgccaggttggtggcaccacccgcgacaagggacttgtgaaggcccaccacctggctgatgccctcacgtgactcgaacgtgaggttggggttggaaaccgacacgctcttgacgtcgtccaccgagggaacgtacctcaccacacccatcgcgtcggtggcacagcacacggcaaacgccacgctgattgcaaccgtaacgacgaggccggccttcctgcgccggagcgccgagacaccgccgcccacgccagcctctgcgacgcagaacaccagcgcgcagctcgcgaccaccaccgtccccaccgcgagtggattccccgagacggagtcggcgaacagcgcgaggacggtcagagacacgcccaggccggccgcaagggcaaacaggacgctcgccacctcgtggacgggacggaacgcgaaggcgtcccccgccctctcgaggtcgcgtcgcgcggacagctccgcggcaaccaccatgcaggcaacgcccacgagggcgtacgccacaagcgccagccatgggaccctgccgttctggaaggcgctcaggctcttgacgaggtagaccgccggggaggcccaggcgagcgacggggacgacccgttgtggacgctcggcgccaagagtgagacgacctgctggacgccccattggaccaccacaacgtatccattgaccatgcagaacaggatcgtcgcgaccgacgcccgtccagacaccaccatgcaaagcgacgcgatgccacagaacgtgatgcacatgagcccctgctcggcaaaccacaccagcacgtccatgggaccgatgcccgccattccgcccagcaccaggaggagcagggcgaggacgaggtttgccaggatgagcggcacgagcgaggccaggaacagcgagtggaagagcggcctgcgcctgacgggaagcgagccgtagaagggagcggcaacgcggtcgaaggcgaagttgaggttgcgcaggaccgccgcgtaggaggcgacgagggtgaggagcacgccgagaacggacgagaacgcaaggagctgctggcctcccgcctccatgccgccgtctgccatcgccctgccgcgatacagcagcgagaggagcggaaccagccagatgaccaggtatgccaatgcaacatgggcgcgcctcaggcaggcgtccctgaagatgccgatgctagaggacgaggtccttgagctcatcgtccgcacctcccaactcgtagaggaagagctcctcgagggacaggggaacggtctccatgtagacgggatgcgccgtcgagaggacctcgcgcacatgccccacgtcgccgtgaactatcagggtctgcatgcgaccgctggcaacccggttggcaacccagaggccacgcggaagctccgcgccctcgggcagcacgacctggaccttaaccaggccgtcgctcgcgcgggtgaggtcgtactccctgagcatggtcccctggcgcaggatgcccatatggtcgcagatcccctcgagctcgcgcaggttgtggctgctcacaagcacggtcgtgttgcgctccgccacgtcgtccagcacgaggcgccacatgcgcttgcgcaccagcgggtcgaggccgtccatgggttcgtcgaggagcaggacgtcgggcttgagcgagagcgtgagccagaacgccgcctgcttcctcatccccttgctgaacttgcggagagggcgcttgcggtcgaggtcgaagctcttgcccacggcctcgaagcgcgcgaggtcgaagccggggaagacgtcgtagtagaactgcgccatcccgcgaatgctctccgtcgagaagaagaacgggtcgctggggacgctgccgatgcgcgccttgatggcggggttctcccacaccggctcgcccaggacgctcaccgtcccctcggttggacgcagggccccagtgaggtgacccatgagcgtcgacttccccgcaccgtttggtccgaccaggccgtagaccgccccctcgggaaccgtgaggttgacgcagtcgagcgccgccacgtcatcgaactccttgcggagcttccgtacctcaatcgccgctcgcacggtcggcacctcccccgatcctctcccgcagctcctcttccgtgcagccaagggccatcagctcgcccgtcacctcgtcgaacctttggaggagctccttccggcgcacgtccgccgcatgggcggcgtttgccacgaagctgcccttcccccgcacggagcagatgtatccgccctgctccagctctcggtacgccctctggatggtgtttgggttgatggcaagcgcggaggagagctccctcacgctggggagcttgtccccgggagagaggacccccgccagaatctgctgctgatacgagtccctgacctgctcgtagatgggacgtgcgtctcggtagcttatctggatcatgcacgcctcccccacttatccgttctaactgtactaattagtttaatacagtcgtacggacgcggagtcgcgagcgcgaacttttgtaaggctcgtgtgagcgagtcgcgagagacggccgacctaccgtgacgccaacccctcccccatgaggaggcccatgacgctggacatcatgaggccgcgcgtccagccgctcgagtcgcccaggcagtggagtcccgcaacgttggtgtcgaggttctcgtccatgctgaccttgttgctgtagaacttgagctcgggcgcgtagaggagcgtctcctcggcggcgaagcccgggaccacctgatcgacggccttgatgaagttgacgatctcgatcatcgcccggtacgggatggccgcggtgatgtcgcccgcctccgcgtcggggagggtgggcacgaggttggagcgcgagagctcgcgcggccaggttcgcttgccgtccaggatgtcgccaaagcgctggaccaggatgtggcccgcgccgagcatgttgcacaggcgccctaccatctgcgcgtagaggatgggctggtcaaagggctcgcggaagttgaacgtgcacaagaccgcgaggttggtgttgtcgctcttgcgctccttgtagctgtgtccgttcacgacggccaggccgccgtcgtagttctcctggctcacgaagccgccggggttctggcagaaggtgcgcaccttgttgcggaaggggttggggtatcccacgagcttgctctcgtagaggacgttgttgacgttctccatgacctcgttgcggacctcgacgcgaacgcccaggtcgcatgggccggcagagtgactgatcccgtggcgctcgcacatgtcgtcaaaccagctcgccccacggcggccggtggcgaccacggtctgcgccgcgcgaatggcgacggcgtcaccccctgccgtcgggcgcaccatggccccgcggcacacgccgccctcgacgagcacctccacgcactcgtgctcgaagaggatgttgacgcccgcgtccaggagggcgcgctcgatggtggcgtagatctcctgggcccgctcggtcccaaggtggcggatggggcagtccacgagcttgaggcccgcctggatggcccggcggcggatgtccgcgacctcccttggatgccccagcccctccacgtgcgggtcggccccaaagtcgaggtacatctggtcgacgcgctcgatggtggactgtgcgagcccctcccctattagctcgggcaggtctcccccaacatggcacgacagcgagagctttccatccgagaacgcgccggcgcccgagaagcccgtggtgatgcggcatggcttgcagtccgcgcaatggcccaggcgctccttggggcagctccggcgctcgatgggaaggcccttctccaccatggtgatggagcccgcgaagtgggatcggatgagcccgagggcggtgaagattcctgccggtccggcacctatgacgaggacgtccgtggaggagggtatgcgctgggcagtcatggctgttcctttcgtgcgaccacgtgattgtatcagtcgcacgccgaggcgcggtaggggtgacggcggagtggaggtgggttggcgctaccctagggaagaccaaacgtcgggcggatgcgcccgtgggaacggagaggagcggccatggccgcaggaaagcactttgcaggcagcaggcccaccctttctgaggaggaggtcgacgccgtcgtccgctctgcgatggagcgggcgcgcagggcggtggaggagcccctgtacacgctctcgagctacgagcccgtgaaggtgaaggtacgcgtcccctgcgtcacggacacccaggttgacctggcactctcctccatggcgcagcaggcgggggcggacgagtcccggctctcggacaccgactgggtgcgtcaggcctttggcgtgcgaggcctcgacgagctgcgcgcggatgtgaggaacgacatcctggcgtccaacatgcgcgacgcagatcgccagaagggggcgctctgccttgccgagcttgcctcccgacttcagcaggaggtccccgagcaggtggttgacgagatgcgccagggcatgcgcgcagggctcgaacaggacctggcgcagagcggactcacggtgaaggggttctgcgagcagaccgggacctcacgggaggacctggagaggagcctggccagccaggcgcgcgaggcggcgacccagggggccgccctagacgcctacgcacgggagaggggactctccgcgagcgagggggagtggccgcggctgctcggggtcccgccggcgcagctggcggaggtcgcgaggcgggcgcgggctgacggtagctacgacgcgctcgccaggaccgcgctccgcaacaaggcggctgacatcgtcgtaacggaatgcgactgcacctacagctacgagacgccgcaggaggcggagggacgcctgcaggagatgcttcgcaacggccaggggacggtcacgcccggccccatgggaacgagcgggctcgacgcgagcctgcccctggtgtagctcactgccgagaggccacgtgcgtctcccccaggcatctgccatggaacaggaagagggccgcccggacgaatccggacggccctcgccattgcgcgcgttgcaatcgccgcgacgctactccgcgggggtctcctcggcgggagcggcctcggcaacggtggcctcggcggtctcggcctcagcggcctcctcggcggccttctttgcagcctcggcctcggccttcttggcgtactcggcggcacgctttgccttggcggcagcctttgcctcggcggcagccttgcgggcggcctcctcctcggcagccttcttggccttggcctccttggcagccttggccttggcgagctgggcctgggcggcgccaccaaacttgtcggagaagcgctggacgcgtccgccggtgtcgacgagcttctgctggccggtgtagaacgggtggcacttgtcgcagaggtcgatggtcatctcgctcttggtggaacgggtgacccaggtgttgccgcaggtgcagcggacggtgcacatcacgtagtctggatggatgccttgcttcatatgggactccttcgatcggcctggtttccgaccaggcgaggggttgtctcgacccatgccgagacagtcaagctttgcgagtatagcaaatcgaccgctgggcgatgtgaagagaacgtgcactcgaatgcggccgtccgctctcctgccccacggcagcacgcggtagactgtggtttcctgccctgccgtcccggagggggtcggctcgtacccggaggtcacgcgatgctgcttgccattgacgtcggaaacacccagaccaccctggggctgtttgacggcgggggccaggttgcgcgccagtggcgcatggccaccgacaagaccgacacggccgacgagctgcacgagcgcctgtttggctacttcatgatgtttggcctcaggctctcggacgtcaccgacgttgccatagccagcgtggtgcccatcctcacccaggagtggctgtacatgatgcggcacatcctcaacgcggacgatgtccttctcgtcgacgccagcagggactgcggcatcagggtgagcatgcccgacccgacccaggtgggggcggaccgcatagccaacgcggtggcggcgcgggagacgtacggggcgccggtcatcgtggtcgactttggcacggcaacgaacatcgacgtcgtggatgccgacggctcctttaggggaggcgcaatcatgccgggcctgctcctctccgcgtcggcgctcttctcccgtgcgtcccgccttgcgagcgtgcccctcgtcgcccccgcgcatgcgttgggcgacacgaccgagtccgccgtccagtcgggaatcgtgattggcgcggcggcgcaggcggaggggctcgtgaggaggatccgagacgagcttggggagccggactgcaccgtcgtgggcacgggcggcctctcgcacgagatcgccaaggcgacggacctctttgacgccctggacccagacctcaccatccgtggcgtctacctcatctggaggcaccgcgcggagaagcgcgccgcccgcgcgtagacggggaggctacaggctgcagacgttgcgcggctcgccctcgagccacgacgtcacgttgtcaaactcaatcctcgcccggcgccgcatcgcctcctgggtgagaaatcccacgtgaggcgtgaggacaacgtttctcgcatgggcgagcgggtagtccgcgggcaggggcggctccatgtcgaagacgtccacgccggccccggcaaggtgtccctggtcgagagccctcgcaagggcctcgttgtccaccaccgcgccacgggcgcagttgatgaggacggacccctggggcatgagctcgaggcccctggcatcgatcatcccacgcgtgctcgcgtcgctgggcacgtggagcgtcacgatatcgctccgtgcaaggaggtcgtccagatttggcacgaactcgatgcccgccctggtggcctcggggttctcgtggcgggcgtagcccagcacgcgggcgccaaatgccccgaagaggcgcccgacctgggtgccgatgtggccggtccccaccacgcccacggtcttgccgctgatctcgctgcccatcagccccgcagaggtgccgccggtgcgcgccgcgacgtccccggggacgaccttgcggaggacgtcgatggcaagccccagcgtcagttcggcaacgctggtgtcggagtagccagcgcagttgcacacggtgatgccgcgctccctgcaggcgtcgagcccaacgtggtcgatgccggtgaaggcgacggcgatcatcctgagcgactcggtcgagcgaatcacgtcggcgggatacggtgtgttggcgatcatcaccacgtccgcgccggagctgcgtcgggtgagctcggtgacgtcggtcgtcctctggtcatacgagacaaactcgtgcccggcctcggcaatcggcctggcaagctcctccaccatctggctgggaatccccagcggctcaagcagggcaatcctcatcgcacgcctcccacccaaaacgccgcccgcccctgacaaggagggcgagacggacggctcatgccagtcgaatccccgcctgctcgggggagaactccagctgcctgccggagtccagggtgaccgtcgcccgaccccacacgtccaggccggcgaacgtgcccgttgccgccacgcgcccgtttgggtagacgacctcgaccctcttccccaggcgtggctcgcggtcaaagtagtccgagaggaacgacgcccatgcaccccccgccgaccggccgctggagacgtccctctcccaccggtcaaagcgggccctgacggcctcctcgaggtcggcatccgcgggcagggccgatgcgccgtcacccggcgtgaggtcgatccgcacgaagaccccctggtcgtcgtagccgccacgagcggacaccgcgcagacgggcgtgccctcggcagccaccacgacgtcgtggggccagtagattcccagctcgtccgaaccagatgccgtcgcggcgtcgaccacgcccatcgcggcgatggcgggtgccgccacgaggaagcccatgggcaccgcgggccgcaccgtcagctgcacgtctcccatcacgaccgcctactgccagtcgaggacgccgagctcggacaccacgtggccaacgcgctcctcgggcgcgtagacgggcaccccggcgtgcatgaggaacctgaccgggtcgtgcatgaggtcctccatggggaccaggacgtagtccctctcgcccagatgcgggtggggcagggtgagcttgcgaccggcgtgctcctcgtcctcgacgtagaccaggtcgcagtctatggtccgcgggccatgccccgcctgctccggatcgcgctcgcgaccgagctggcgctccacgtccatgaggtcgtccaggaggaccatgggatgaagctcgctgcggatctcgaccacggcattggcgaccgacgtcttgatgccgtaggcgggctcggtctcgtacgcgtggctcacctgcaccacgcaggtgaggggaatctggttgatcaggcggaccgcctgggtaaggttctcgagccggtcccccacgttggagccgatggagacgaagccctggcgcgggtccgccttcgcaaccgaccagtacgagtcgattgcctggcaggcggtggccacgtcgtgaacgcgcaggatgcgggcgcccgactcaatcgccgacaggcagattcccatcgttgcggggtcacggtctgcagcgaccgcgatgcccgagaccgcgccgacgaaccgcttgcgcgacacggcggtgagcacgggatatcccatcgagacgagcttgcgggtggcacgctggatgaccacgtcctggtccgcggtcttgtcaaagccggggccggggtcgatgcagatgcggtcatggctgacgccggcacgcatgaggatgcgggcctggtcaccgagaaagcccatcacgtcgcgcatgatgggcgcctcctccggcagcgtgaagcggcgggtgctggtggggatgctgcgctggggcgcacgggcgggccgcgcgctgtccagctgcacgaacttcctggtcgcctgcccctctcccctgttccagtgcatgaccacgcagccgcagttggactcggcggcaacgcggaccatctccgggtccgtgaagcccgagacgtcgttgatgatcgagacccccatgcgagcgcacatgtgggccaccgcagggtggcgcgtgtctatggagacgatcgcggagggcgccgcctggaggattcccctgatgaccgggaccacgcgctttgcctcctcctcgggggagacgggcgtgtggccgggacgggtcgactcgccacccacgtcgatgatgtccgcgccctggtcgagcatctgcagggcgtagtccaccgcgaccttggggtcatcgtgctctcccccgtccgagaaggagtcaggcgtcacgttgaggatgcccatcacgcgcgggcgggcaagcgagatctcgtgccgtccgcagcgccagatggagtagtcctgtcgaagcatgggtcgtgcctcccccaaagtgagcggggcgctcgcggcgccccgagatagtcttcacaattgtagtcgctttgggagccggcgcgcccacgcggcgccccgggcgtttggcagccccgggcaacggatccgtcgaagggggcgcgggcggtaccactgcgcaccgcgctttgtggatccggttcccgctctggtcgtgcggagaacagggactaggaggaaagatgcccgtgaaggggagaggcacgacgcctcgctccccccggccgcacaattggacggcgcgacgcccgcatcgtcgccgcggcattctcccccgccgaaagcgactcctgacgcatcggttttacaaccatggcggcggaagcccgatgtgagcactttcgcggcccacccatctggcgaagggaggggtgccgccccacatcggtgcaggcgggagggccggggcctgccccaggcgccccaacgctggcggcagacgccactaatgagcactcacgtcgggagcttgctgccatccggggcccgggacggggtccaatggcaagggattcccgatgtgagtgctcacgccaggggtttgccgccacggtccaggggttggctggagcccacctgggatgacgcccgggcgagcgaccaccctggcggcgggagcccgacatgagcgctcgcttggggagttccctgccaatcggcctgccggagaggggctcggccggcgtcccgaggggacgtcagaactcgaacgccttcgcgatgtcgcacacgcacacgaggtcggccatgccatcctgcggcgtgggctcaaggttgcagatgacgaggtcgttcccgcggaagtactggacgagacccgccgcggggtacaccacgagcgacgtcccgccgatgatgagcatgtcgcacccctcgatggcgcggaccgcccggctgatgttgccctggtccagcgcctcctcgtacagcaccacgtcaggcttcaccacgcccccgcacttctcgcagtgggggatcccgtcggtcgcaaggatccactcctgcgagtacacctcgccgcaacggcggcatatgttgcgatgcgtggagccgtgcagctcgatgacgttcttggagcccgccgcctggtgcagcccgtcgatgttctgcgtgatgaccgccgtgagccttccctcggcctcgagctcggcgagcttgcgatgcgcctggttgggccgcgcgtcgggggcgcacatgacgtggcggtagaagtcgtagaactcctccatgtgcgactcgtagaagctgtggctcagcatggtctcgggcggatatttgtagccacgctggtgatagagcccgttaggactccggaaatcgggaataccactggcagtggaaacgccagcgcctccaaagaacacgacgctcttggcgcgctcgacatgactcttgagctcctgggccgcctcgctggggtctgtgatcgtcttcgccatgatggcctcccgttccactgcttgcttggaccaactctatcaccgggaggtgcggcgcacatgacccagcaacccaaggcccagccccttgtgagcaacgtcaccgactgcgccctcgtcttcgagggcggcggctatcgtgccgcctacacggcggggttcgcccgcgtcctcctggagcagggcatctacttcgactttgtctgcggcatcagcgccggagccagccacaccgtggattacctctcgcgcgacctctggcgcactcggttcgccttcctgggggagaggcccaagggcatccagatcaacggcctgggatcgatgctgcggggcgaccgctacttcaacgccgattacctgtacgagggatgcgtggaggacggcttcatgccctttgactgggagaccttccacgccaacccggcgcaggctgcggtccagtcgtttgagagcgacacggggcgctcggtcacgttcaccaaggacgacatgcccgacatggagtccatgatgcatgcagtccgcgccagctcgaccctccccggcatgatgaagcccatacagatcgacgggcacgtgatgtacgacggcggcctgggacagggcgcgggaatccccctccaccttgcggaggacgcgggatacaggcggttcttctttgtggcgaccaggccgcgaggctaccgcaagctcccacccacgggcgccgagaggcgcatgctgctggcagtctcgaagggcaacccctatgtgagaaacgccctcctgacccgctgggagcgctacaacgtggagctgacccgcctggaggagctcgcgcgcgagggcagggcctacatcgtctatccggacgagatgccgctcacgagcgggaccaccgacacccgcaagctgcacgaggcgtacgaccatggccacgcacagggcatgcgcgagctgccgcggtggagggagttcctctttggggcgcccgacgcggggcccaagcccgaccccaaggtccttcgcgaggtcgaggcggaggacaagggctacatcacgatctcgcagtgaggcccgaccactgccgcggcgtatgcgacaatcccctcggactgcgccgagcgaaaggaccgacatggcagaggaacgcgagctgcgcctcgtctcgtggaacgtgaacggcctccgggctgtgctcaagaaggagccgagcttcaccgagatctttgggcagtgtgacgcggacgtcttcgcgatacaagagaccaagctgcaggagggccaggtgagcctggacctccccggctacgtgcagacgtggagctacgccgagcgaaagggctattcgggaaccgccgtcttcagccgcgaggagccgctgcaggtgattcgccagatcggctccccggtcgcggacgacgagggccgcgtctgcgcactggagttcccctccatgtggtttgtggacgtgtacacgcccaactccaagcagggactgctgcgcctggacgagcgcatggtgtgggacgagcgattccgcgacttcctgtcggagctctcgcaggacaagcccgtggtgacctgcggcgacttcaacgtcgcccacgaggagatcgacctcaagaaccccgacaccaaccacgagaacgccggcttcagcgaccaggagcgcgagagcttcaccaagctgctcgactccgggctcacagacaccttccgcgccctgcaccccaccctcgagggggcctacagctggtggagctaccgcatgcgctctcgcgagcggaacacgggctggcgcatcgactacttcctggtgagcgaccgcatcgcggacagggtcagggacgcccgcatcctgagcgacgtctacggaagcgaccactgccccgtggagctcacgctcgcgatctaggggagaggctcggcgccccggtgtcggggcgtctctcccctggcatcacggcatccgccccgaggcgaccaggctactcgatcgtggtgccaacaccctcgcgcatcgcccgcaggaagctctcggcatcacgcgtggcgataagcgcctgggggaagtggatgcgctcgagcatcctgagggcggggtcgaacccacccacgccgcagctgatgtgggcgtcgctgctcaccacgatcttgcagccctcctcggcgcacagctcggcaagcgcctggcagccgtcgatggtgtccttgcgcccgatgacggcgtcgatgctgtgcgcgttgatctcgatgagcttgtggaggtccctggccgccctcacgacctccctatgctcgaaggggaccctgccgcgcaccgggtggcccagcaccagcaccttggggtcctggagcgcggagaggtacatcttggtggtggcggacaggtccgccccgcgcgcgaagtccctgccgtgcacgctggcgatgacgtagtcgcagcgcgagaacacccggtccttgagcgttgcgggcgactcggcatctcccgtgatgccctcgtcgaccacgacgtcgtggccaaagaggttgccctcgaggtcgacgatgtccgcctcgcagccatggagcagcctcacgccgtgccacaccctcggccagcagccaaagttgtagaagtactggtagtctcgcgtgtcacacgcaagccggccgtcctcggtggcgacggggggatggagcatcgacgagaagtgctccgtgcatcccagcagctcgagcctcagctcggcggcggcgcgcacgttctcctcgatcgtggagtaggcgtggcgggagtagatggtgtgggtgtggatgtcgcaggcgttgcggagcacgttcgctctccctccaaaggtcagacggtaggccagaagccattgtcgcaccttgccggcacggcacgcctagcgcgcgtactcccccgcaaggcgctcccacgcgggcatggagcccacgatggtctcgtggctcacgcagtaccccacgcggacccatcccgtgcagccaaagctgtcggagggcacggggagaagctcctgctcgcgtgccttgaggaagaacgcgttggcatcgggctcgagcgccttgacccacaggtagaaggcgccctgcggctcgatgtactcgtagcccagcctcgagagtccgctcgtgagtgcctcccggttgctggcgtaggcctccacgttgctcggcacgtccacgcagtccgcgaccacgcgctggaacagcgagggcgcgcacacaaagccgagcttgcgacccgagccggcgacggcggggagcagctcgtcgtggtccgggttggtggtgggcaccaggacccagccaatgcgctcgccggggaggctgagcgactttgagtagctgtagcacaccagcgtgcggtcgtacacgtcggggacccagggcacctccgccccataggtgatctcgcggtagggctcgtccgcgatcaggtacacgctcgtgcccagggccgtctcgcggtcgcgcaggacggcggcgaggtcgttgaggttctgccgcgagtagaccgagcccaccgggttgttgggcgagttgacgatcagggccttggtcctctctcccaccgcccttccgatcgcgtcggggtcaatctgaaaggtcgtggggtcggcgggcacctcgacgcaggtcgcccccgcgctctcgatccacacccggtactcggggaagtagggggagatcacgatgacctcgtccccggggttgaccaccgcgttgaggacgatgttgatggacgccgcggcgccgcaggtcatgtagagctcgtcgggcccgtacgacgtgctaaagcgacggttgagggagtccgcgaccgccttgcgcgttgccgggtagcccgccgcgggggtgtacccatggagctcggtcggggggagggagaggttccgctggatggactcgcggacctcctccggtgcggggacggaggggttgcccagcgagaagtcaaacacgttctgggcgccgatctgcgccttgcgccgcgccccgtacgccgcgatctcgcggatgctcgacttctgcgcgccataggcgtagctctgctggtttatggacatgaagggtctcccctctcccccggttggtcgttgcggtcagactgccgtggggcaattgtaggttcgcgcgccacgtgccgtcacgcgcgtgcgcaaaacgaaaccggggacggacccagcggcccatccccggcaggcggaagctaccatcacccaggcttcgggcgagaggaacgtggctacgccccctccaccgccgcctcggggtggctctggacgtactcgtcccacttgtcgtcgagcagggcgtccacgacctcgccctcgaccgtctcgcgggcgaggagcaccttcgccatggtcgccatctgtcccgcgcggtcgcccagcacctggcgggcgcgtgcatgggcctcacgcatgatgcgctcgacctcgtcgtcgatcctcttggccgtctcgcccgagtagttctggtgcgtggtgtagtcgcggcccaggaagggctggtgatcttggtcgccaaacacctgcgtgcccagctcgtcgctcatgccgtagcgggtgaccatctcgtgcgccatcttggtggcacgctccaggtcgttgctcgcgccggtggtgatgtcctcgcagaacagctcctcggcggtgcgaccgcccagcagcacggcgatctggtcgagcatggagtcgcgcgtctccaggaagtggtcctcctcggggagctgcagggtgtaccccagcgcgcggccacggctgatgatgctgatcttgtgcaccgggtcgctgttctccagcacgtggccgacaagggcgtggccgctctcgtggaaggcgatgacgcgacgctccttctcgctcatgacgcggcccttcttctcgggaccggcgatgacgcgctccatggactcctcgatctcgcccatgccgatggtgtccttgtgcctgcgggcggcgagcagcgccgactcgttcatgaggttggccaggtcggcaccggtgaagccgggggtgagcttggcgagcgagccaaactcgatgtcgggctccaggggcttgttggcggcgtggaccctcaggatcttctcgcgacccttcacgtcgggggcgtcgaccgtgatctggcggtcaaagcgaccgggacgcaggagcgcggggtccaggatgtcggggcggttggtcgcggcgatgaggatgacggagctgttgtcgtcaaacccgtccatctcgacgagcagctggttgagggtctgctccctctcgtcgtgaccgccgcccaggcccgcgccgcgctggcgaccgaccgcgtcgatctcgtcgatgaagatgatggagggggcagcctccttggcctgcttgaacaggtcgcgcacgcggctcgcgcccacgccgacgaacatctccacgaagtcggatccggagatggagaagaacgggacgcccgcctcgccggcaaccgccttggccatgagggtcttgccggtgcccggagggccaaccagcaggacgccgcgggggatcttggcgcccatcttgtggtagcgctcgggctcgcgcaggaagtcgcgtatctccttgagctcctcgaccgcctcgtccacgccggcaacgtcgtcaaacttgaccttggggcgggtctgctcggtggtgcgcgccttgttggccctgccaaagttcatggcacggccgttctggctctgcatctgccccatgaagtagagcatcgcgatgaccacgatggcggtggggacgatggagacgagcacgttctcccacacgtcgggcgacgaggtatccacgttgaacttgaccttgggatggcttgccatgagctcctgcaggctgtcggacccaacgtagtagctcacgaagctcgtggacgtgccgtcggacgacatcttgccgcgcaggctgccgtcggaggtcttgtaggtgacctcgctcacctcgtccgacttgacggcagccacgaagtcgctcgtggcaagcgtcttggtgctatcggaccccatgacgccctgggcggcggagtagacgccgtaggcgatgagggcaaccaggatgagcgtgacgatggccgcctggcgcctccttccggggtcgcccttggggccgccgagaaggtcgttgcgatttgggttgttgttgtctgccacgaaacagctccttgcgtgacgggcccgtgcgaggtcgctacctcgaatagacctcgggcttgaggatgcccacgtagggcaggttgcgatagtgctcggcgtagtcgaggccgtagcccacgatgaactcgtcgggcacgtgggtccccaggtagtccggcttgatggcgggggtgtggttggggatgtccttgagcgagaaggcgcacaccttgacggagcggggaccgcgaccgcgcagcatgtcgaccaggtagctcagcgtgaggccggagtcgaggatgtcctccgcgatgatgacgtcacgtccctcgatcttggtgctgaggtccttgaggatgcgcaccacgcccgagctcttgacgccgtcgccgtagctcgacacggccatgaagtccacctcgcagggcaccgtgatggcgcgcaggaggtccgccgtgaagacgaaggcgccgcgcagcaccgccacgatgagcgggttcttgccggcgtagtccctcgagatctctgcgccaagccgcgacacgattcccttgatgtcgtcctcggacagaatgacctcggaaacgtcctcgttgatctcctgagccatgagcgttgccccttctcctctgcgttgccgtcgcgcgccccgcggctgcctctggacgcgagctcggggcgacatgctatgccatggtactacgccccaagtgcgcaaacccccaggggcggcaaccttcacccgcagtgttcaccggcgctacggacgtgggtcctgccgctccagcagcgtgagctccacgacggtgcgggtgtccggggtgcagcgcgccccctcgtccgggcggacccccgcaacccataccaccctgccggtgggagaggtgcggagcacgggaacggcgcccctctccgccgcggggatgcgcgcctcgttgaggaggtccgagagcttcttggactgaccgtgcatcccgaggggacgcaggacgtcgccgggggcgggggcgtcgacccacaggcgcccgccgtggaccgggtccacgccgcaggaggcggcgtcgagcatcaccgaggcccggccccactcgcgggagtgggcgcgggcgacgtccggggccttggagccggcgggaacctgggcgaggcgggcgacgacggcacggccatcccccagctccaggcgaccggggatctcgagccacgcggggccgaccgagccggcgggagcggccgtgcggaggaacaggaggccgtactcgacccgggcgtcgcagcccatgggtgtgctcgccgagccgctgcccctcgccaccagcgagaggacctgcgccacgtgccgggcctcgaggcgcgcgcccgggcagatccccagtatcgccatgcgcaccacgcgccgggcgattgccacgtcgcaggcaccaagccgtgccgcgtcgagcgccaccatgccgtcggaggagcgcctcaccaggtcgcggaacgtccgcgtggccacctgggtcatgtacgagtcctcgtcgcccaggatgtcgcaggttgccgtgaggctcgccacgacgcgcgggttgcgcctctccaccacaggcatgacctcgtggcgcacgtaggcgcgcaggtagcgcgtgtcaccgttggtgtcgtcctcgcgccacacgattccgcgcatgcgcaggaggtcgcacagctcctcgtgcgtgcgatcgagcaggggccgcacgatgcggttgcggcggcgcggtatggacgagaggcccgagggcccgctgcccctgatggcgttcatgaagaaggtctcggcgcggtcgttggccgtgtgcgccgtgaggatgcgggcggcggagcggggcgtgccaaactcctccgagagcttgttcgccagccggttggcggccctgtaccgcacctcgcggccggcgttctcgacgtttccgtccgcctcgcccgccagcgcgcgcacgtccacgctcaccacgtcgcacgggatgccaaagcgaccggagaggtcgcgcacgaactcctcgtcctcccgggcgtccagccccctcagctggtggttcacgtgcagcacgtggaggcgctcccgggcgattcgggcgacgccgcgcccgtcgtcgatgtccagctcggacgtggcggcgagcacgaggagcgccgtggagtctgcaccacccgagaccatcaggaccacgggggcgcgcattgcgtcgtcgcggcgggaggacggtcgctcaaacgggccgccggaagtcgcatacctgcgcatcacgctcgtcacctctgccacgcccccttcgtgtaccctactgcgttgccgccgcccctggcgggcggctgtggaagagtgtacgtctatgccgggccaacgcccgaggaggggaccatgactccactcatgcatctctacgtgctcgcgagcggatcggcgggcaacgccgccgtgatcgacgggccggacggggcgatccttatcgactgcggcatctcgcgtagggagctcggacggcgggccgacgatgcgggcgtggacctggggcgggtgcaggcggtcttcgtgacccacgagcacggcgaccacgtgcgcggcatccccgtcctcgcctcccacatggagtgcccgctctatgccaccgcggggacggcgggcggcggaaaggcccttctcgacgtccccttcacgctcgtctcgcacgacgacgtggtcgacgtggccggcatgcacgtgaccctcttccccaccagccacgacgtggccgacccctttgggatgagggtcgaggtgcgaggcgacggggacgtggccctcgacgccatcggctggtgcacggacacgggcttcctcaccgcggaggcgcttggctcgctgcgcgacgtgcgcatccttgggattgagtccaaccacgacgtcgagatgctccgcaccggcccgtaccccgccttcctgcggcggagggtcggcggcgagaccggccacctgtccaacgagcagtgcgccgacgcgctgcccctgttggtgggagacgacaccgagaccgtcgtcgccctccatctgagcgagaggaacaaccgcccctccgtctgcatgaggaccctggcgggggcgctgggcgccaccctcctggacggcgaggacgggcccgaggccaggacggatgacggcgccgtgagcctgtgctgcgcccaccaggaccggcccctcgtcatctggtaggtcttctccctctcgcccagtcccacgcacaaaaaggcgggggcgacgctcctcgcgccgtccccgcccgtcgcatcgccgcctgccagtgctagtcgatggcgaccttggtgacgctgtccttctcctggatcttgggcacgttcaccgtgagtacgccgttctccagctttgcggtcagcccctgcgtggaggcatccttgaggtacacgccacgggtggcctgccactcgccgctctccttgtgcaggtagttcttgcccttctcctcgtcggactccttcttgtccaccgagatcgagaggcggccctcgttgagctcgacgtcgatctggtcacgcttgacgttggggagctcggccgagaccacgtacctgtcaccggcatcctcgacgtccatcttgaagacgttgccctctgccgccgagacgagcgggccgccaaagaagtcgtcgaacgcatcccacgggaaggccctgcgaagtgccctgtcatagctgctataaggaatcatgctcgtcatgttcatcactccctgatgatgccttgtggacgccccgttaccgtgcgtccctgtgttcactcgtacttgttcccatgcgagggtgctttatacctcacgacaagattttcttagcttttgtgactaagcaaatctaagtccaatttgttagatgttgagagatgccgcaacggtttgggcaactgcgagagacatggcagatgcgcggatgtggcgttcaaacggtcgctagcccagcccccgtgttctatcatggtgcccgttatctgcttgaaaaatgccgctcccgcggaggcaccctcatgaacgacaacttgaacactggcaggcatgcaacggggtcccatccccgcagggagcatcccgtcgacgccgcgagggttcccgatcccctgtcggcgacgccgctcgaggaggggcaggacccggcccagggcagccccgcccccgcggagccctcggctgatgcgcacgcggacgccccctcttggctccagcaggacgagcagcgggtgaccgagcgggcacaggcccccatggaaccccagatgcccaccccagaccagggcacgcaactagcgcagcagggccagccgcagcacaggcccgccgcggagtaccgccagcgttacgtccgccagcgcgccccacaccgcacccaggcggccatcaacgacctcgagcaggacgtgagctatccggacggatacacccacaactcaaacatcacggtgggcggaggcgccttctcgggcggtgccaagtaccgtcgcggccgtgggagcatggaccgcatccagaaggggcaatacgggcgctacctcgagattcccaagggccgcaggtcaatcttcgcctcgcgggagcgcgctcggcgccggaggtctatcctctccctcatcgtggtcgtggtccttctcgtcatcgtcgccgtcatcatctggcgcctgatgggggccgcaggctagcgacggacgggcactagccccagggatcgcgctcaaagagcggttcgcgccgtgccgggcggtcggagtacgggtcgtacccgtcgtcgtcctcgttgggcgcgcgcaggaactcgctcctcggccccctcgcgcgagcgcccttgccggagttggaacccagcctcgctccgtcttcgccctcgctgtcccccgcgtcgccctcctcgtcgtcgagcaggtcgtcgtcctccaggggctcctcgtcagcgtccactgcccctctcccttcgcctggcgcgtccttggtgcgcgctcacttgtacacgtcgatgtaggctgccatgtcacagtagctcccgccaaagggcgagaggtcgtagttcgcgtacagcgacttgggggcacaggtcaccgagacgcgcgtgttgctcccctcgttcgcgatgagcacggtccacacgaggtcgcccatctcgccatacgcgcacacgaacgcagccgacgcctccttggtcccagaggggagcttgatcgtggagttgttgcagctccccctcatgcccgtgaggccgcagagcgtcatgaccccctggatggagtcctttgacaggtcgctgaccgagctgggccactccgagctgggcacgtcaaagcgcacgccctcgtagtcggcgcccttcgccatcacgttgtcgctcgagttgttgccggtctcgaaggtgtgcgaccaagggatggagctgaaggtgatggtgcccttgtcgcctcccgagtagagggcctgggccattccgtccgagttggtgtgcgagtacttgagggtgaaccccttgccggccaggtaggcgtcgagcgccttggaggagtaccccaggtagtctgccaggtgatggtagtcggagggccccttcctcgacaccgagagcgtgaccttggtaccgtcgagcctggtcccctgggcgggactggacgagacgaccgtgccgccctcctggtcggagtccacgtaggcgacgcttgcggtgaggccggcgtcctcaaggagcttggtcgcctcctcctcgctcttgccgaccacataggggacggtgacgggctgcgacaccgtgagcgtgaccttgtcgcgcgaggtgaaggtgcttccctcggcaggcgagacggacagcaccacgccgctgtcgccgtcagacgactggtattggagcgcgacgtcgcccgcaccctcgtcctcgagggcgttgcgggcctcgtcgaggctcttgcccaccaccgtggggatggtccgcgccttcccgatgctcagggtgaccgtgctgccggagtcgatcctgctaccggctgcggggtcggtggagacggcctttcccacgccgtcgtccacggcgacctcctggaccttgacggagaagcccttctcctggagcgccgccgtggccacggcctgcgacttgccggcgaccttggggaccgtgcgtccgccccagagctccagcccatacgagacgaacgcgccgccgccaatgaggagcgcgaccaccaggaccaccgccgcgacggtacggccgcagccatgcctctcgtcgtcgtccgtgtcgacgggcatcgggacgtcctccctgggctcgctcatctcgcacgcctcccgtcctggcagatgggtttccattaacgggattctcccacttcgcggcggctcggcaacgcacgccgacacgggagcggcggccgcgggcactcgatctgcccacggccgccgccgcaatctccttcgcccggaaggcctcgccgcctactcgatggtgtcgggctccacgggaccctcgtccgtgccggatgcctcgcgctcgaccgcggcacgggcctcctcctggctcctccggctggcctcctcgtcgcgcgtggcgaccaggttgtcatccgggccgacgtcgatgcgaacggtgtcgccctcgtggagctttccgtcgatgatgagcgtggccacgttgtccaccacctggcgctggatgaggcgcttgaggggacgcgcgccgtagaccgggtcgagcccgtcgagcgcaagcgactggatggcgccgtcgctcagctcgagcttgatcctctcgcggtcaaggcgctcgcggacgtcacgcagctggatgtcgacgatcttctcgatgtcgtcgaggccaagcgcgtggaagaccacgacgtcgtcgatgcggttgaggaactcgggcttgaaggtctgcctcagggcgtcgttgacctgcttctggaccacgtcgggatcggtggaggcgttggcgcccgcgatgaactggctgcccacgttgctcgtcatgatgatgatcgtgttcttgaagctgaccacgcggccctggccgtcggtgagcctgccgtcgtccagcacctggagcaggacgttgaagacgtcggggtgcgccttctccatctcgtccagcaggatgacgctgtacggacgcctgcggacggcctcggtgagctgaccgccctcgtcgtagcccacgtatcccgggggcgctccgatgaggcgctggacgctgaacttctccatgtactcggacatgtcgatgcgcacgagcgcgcgctcgtcgtcgaacaggcactctgccagcgcctttgccagctccgtcttgcccacgccggtggggccgaggaagaagaagctgccaatgggacggttggggtcggacagcccggcgcggctgcggcgaaccgcggcggcgacggccttcacggcctcgtcctgccccacgacgcgcttgtggagctccgactccaggttcttgagcttgtccatctcgccctgcatcatcttggacacgggcacaccggtccaggcgctcacgacctcggcgatctcctcgctggtgacctcctccttcaggatgccacccgcctcctgcttctggttcagggccttctcggcctcgtcgtactccttctgcaggctggggatggtcgagtagcggagctcggaggcgcgtgcgaggtcgccggcgcgcgtgacgcgctccatctcggtcttggcctcctcgatcttcgccttgaggtcctggacgtggtcgatggcgcccttctcgttctgccagttggccttcatgccgtcgagcttctcgcgcgtggtggctatctccttgcgaagggcctccaggcgctcgcggctcgcggcgtcctcctccttcatgagggcctgctcctcgatctgcatctgggtgagctggcggtcgaccgcatcgatgtcggcgggcatggagtcgagctccatgcgcaggcgagacgcggcctcgtccaccaggtcgatggccttgtccggcaggaagcggtcgctgatgtagcggttgctgaggtcggcggcggagacgagcgcggcatccgtgatgcgaacgcggtggtgctgctcgtacttctccttcaggccgcgaaggatgctgatggtctcctccacggagggctcgctcaccatgaccgtctggaacctgcgggcgagcgcctggtccttctcgatgtacttgcggtactcgtccagcgtggtggcgccgatggcatggagctcgccgcgtgcgagggcgggcttgaggatgttgccggcgtccatggagccctcggtcgcaccggcgcccacgatggtgtggagctcgtcgatgaacaggatgatcctgccgttggacttctccacctccttgaggacgctcttgaggcggtcctcaaactcgccgcggtacttggcgcccgcgaccagcgcgctcatgtcgagctcgatgatctccttgtcgcggatggtcgagggcacgtcgccggcgacgatgcgctccgcaaggccctcgacgattgccgtcttgccaacgccgggctcgccgatgaggacggggttgttcttggtgcggcgcgacagcacctggatggtgcggcgaatctcctccacacgaccgatgacggggtcgagcttgccctggcgcgccatgttggtcacgttgcggccatagtgctccagcgcctcgaactcggtcttggcgtcctgcgaggtcaccctgtcgtcgccacgaaggtcgttgaacgcctcctgtacgcgcttggacgtgacgcccatgctcttgagcgcactgccggcggacgtcttgtcgtcggcgagggcgcacagcaggtgctcgctcgtcacgtacgagtctcccatcttgctggcgagcttctcggcggcgtcgcccaccctcacgagctcgttggagagccccatctgcgaggcatcgcccgacacctgcggctcgcgcgccatggcatcgtccacctgtgcctcgagctgtgccgggtctgcgcccacgcgctcgatgatcgcgctgatgttcctctcgcccgaggagaggagggccttgaggaggtgtatcggctggacctggccagccgagtggtccgccgctatggagagcgcggactgcagggcctcctgggccgtcactgcccacttgtcaaatctcatacacacatcacctctccgtccctgcaaggcagagcctgcgggatcgctgcttatcgcaggatattgttcccgcatcaactggtttgtatacattatctaagtctatgtatgttagattttctgactccgcaagcaagaaaagcgaccgggggcatctctcccccggtcgcccttacacacccgtcgtgccgtccggccctactcgtcgttttgttcgcgcttgcggtccgcgtcagccctgtccctccccggaaggcgacccgcgcgcctcagggcgtcccgcaagatccactcgacctgcgcgttggcgctcctcatgtcgtccgccgcccagcgttcgacagcggcccagacccctgggtcaatgcggagcggatactgctttcgtgccgacatgagcgactcccccgacggactcgacgtgccttcctgcagcctactgatagagcgagccggcgttgaggacgggctgggcgtcggactcgccgcacagcacgaccatcaggtttgacgccatgaccgccttgcggtcctcgtcaaactccaccacgccgtcgtcggacagctgcgtcagcgccatgtccaccatcgagacggcgccctccacgatcttcttgcgggctgcgataactgcctccgcctgctggcggcgcagcattgcctgcgcgatctccggtgcataggcaaggtgggtgagacgggcgtcgtccaccgtgacgcccgccggggcgagcctacggtcgagctccgccttgagggtctcgcccacctcctcgatgttggagcgcagggtgatggaggaggagtccgcctcgtcgtcctccatgtggtcgtaggcgtagacgctcgcaacgtgcctgagcgcggtctcggtctgcatcgagacgaagctctcgtagtcatccacgtcaaagaccgccttggccgtgtcctccacgtgccacaccaccacggtcgcgatctcgatggggttgcccatcttgtcgttcaccttcaggcggtcaccgttgagcgtgcgcgcacgtgtcgagatgatcgagccatgcttgcgcccgcccagggaacgcagacccgagctcgaaccatcatccagggcatccgagctcctgccaaggctccgcgcatagagcgggttcgcccagcggaggccatcgtcgcggacggttcccacgtacttgccaaagagcacgcagatccgcgcctgaccgggctgaaggctgaagaagcccttgctcaggaaggttgccgcgatgaagacgacgatgctcgccaccatcatcgcgacgagggacccgggggcatccaggcccatctcgtcgtacgagtcaatccccatggcggcagtcacaaacacgtagacggaccagacgtacgccagcaccgtcacgcacagcatgagccagccacttgcggcgtgtgccttcttctcggtggtcatcagggttcctttcgctcgcggagaacgcgtcccccggttggtgacgccattctcgttgagggaattctgatatcacatcgatttctcttcaacaccgttcaccgacatattttggcaagtgtgtccaacaaaaagcggaggccgagaggtccctccccctcggccgccgcagcacacccggctacccacatacatcaagtcgcaacgttctcctgcgcacccctattccagcgtgcgcatgaacgcggagattgccgcaaggcccttgcgcaggtcgtcagggttgtccgagtacgcgtagccaatgcgcatgctgtgaggctcctcgaaggcgtcgcccggagtgaccagcgccccggtggtctggaccatgtccacgcagaagtcgtaggagtcgatgtcgtagtcgtagtacacgagggcggtcgttcctgcctccggcctcacgaacgagaggtgcggctcggaatcgacccactcctgcagaacgttcaggttctggcggacgatgcggtggctgcgctcgaggacggcatcgcgatgggcgagtgcgtacgcggcaacctcctcgtcaaagagcccgcagctgatgaggttgtagtcgcggtggctcagcaggtcgtggcgcagcttctcgtccttcgtgatgcaccaacccaggcggattcccgccatggaccacaccttggacatggagctcacgaccacggccttgtcgtacaggtcgattggcgacgtggtgaaggcgtcgctgtcctggaccagcagacggtagacctcgtcaaacacgagccacgcgtcatgcttgcgggccacctccacgatgccacgaatctcctcctcggagaggagcgcgccggtggggttgtcggggttgttgatgcagatgaccttgacgtcgttcccacaaagctcgttgagacgcttcgcgtcgacgtggtagcgccgctccttctcgaggtgcagaatgtcgaccttagcgccgcacatctccggaatcgaatagagctgctggtaggtaggcataaccgagaccacatggtcacccggctcgcaaagggtcgtgagcaccaggtggtttgccccggcggcgccgtgcgtgggaatcacatgacccggctggaccgtctgatacaggctgcagatgccctcgaggaacttggggttgccctcgatgtcgccataggtcagtcggcgggcgcagaattcgttcaggaaggcgtcgcgcgcggcgcgtcccgcgtcggtcgagccctcgcacagctcaaacagctcgtcgagcgaaatcgagtaggtacaggtctccgcaacgttgtacttgcacttggtctcccaggagttcatccactgctcgaccttgaagtccttgatcttcatgctgtcctccgtcccgggcgctggtgcccgtcatccatgcgtcagatcccctcgggtgcaaccggaacctagagctccaccgtggtccccaggccgcgctcgaccgcacggtcatacgccatgcgggaggcagccaggtcctgcaccgcaatgccggaggtgtcaaacaccgtgatctgctcgtcggacgtacgtccaacagccttgcccgcaatgacctcgcccagctcggcgacgatgtcatccgccgtgatggccccctggctcacgggaacctcaagctcgccggacgcgaccgactgtgcacggtcatccacgtagagacgggcgctgctgaccagcttggaggagagctcctgcttgccctccatgtcggcaccaacggcggagatgtgcgtgccaggcttcacccactccgcctggatgattggctcggtcgccggggtgaccgtgatgatcgcgtccgccttgtgggcggcctcctccccgctcgcaaccgcgacgatctggaaggagcgctcgacgcctgcctgggagagaatctgcgccacctgctcgcgcatgagctccacccgggactccggcgcctcctccttgcgggggtcccagacctcgacacgctcgatcgactcgcaggcggcaagggtcgccgccaccacgaaggtgctcatgtggcccgcaccggcaaccatcaggttgcgggcatccttccgggcaagccacttgacccccaatgcagcagccgcgccggtgcgcagccccgtgatggcggaggcgttgagcagggcgaggggtgcgcccgtggtgtcatcgcacagcaacgtggtgccatagatttccgggaggccacggctcgggttgcgggagaaccatgccgtcagcttgagaccaaagagcccactcgcggaaagctcgcccgagcggatgtccatgtcggagacgcccggctcaaactgctcgtacaccatcggccacgcggtaccctcgccctctgccttctggcggtatgcgtcctcgaccgccgcaaccgcatcggtcacggtgaggaccttcgagatgccatccgccgagagaaccctgatctgcgccatgtgctcatccgttctgtcacgggctcctgtttccggcctgcccgtcgcgcgggccccattgcccgcgcctcgtatgccgatgactctacgcgcgcgtaggtgaactttcgagggttcgtttttgtagtggattacaattagtttaaactgttccatatcctattcatcgatttgttaccattcatccaatatttattgtgtttctgtacaatattcatatctaattttgttaggttttagtccccatgatatacaccgtatctgacttcttgaactcgtacgcagaaagcgtccgcctcatcgctggccagggcggactctcccgcgctattggccaggtcggcatcctggactacgagctcatgcccggtctcaagactcgctaccagcgcgtaaacttcgagcccgaccagctggtgctaagtaccttcatctatgcgagggacgactcatggctcatcggcgaggcggtgaagtacctggtcggcaggggcgtcagcggactggttatcaagaacgtcctccacctcgaaatcccggattccgccgtgcgctacgcaaatgcgcgcgatttccccctatttgtgacaagcggtgacggcttcttcttcgacacggtgatcgcccaggtcgaccgacgcgtggcggagctggcggacgcctcgttcgcgcagaacgagcttgacatcatgacgcgcgacgacacaccaacccagcaggttcgcgagcacgcgttgcggctgaaccccagctttgacgaggagcacgtggtcgtctacgtcgcggagcccctgtcgcaggcggggtttgcccaagccctctcacgctatcacgagagcaggctctccggcctgcgcaacctgttcgcgccgtatggggagggcttgctctacgtgacgagcggcgactcggacgcgattggcgaccgagggcaggtggacgacatggtcagcgtgctcagagctgaggtgctcgaccatgaggtctcggcctcggtgggcataagcgagacgcactacgacctgggcgagatgaatcatgccgtgctggaggcgcgccgttcggcgttggtggcacgaggacgcggcggtggcaccgtgcgctatgccgacttgggggtcctacgggtcctcctgccctttgcggaccgccccgagatgcgtgacttcgcaaacgacgtgctcgagccgctgcgtagccacgacgcagagaccggctcggacctcatggagacgctcgcgtcctactgcgacgccggatgctccatcgagggggcagcgcgggccctggaccagcatccaaacaccgtgcgctaccgcctggacaaggtcgccaaggtgaccggcctcagctacaaggtgcgcgagcagagggagcagctctcggtggcgcacaagatcgagctcgcccataagctgcttcacgagtagccaagcgccaccgggaggtgtcccggccgccagcatgccctcgacccagacacaaaaagcccctctcccgcaccattggggagaggggcttgcccatgcggcaaccaccatggagagacgccaggggcctcaggcgtcgcggtcctttccgttggagagaaggccgcgcatgacctgctcgggactcgacccgtcgtagcgcgcgagggccgtgatcttctccctcatcctgaactcgtggacctcgtcctcgagctcgcgcacccttgccctgagctcgtcgatctcgcggtcgcgctcttccgcccgctccctcatgtccaggatgcggacgacgcccgcgaggttgatgccctcgtcggtgagcttgctgatgaggttgagccgctcaatgtcgtgctgcgagtacagcctggtgttgccccgcgacctgccggggttcaccagccccttctgctcgtagacgcgcagcgtctgggggtgcatccccgtgagctccgcggccacgctgatcatgtagaggggcttgtccttgccctcgccctccttatgcgccatagcggtcgacgtccttcctgtatgcgcgcttgtctgcatcgcgcaatgcggtgagcgcctcgcgctcctttgccgagagcctcgtgggaaccttcaccctcaccttcacgtacagcgcgccacgggtgcccttgtgcttgacgtcgggggcaccgaggtcgcggaaccggaaggtcttgccgtcctgcgtccccgcgggaaccttgaggcggacctccgtgccgtcgggcgtgggaacgtccacgctggtgcccagcgccgcctcgtacgcgctcacgggaagctccatgcgcacgtccgcgccgtcacgcttgaacagcgggtgctcctggaccttggtggtgatgaccaggtcgccgcgcgccccgccgttcacgccgtactcgccgcggttgcgatagcggagcttgccgccgtcgaccgcgccggcgggcaccttcaccgtgatggactggcgctcgcccgtggacgggatggtgtagctgaccttgcgctgcgcacccttgaacgcctcgtcggcaccgatctcgatgctcatcgtgaggtcgccgcccttgacgggacggttggtcgcgcgcgcccctccgggctgcccgccaaagatggacgagaagtcaaagccgccaaaggcgccatcgccgccacggatgttgtcgaagatgtccgcccagtcggcaccgcccatgttggtggtgtacgtgtagcccgtgcggttgcgcccgccggagccgccgaagtcggaaccggggatgccgccaaacatcagcagctggtcgtactccttgcgcttctgggggtccgagagggtcgtgtacgcctcgctgacctccttgaacttctgctcgtccccgcccgcgtcgggatggtactttgcggcgagctttcggaacgccttccttatctcgtcgggggtggcgtcacgcttcacaccaagcacgtcgtagtagtttcgctttccagccatgagaagccaacgcctcctttcacatgcacgcgcccgaaccgtttgggcccgggcgcgccgactgaccgttacttcgcgtctccgtcgccaccgggggccttctccgagtccccgccgtcagaggcgtccttgccttcctcgggctggggcctcttcgggcctccgtaggtcaccgtgaccatggcgttgcggatgaccttgccacccatccggtagccccgctggtacacctgggcgaccgtctcgtcgtaggcgtccttgttctcctcgcgacccaccgcctggtggaccagggggtcaaagggctcgcccttggggtctatgacctcgacgccctccttgcccaggatcgagagcatcttgtcgtgcacggcgtcgatgcccttcacaaactgctcgaggttctcgtcgccctcggcgcccttcgccgcgtgctcggtggcgcgctccatgtcgtcgagcaccgggagcaggttggtaacgagcttctccgccgcacgctcgcgctcgtccaggcgctcctgggcggtgcggcgacggtagttgtcccagtctgcctggagacggacgagcctgtcggcagactcggaggcctccttcttggcgtcggctatctccttctcgacgccatccagcttcctctgcaggtcgtccctctcggcacggaccttctccacgtcgaccttgagctcgtcggccgccgccttctcgcccgcacgcttggcggcctcgaccatcgcgacctcgtcctcttcaggggtggtcgcaggagagaccccctcgtcccccttgtcgtcgggcctcttgtcgtcgttgacctcgatcggcactttcacgtcaccctcctcgggatagtcctggggggacggccttgcggccgccccctctcgcgttcattcaactgcccgtgacgggcgcgcgactgctacttgttgtccttgtcgtcgtccacgacctcgtagtcggcatccacgacgtcgtcgccgttgctggcgctgccgctgggctgctggctgccgccctgcgcggtctgggcctgggcgtcggagtacacgacctcggcgagcttgtggctggcctcctgcagcttctcgccagcggccttgatggcgtcgatgtcggtgccgtcgagcgccttcttggtctcgtcgatggccgcctggacctccttcttctggtcctcggagaccttgtcgccaaggtccttcagcgtctgctcggtgctgtagcacagggagtcggtctggttgcggacctcgatgtcctccttgcgcttcttgtcctcctcggcatgggactcggcgtccttgaccatgcggtcgacctcgtcgtcagacagcgcggtggagccggagatggtgatctgctgctgcttgcccgtgcccttgtcctttgcggtgaccttgacgatgccgttggcgtcgatgtcaaacgtgacctcgatctggggcacgccacgaggcgccgcggggatgccggtgaggttgaacttgccgagcgacttgttgtccctcgccatctcgcgctcgccctgcaggacgttgatctcgacggaggtctggttgtcggccgccgtggagtagacctcggtcttggaggtcgggatcgtggtgttgcggtcgatcatcttggtcatgacgccgcccatggtctcgacgcccagcgacagcggggtgacgtcgagcagcaggatgccggacacgtcgcccgtgaggacgccgccctgcacggccgcgccgtcggcaacgacctcgtcggggttgacggacatgttgggctgcttgcccgtcatctgcttgacgagctcctgaacggcgggcatacggctggagccgccgaccaggatgacctcgttgacgtcggacatctggaggttggcgtcgcgcagcgccttggtcacaggctccttgcagcggtcgagaaggtcgcgcgtgatgcgctcgaactcggcgcgggtgagcgtgtagttgaggtgcttggggccgctggcgtcagcggtgatgaagggcaggttgatgtcggcctgctgggcgctggagagctccttcttggcgttctccgccgcctccttcaggcgctggagcgccatggggtccttgcgcaggtcgatgccgttctcctgctggaacttgtccgccatccagtcgatgacgcgctggtcccagtcgtcgccgcccaagtggttgtcgccgttggtggcaaggacctcgacgacgccgtcagcgaggtcgagcagcgagacgtcgaaggtgccgccgcccaggtcgaacaccaggaccttctggtcgatgcccttcttgtcgaggccgtaggcaagtgccgcggcggtgggctcgttgacgatgcgcttgacgttgaggccggcgatcttgccggcgtccttggtggcctggcgctgggcgtcgttgaagtatgcggggacggtgatgacggcgtcggtgaccttctcgcccaggtacttctcggcgtcctctttcatcttggagaggatcatggcgctgatctgctcgggcgtgaagtcctcgccatcgatctcgacgaccgcgcggttgccggtgccggccttgaccttgtaggggacggtcttgagctcgctcgtgacctcgtcgtagcgacggcccatgaagcgcttgatggagaagacggtgttctcggggttggtgactgcctggttcttggccgccttgcccacgatgcggtcgccgtcgggacggaagccgaccacggacggggtcgtgcggtcgccctcggcgttgacgatgatggtgggcgagccaccctccagaaccgccatcgcggagttagtggtaccaaggtcgattcccagaatctttgccatggtgtgagtcctttctgcctgcgcgcgattccggcggctgccggctgccaacggccccatgccgcctcgcgcctttctttacgtctgctatttttcccatgcgctccgattctatacattatctaagtctgacactaatagattttttgaggctgagattataggttccctaagtgcccgcaattggccctcccgccgaggttagaggtgccatggagtcgggggcgactcccccgtgatcgcgccaccgcgggccttggttgtggcaccatcgtgtggcgcgggcgagactgcctcgccccacacacgcaaccacaaagggggagagacacatgcgccttctcatcgcatccgacatccacggggcggcggactggtgcgagcgcctcatgcgggcgatcgacgagcagcaacccgacagggtcgtgctgctgggcgaccttctgtatcacggcccacgaaacgaccttccgggggactacgcccccaagcgcgtgatctcgatgctcaactcgctggcagacgacgtcatcgccgtgcgtggcaactgcgaggccgaggtggaccagatggtcctctcgttcccctgcatggccacgtacaacgtgctgtacgaccccgacagggatcgcgagctgttcctcacccacggccacgtgtacgggcccggggtccacaacagcgtcgacaactggccccagatccccgaggggtccgcgctggtctacggccacacccacaagcgggtgagcatggcaagctccgagcatcccgggtgctgggtattcaacccgggcagcgtgggcatccccaaggatggcgagcacagctacggcatgtacgactcgtccctggacctgccgttctcccaccacgcgctcgcgtagggacacttcccgagggggggtcacgcggaggcgctcgccgccctggcggccctcgcggacacccctcacccaaacgcagaatagacggtctcccctctcgcctgttggagctatggatgagggggggtactcccatgcgccgggacgccatgccgcccggtgccgacggattggcggtgacgctatgaacaggaagctcgaggccgaggcgctgcgcctcacgcacgaggccatcgccagcttctggcagttggacatcaagccgattctctcgctcgcggcagacgacatcatgtgggtcatgcccgaacaggagcgctacatgcgcggcattgacgcgatgcgggcagacctcgaggccaacctgcgagagctggttccctgccacatgtcccacgtggagttcacggtggtgcagaactgcggccgcgccctctcgatcatcggccgctacctggtcacgaccgacgccggcgcgcccatcttcctgcaggtgcagcagaggacccagatcaactgggagctcgttggcgaccggctggtggtgaggtccctctacatctcgcacccgcgcggcgagcttgccgttgcccggggcgagacgttcgcgaacgccatcggccgcatggcaaagcactacctggacgagcgcgtggcggccgagacggacctccgccgggtgcccctgcgcgatgccggcggcaccatgcacctggtgtcctcctccgacgtcgtgttcgtggaggcgagaaggaagcggtgcctcgtccgcaccacctacgaggacattgacgcccgcatgggaatcacggaggcacgggggcagttccccgagcttctggcggcacaccgaagctacctcgtgaacccgcgctacatccgctcgttcaacgaggactcgctctcgatgtccgacgggacccaggtcccgctgcctcgtcccagacgcgccgaggtcatcgcgcgcatcagggagatcaccgaccccaggtgacccagtcggcgactgcctggttggcggtgtcgcgatgcttagcttttctggggctcgcacggatgatttgacggcgatgcttaatctcaccggagctcgcacggcttttgagacgaaaaatccgcttttgcagaaagttggtcttccgccaggactagctccgcggccctataatcaccacaggacatagccatccgccagaatgccgcggtgggtggcggcgatctggcgattggtagtccacgggcagcagcccccgaccgcggcagcagggactaccaaccatgagcggcacgagtggcacgccccgtctgcctcggcgacgccctgggacggcgtcccggacgccgaactgacgccggcacagctggccgtcagggaccgccataggagcgtgtacgatttccgccaccgttctctgatggagaccggggacgcggacttcatgaacgggtacgagagggaccgctgccccagatgcggagcggccacatccagcgatggggccacgaggccgatggcgcccgccgctggaggtgcgcgtcctgcggcagaccttcacgccggcaacgggcacgtctcgagggacaccaagctccccgtcgccgactgggtcgagttcatgtgccaggcgttcggcttcgagagcctaaggcgaaaaccagggaggacaggagggcggcaccacaccgcctggtggatggccaagctcttcgccgtgctggagggcgttcaggacgcgtcgtgctctcgggcgaggtccagatcgacgagaagatgcacccctcgccgccagggacagggctggaggggagggccgggatgggcgcgtaccgagggacaggatctgatcgccgtgggatgcgacgactccggcagaggcctcgcggtgcgggctgggctcggcagctcagcaagtcgaggtgctgggacgcctacggcggccacatcgcccggggggcgacgctcgtccacgatggagaactcccactccatgctcgtcgagcggcttgggctgacgagcgtcgcctacaggtcggccgacccaggggctggacgacaccacaacccgctctcccgcgtcaaccacatgcaattcctgctgaaggagttatgcaccgccttccggcttcgagcgagaccgcatcgacgatggctcaactgttctcggtcatcgtcaacccacccgagaccggtgataggcccgtcccgatttcgctgccctacagggagtactacgagagaagtgccagctcggaggactagcagctcagaagtttaccaactttctgcaagagaggattttgagacgaaatgcttaatcccaccggtgcccgcacggatgtgactcatcagattccgtgcgggcaccggactttctaagcagaccccttcagcggctcgtgcgagcaccggactttctaagcaccgcgcgttggcggccacggtgacgccaacagtagcctagccagaggctgatagcaccagcccggcaggcagggtgcgcaccttggccccaaaaacacgaccccccgagccgactccttcggggagtcccggctcggggggaggtccgccgccaggcgagagacgcgggcggccggtgggatgagtcacctagctggcgctggggtttctctcccccttcatctttgcgaacgccacgaagcacaggatcatctgcaccagcacgaagaggaagtagatggggaagagcgccatcgccacggcatacatgatgccggcgacgagcgcgaacggtcgcttggacatcgcgaatgcgagggcgttgaacaccactgccaccacgaccgccaccaggtggggcatcacgagggcggtcgccatgagcgcgccggcggcctccgcccccgagcccgacgtggacgccccgctccaatagacgaggctgtagaccagatagagcgcccccagcacgagggccacgagcaggagcttgttcctcttcacgatgtcctccctatgcgagcgagaaggtcttctcggcaagggtcgtgttgtcgaggttgacgatgggatagaccttcacgtcgatgtccgacgtgtcagagacgccgtaggccagctggacctgcgtggagtttcccgcctgcaccttggtgagcgcggagttgccatccaccgagtcgcagatgacgaggtcgcactgaacgccgttctggtagacctcggaatacgcggccgtatcgaatgcctgggcgtccttgtccgagacgttggtgaaggtgtaggtgaccacgacgcaggggttgccctggtagtcggtcgccatctgggcgccatcgaccgtcacggcgacggactgctgctcctttggcgcggcctgctcggcggcggagtccacctttgccgcagaatccgtgccgcccgcagactcccccgagccaccgcaccccgcgagtccaagggacatcgacgcagcaagcgccacccccagcacgacgcttcccgcacttctcctcatggcgctctcccttcgcgcttgccttgcccctccgggccgtgcacccgatggtatttggggagctgaggcaaaacttccgctgggagcggagttctggcgactggcgatgccggcagctgtctacgcgatggcgatggcgtaggacagggcggcggcgagggtcagcaggcagagcgcgaccaggtgggccaggatggcgaccacgaggctgcgggcccgatgggggcaaccctcgtatcggccgattcccagcgcacaacccatgcactccagggaaatcgccacgacgtcggcgcagatccccaggagcaccacgagggtgggggcggcgagcggcgccggcatcgccagggactgggccgcggaggagcacgcaaaggcgacggcgagggcgacgcatgccagaagcgagacgagcgagaccaccttgcccgggcgattcggcagcgccatgagcgagcggagctcggcgggataggactgccagagggtgagccatcgacggaggggcgagcgcccctctcccctgcccgccggatggcggtggcgtggggttgtgggcgagagggacgcaacgggctcggcggcatccgcctcatgggcgagaggggatgatgcgggggcggcgacgggctccgccagcgccgaggcggcccgcggctccgaggcgcctggccccacgtggtcgaacggggtggacggctcgggctgctcggcagctgacgcgccggggcgcgttgataccaccgcggattcggcaggcccccgtacgagcgcgtcgcgcgccgccgcgaccagctccccaacgtcctggtacctggcacttggctccagcgcgcatgcggtggcgacgacctgccgcagggcggaaggcgcgcccgcgtcgctaagcccggcgagcgagcccgcgtccctggggtggcttcccgtgagcatgaactggaggagacggcccatggagtacacgtccgagcgggcgtcggtctgggcaaagccaaactgctcgggggcggcataccccaccgttcccagcgtggtggtgtcgcgcagcgttccgtcgctgtgcacccgcgcgatgcccaggtcgatcaggtgagcgccgtcctgggccacgatcacgttggacggcgtcacgtccctgtggaccacgccgcgggcgtggagcgcggcgactgcctcgcccacctgcgcgaggagccccaccgaacgcccgggtgccagcgggccctcccgctggaccaggtcggcgagcgtctctccctccacgtactcgtagaccgccacgagctcgttgggcatggcatacaggcacaccatgcgaggaaggcgcggctggtcgatgccaaggagcgcgccccacgcctccgggtttgccaggggccaggcgatgcgcttgcgcaccatgggcgagccgtgcggaaggctcaccagctcggtcctgcccgtctcgcccgagccaaggacccgcaccaacctgaacgagtcgtcgatctcgagcgcgtgcaacagcccggactccgaggcgtcatcgcccgacacgggctagcccctctcgggggtgagggtcctctcccccaggcgatacagctccgcgtcggcgcgcgggaggtcgtacccgtgctccaggcagaagatcaggatcgcgtcgcggcggcgcttgggccacagcgcgccctcgtcggcaagccgcagcagacgctgcgcctggcgcaggtcgcaccccaggcagaaggcgatgcgcagcaggaactcgcgcgtgggggtgcgctccccggcaaagatctggtacacgtagctcgcccccatgccgcactcgtcggccacggcggcgcggctcttgccgctcgcgtccagaagcgcgaagaggtagccggggaggtcgcggttgggcaggtccacctggtcgaggtactcctcgggagaggcgctcctgcgcagggcctcgaggagctcctcggtcaggggctcgtcgtcaaacccctcgtgggccatcggacgcctggtcatgtggtcacctctcgcaccgaaacgggtcggacgctacgactcgaacttgtcgaccatgccgtcggagtccgccttgagcgacgcgatggcctgggggaccttctccagctcgtagggtgtcatctggtagacccagttgagccagttgcgatacagcaggttggcgtgggcgcgccaggtgaagatgggctggctctcggggttgtcgtcggggaagtagttctcgggcaggcggatgggcatgcccttcttgaagtcgcgccagtactcggatgccagcgtgtctctcccatactcgaagtgcccggtgacgtacacctcgtggaagtcgcgcgtggcgatgatggcagggccgctctcgaacccctccgagaggacctgcagctcgggatggaggcgcagctcccccgcgtcgatcgcggcgtgacgggagtgcggcatgtagtggacctcgtcgaacccgttggtgaggaagctgtactcgtcgcgcaggcgctgggggaagacgccgaagagcttgtgcggcaggagcctcttgtggatgccgtacaggtgccagagtccggccatggcgccccagcacaggaacatggtgctgagcacgtgctcctgcgaccagtcgatgatgcggcacagctcgtcccagtagtcgacctccgagaagtcgaggtgctccacgggtgcccccgtgatgatcatgccgtcgtagttcttgtcctcgaaggcgtcgaacgtgtcgtagaacttgaccaggtgatcctggctcacgtgcgtggactcgtgcgtagagacgcgcatgaagtcgcagctcacctgcaggggcgacttgctgatgaggcggaggatctgggtctcggtctctatcttggtgggcatgaggttgaggatgaccacccggagcgggcgaatctgctgcttggtagccgcctcctcctcgagggcgaagatgcgctcctgcctcaggatcttcttggcgggaaggccgtctgggatgttgatgggcatggaaactcctcacgtgcgatcgtgcgcgggaaactgacggggcaatggtgtgcaccacgccgcgcatggcggcatggcgctagcgcattcgctgcgtaaggcctatgcgtgtcccgttccagcacatggcgccgttggctcccctccgctttgcgacccgaccgatggctggctcgcaggtctcagggtagcagctttgcgggggactgggggagaaggacgtaacggaggagctgcgggaatcccctcgcgccgggtttccgaccaaagaatccgcagctacacgccactctcgtttggcagggacgccacgttgacgcatacttaccagtatggatacgacatttgccgagctcgggctaaacgagcacatattggagggcgtgcgcgcccttgggttccagattccaacgcccgtccaggcgcaggccatcccccaggtgctggcggggcgtgacgtcatagcctccgcccagacgggaacgggcaagacggcggccttcgcgctgccggtcctgcaggtgatcgagccatactcgcgcgaggcccgcgccaaggcggaccaggcgggcagtgctccgcagtcccaagcccaggccgacggtcccgcagggcgcgacgaggacgacgcccccaccaaccccaacacccccgacgtcatagccgatgacgttgcggaggggtcctccgtctccgccgacgtggaccagagcgggggcgtgtcgcagcccaagcgccgcgcccggcgccggcaccacaaggcgaaggtgtccgcggagaccgacgagggtgcctccacaggcgagagggacaaggccgtctcgcctgctgcgaccccctccagcagcagttcgggggaggcgtcctccattccgacgcccgccaagcgcaagcgtcccaggcgcaggcgcggtggcggcaggtcatcgaagcaggcacgcaggaccacctcggacgacagccgcgaggcaaaccccaacgcccacccctttgggccattcgccctggtggtgacccccacacgagagctcgcgcagcagatcgaggacgtggtgagcgtggtctgctcccacaccggccaaaaggccgtggtcgtgatggggggcgccaagttcgaccgacagatcagtgagctggaggcgggatgcgacctcctggtcgccacgcccggccgactcatcgacctcatggagcacggccacgtcaggctcgacgacgtgaaggtgttcgtcctcgacgaggcggaccgcatgctcgacatgggcttttggcccagcgtcaggcgcatcgtggcggcacttccccgcgagcggcagaccctgctcttctcagccactatcccgccgtcgatcaagggcacggtcgacgcgatgctccgcgaccccgtccagatcgagatcgcgcacattggcgagacggccgacaccgtggaggagcacctgtgccccgtcacgcaggggcagaagacccagctgctcgagaccctgctcaagaccggtggggcggcgggcgaggccccggagcgcgtcctggtgttctgccgcaccaagcacagggtggacgacctcgaaacgtacctcaaggcggcaggcatcaaggtggacgtgatgcacgcggaccgccctcagaaggcacgcgagcgggcgctcgagcgctttagggacggcaaggtgcaggtgctggtggcaacggacgtgatgagccgcggcatcgacgtgagcggcatcgacgccgtggtcaactacgacgtgcccatggacccggaggactacgtccaccgcatcggcagaaccggacgcgcgggtgcgacgggccacgcctacaccttcgtagcacccgacgagataagcccgctgcgcgagatcgagtacttcacccacaagctgatacccgtgtgggaccagccgggctttgactacgactcctcgcgcatcgtccccaaccccggaaggtccaccaccaagcccaagcgcaccatgttcagcgggtcgcggtcgcgcggcaggggcatctccgccgggcgctacggcaggcactactaggagataggctcgtggccacatcccccggacacctcccgccggcattcggggcccctcgatcccatcccatctatggagcctgagccaccaacacacgagagcgcaagacgcccccgccggaaccattccggcgggggcgtcgtcgttctaggggagcgtcgcaggcgctacgcgtcgatgggcgacgcggtggctgccgccgcctccgcggcgtcgcgggcaacgtgctcgcggcccatctcggtccactcgggctcctcgtcggggatggagcctggcttcttggtgaagaactccttgaggcagttgtacgagacgatcaggcccagtgccacgagcagcacggcaaacacgagctggaggccggacgtcgcggcgacggagaccatggtgcccgccgtggagcctggcatcatgccaaacaggccgtaggtcgagatggcggtgacgcagccgatgatggactgcaccagcgaggtgaacgtgcagcacagcaggaacgcaacgggaacgtacagcatccagcccttgcgcccggtgcacttgcagaacaccgcgagcgtgatcatggtcatgccgcccaggagctggttggaggcgccaaagagcggccagatgttaaggtagccgccaaaggtgagcgacaggccgccgatcagcgtcacgacggtggcaaaccaggggttgccaacgaccctcatggcaccggtcctctcctgcgaggcggcgagggcatcgtttgacttggcgaagaactcggagaacgaggcgcgggcgatgcgtgcgacggcgtcgagcgaggtgagggccagggccgagacgcacatggtcatgaacaccgtggcgatggtcttgtccatgccaaacatggtcatgcccttggcgatgcccgcggcgaagatctggaacggggtggaggcgacaccggcgttgagggagccggtcccggcggtgttcatctcgccatacatgaccgccgcgacgacgatggcgatgacgccgacaaaggactcgagcaccatggcgccaaagcccacggggagcgcgtcggtctcgctctcgacctgcttggaggaggtcccggacgaaaccaggctgtggaagccggagagcgcgccgcaggcgacggagacgaacaggacggggaacagggtggagccagtcttggtggcaaagccggtgaaggcgggggccgtcatggtcgcctggccgctgaagcccatcacgacgatgccgaggacggcggagaggatcatggtcaccatcatgatggtggtgaggtagtcacgcggctgcttgagggtctggatgggcatcgccgcggcaaagaccaggtagaccatggtcacggcgatccagccgttggcgtcgaggtagatcgggaagcgcatgccgaccgcgaacatcacgaacatcagcacaaccgcgaccacgaactgcttccagcccttgaggtcgaacttgcggcagaaccagccaaagaagatggcaacgagggtgaagagcagcgagatggttcccgccgcaccgttggcgaacgagccggcgatgtccacggaaccgtccgccgcgaccttggtcgcaaaggtgccagcgaccatggaggtaaaggcggcgatgacgatgaggcagaacagccagctgaacagcaggaacagacgacggcccgccttccctatgtacttctcgatgagctgggccagggacttgccgttgttcttcatggacgcgtagagggcaccaaagtcgtggaccgcgccaaagaagacgccgccgacgaggacccacagcaggacgggcacccagccaaacgccatcgcgacgatggttcccgtgacggggccagcaccgcagatggacgagaactggtgagcgaacgcggtgaatcgcgaggcgggcgtgaaatccttgccgtcctccatgcgcctggcgggcgtcagcgcctcggcgtcgaccccccaggagtttgcgagccagcggccatacgcaagatagccaatggccaggaccaccgcagcaataacgatgaccaccaatccgttcatagtagaaacctcccttactccataaaaggggacgcgcgacgcatcgcgctactcaacgtggggaagcctctctcccccgttcgcgaagtgaggagaatggtaagtctgaaaaacaattcggtaggcgcttcgaaacatgcggttaacggtttttctgtcgatgacgtgttagggtcagctgttttgggaagaaggcgcagcgttacggttgaaatgttcagctatctgtatacacgtttgattcagattcacaaatgcatccccatccactacttgtcagctcgattgccgcaagagggcgtgggcatcgaatgcgtaggttctcgtagggtctgcggggatgcgacgcgattcggcactcgcttcgccagaatggtgggaagaggaacgttggcaagcaagggggagattcccgcatgaagaaggtccggccgtacccacaggcagtcatctctcaaaaggcggcgcgcgcactcaaggcaggccatccctgggtgtttgagggagaggtcaaggcgattctcccctcccccgccgacggtcgggaggccgcgaacggcgacatggttgacctggtggaggagaacggcacctggcagggttcgggactcgtctcgatggcatccaagatccgcgtgcgcctggtgagccgcaacgccaacgaccgctttgacgagggcttctggcgccggaggctccagtgggcgtggcagcatcgcaaggtgaccatgggcgccagggcgctgccggggtgcgagcccgacaccaactgctgccgagtcgtgttcagcgaggcagacgggctgcccggcctcatcgtcgaccgctacgaggacgtcctcgtcgcccaggtggggacggtgggcatggagcgcctgaaggggatgctcctgcccctcctcgtgcgcgtgctgcaggaggacgggcaacggatcaggggcgtgtacgagcgaaacgactcgcccgcacggacaaaggacggcctgccgctgcagaagggctggttcgacttctctggaacggacctctcgctccccacgccggagtccgcccgcgtgatggtgcgcgagaacggcatcgcctttgaccttgacgtcgagaacagccagaagaccgggttcttcctggaccagaagtacaaccggcgcgccgtgcgccagatcgcaggcggccgccgcgtcctggactgcttctgtcacgtgggcccgtttgggctcaacgccgcggcgggaggggccgacttcgttcgctgcgtcgacgtgagccagaccgccatcgaccttgcgcgcgagaacgcccggatcaacgggctcgatgccggcatgggattcacctgcgccaacgtgctggagtatctcccccagctcgcgcacgaccggcagttccttcgcgacgaaggcggtccctttgacctgatcgtgctggacccgcccgccttcaccaagagccgcgggaccgtgcagcacgccatcaagggctatcgcgagatcaacgaggcggcgatgcgcctactgccccgcggcggctacctcgccacgtgcagctgcagccacttcatgaccagggacctcctcgcacgcgcgatatcggaggccgcacacgccgccaacgtgcagctcaagcaggttgaggagcgccagcaggcacccgaccaccccattgtgtggggcatccccgagacccattacctggacttcttcaccttccaggtggtgtaggtaacagcagccgatgccaagccggccgctattgccaaaccgcgcctaggcggagaagtcctcggcgagcacggacgagaggattcccacgtccaggttgccaccgctcatgacgagggcgacgttcttccctcccacgacgtccgggtagtcgcgcaccgcggcgaccaccatggcgctccccgcctcgacggcgagctgctcctgctcgatcatgaacttgaacgccgagcgaatggaccgctcgctcaccacgaccgtctcgtccacgtacttgggatacatctcgtaggcgatctcgccgatgccgcccacgattgcctcgcacacggtgtcaccgaccgttgggtaggtgtggtagcacacaccgtcctcgagcgactgcttcatggcggggcacgcctgcgtctgcacgcccaccacgcggacgtcggggcgcacggactttgccgcaaccgccacgcccgtgctgagcccgcccccgccaacggggacgacgatggtgtcgatatcggggttctgctccaggatctcgagcgccaccgtgcccgtgccgctgtagacgttggggtcctggtcgtagggatccacgaagaacatctctgcgcggtcgatgtagttgagccccaggacgaccgcatcgtcgtagtctgcgcccatcatcatcgagcgggctccgtagaagcggatcctgtccgtcttggcgcggggggtgcccaggggcacgaccaccacgcagtcctttatccccaggtcacgggcggcaatcgcaaccgccacgccgtggttgccggtcgagatggtgcccacgccgtgccggacctcgtccggggagagctggagcatggagttgatggcgcccctgatcttgaagctcttccccagctgctggctctcgagcttgaaccagtacttgcgatgctcgctgttgaggtagatggattcctcgaggggcgtccttctcacgtggccgcggattcgacgataggcctcgcgcacgtcctcgccggaaaaccagtctgccatcttggaacgtccccctcgcaaccgcatacccttgtgcaataaaaataactcattttcagcagctcaggcggcccggaaggcggttttcgggcggtggcaggcgtacctcaggtgagttgccgggcattgggggacgcaggcacccgcacgcgatgggtgcgggagaccggggccaactccttccggcgcccccctattgctccgtcgattcggagcgcggcgccttccgctccgcacggcgggcgcggaagaagtccctgagagcctgggcgcactcgtcttcgagcacgccggtggtcacctcaaactcatggttgaggcgggggtcgtgactcacgtcgtagagcgtccccagggcaccgcccttggggtcgggggcaccgtacacgcagcggtcaatcctcgcgttgaccatgaggccggcgcacatgagacagggctccagcgtcacgtacacggtgcatcccgtaaggcgccagcggcccaactcctgcgaggcgcgcaccaaggcggcgaactccgcgtgcgccgacgggtcggcgtcggtctcgcgtcggttgtgcgcacgggagactacccgcccatcgcagaccacgaccgcccctatgggcacctcgccctcacgggcggcggaggcggcctcctcgagcgcgacccgcatgtatgcctcgtcctggtcccgcgacaacacatcctcccctcgccagcctgttgcaacaagcacgcaaccgagcatatcatccgccgagaccttgccgcgcacggccttgccgtcgccgtggcgcgggttcagaacgcattggttatggggtacgatgtacttgcttgcccttggaggggtggcagagtggttgattgcagcggtcttgaaaaccgtcgagcggtaacaccgttccgagggttcgaatccctccccctccgcctcgggcagttcctttgcgcacgtccaccttaagaacggcgcatcttcccgcgcctccgcgcatggcctttcgcgcggcgagaaaggagcaccaatggcagcaatcatcatcgtggcaatcgtcgtcgtgataggcatctggttcgtcaccatctacaacggcatcgtcaccaaggacaaccgctgcgacaacgcctggcagaccatcgacgcccagctccagcgcaggaacgacctcatccccaacctagtggagaccgtgaagggctacgccaagcacgagagcggcaccctcgaggcggtgacccaggcaagggccgcggtcgcaaacgccaagacccccgaggacaagatggaggcatccaacgtcctctccggaacgctcaagacgctcttcgcggtgtccgaggcatatcccgacctcaaggccaacaccaacttccagcagcttcagggcgagctctccgagaccgagaacaagatcagctacgcccgccaaagcttcaacgactgcgtgctggagtacaacaacgccatcgagaccttcccgggcaacatcgtcgcgggccgcaagttcaagacccgtcagggcttcgaggtcaccgaggcgtccgttcgcgaggcgccgcaggtcaagttctaggcgagaggcacggggctcattcgcttggggcgcatcccacaggggtgcgccccttctctttccaaagccttggcacgactcttgccggagtcttcccaagactttgcgaagcgtttgcaaccaaaggcgcagctcgaatgtcgggcgtgtacaattgcctgtggcttggacaccatacctgtccagcacctctgcaagccaagtagaagggtcattgatgaaacctcgacctcacagtcgatgacccctcggtgtgcctcggttggttgcgccggggggtaacccccgatgatcgcgctcgcaccgccctgcggcgggcgcccgaccaacaaaggagcgcacatgatttacctctcccagatgctgggaaaccccgtatacgacctcaagggcgagaagatcggcaaggtcaacgacctgggcattgccacgggcgaagtgttcccgcgcgtgacctcgctcgccgttgagggaccgggcaagaccccgttcatgatcagctggcgcaagtacgtcgattcctacgacgagcaccaggtccagctcaaggtcgtcgccaccgacatccgcttctcgtacctccagcccgacgaggtcctcattgcccgcgacctcctcaacaagcagatcgtggacacccgcggcatgcgcgtcgtgcgcgtcaacgacctcaagctctcggacaccagctcgagccagctccgcctcctgggcgccgaggtgggcatcaggggcatcctgaggaccctctcgccccgcctggagcgcgtggtcatgcgcatcgccaagtcgctgggcaggaccatccccgaacgcatcatcgcctggaactacatggacctggtggagagggacctctccaacgtcaagctgtctgtctcgcacaagacgctcgacgagctgcacccagccgacgtcgcggacatcctggagaagctcgacccgcgcctgcgtggccaggtctttgcgcagctcgacgacgagcaggccgcaaacgcgatggccgagttcgacgacgacgccatggccgccgagatcgtcggcggcatggaggagaccgacgcctcgcgagtgctgagcgagatggacccggacgacgccgccgagctcgtgagcgagctggactacgagaaggccgagaagctcctgcgcctcatgggcgtgaaggagcagaaggccatccgccagctcctgggctacaaggaggacaccgcgggccgaatcatgaccagcgagttcgtccagctgcccgaggactccaccgtgggcgacgccgtgaaggcgattcgcggcctggacgaggacttcgaggcggtgcactacgtctacctcagggacgaggagggcaggctctccggcgtcgtgagcctgcgcgacctcatcgacggcgagacggacacgcacctctcggacatctcgtacgacgacctggtgacctcgagccccgacgacgaccaggaggacgtggcgaaggacatcgccaagtacaacctcctcgccatgcccgtcgtggacgacaagcgcaagctcctgggcatcgtcacggtggacgacgccctcgacgtcatggaggaggagcacgaggaggacctccagattgccggcgcctccacgggcgactccgacgggagccagcacacgcacgtgctctcgtggctgctgcgcaacgagctgtggttcttcatttggatgctcggcgtggtaatcatgggctccatcgcaacgggcgagcacaccctgcagtacacgctgctgctggcgctcgcgctgccggtcgcgatcgtgtccgccggcgacgccgtgacctacgtaaccaacttctacctcgagtacgacgaggacgacgaggacgcaccgagcatgctgggctttgccctccagggcctgggcctgggaattctcttctccgcaatcgtcctgctcgtggcctggggcatcaactccgtcttcttcatgcgggacgccacgggcggcgcatatgcggttaagggcttcacggcagccagcgtgagcatcctggtctcgttcctcaccacgcccatctacctcagggtgctgcgcaagcgcgacgagaagaacaaggaaagctctggcacctcacttgcctgcatagccatgctggtggcactcgcggtgtttgtcgtcgtggttctcctcctgacaaacgggatggcgatctagcatggccagggagaagagggccaagtccagacccacggagcaggagaaggcccaggcaaagcggattgcggggtccaaggccaagaagaccggcctgctcgcgatgctcagcgtcatgggccccggcctgctcaccgcactcgctggcaacgacgcgggcggcatcgccacctactcgtcagccggtgcgacctacggctttggacagctgtggaccgttcccctgatgtgtctcctgctcatcgtggtgcaggagaccgcggcgcgcatgggatgcgccactggcaaggggtttgcctccctcatccgagagaagtttggcatccgcatctctgccatcgcgatgctcagcctgtgcgtgtccaacttcgccgtcaacgtgtcggagttcgcgggcatcgcctcgggcctcaagctctttggcgtgcccgtgtacgtctcggtgcccgtctctgcgctcgcaacctggatgctcaccatgagcgggagctatcgaagggtggagaagatcctcctcgcaatcagctgcgtgttcgtgacgtacatcgttgccggcgtgctcgcacagcccgactggggcaaggcgctccacgacaccgtggttccccagatgtcgtttgaccccgcctacatctcgctcctggtggccaacgtgggcaccacgatctcgccctacatgctgttcatggtcgcgagcaacgtggtcgagaaggacctggacgaggacgacatccccggccagcgcgccgacaacgtgggcggcgccctggtagccgagaccatcacgtggttcatcgtcctgaccaccggaacggtcctctaccccgcccacatcgtggtcaacgacgcggcggacgccgcccaggcgctcgtcccgctcgccggccagtactcctccgcgctgttcgccgccggcctggtaggcgcgtccttcctcgccgcctgcgtcatgcccggcgtcaccgccggtgccgtgtgcgaggcctttggctgggagcgcggcaccaaccgctcgtggcgcgaggcacccacgtactacggcatcctcaccgccatcaccgtcctcagcgccggcctggtcatgctccccggtgcggacctgtttggcatcatgatggcctcgcaggtcatcaacggcgtcctgctgcccatcctgctgctgtgcatggtctacatcgccagcgaccgccacgtcatgggccggtgggccaacagcaaggcctggaacgtcctcacctggttcaccatcgtcgccgtcgtcatcctcacggtgatcatgttcgtgttccaggccatggggtactaggccccataacaggcgagagacacgagggggctcccatcccgaccaccacgccgggatgggagccccctcgactgctgccggaatgggtggctacttgctcgccttgcgaaactcgtccgcgaagtcgccgaacatcttgcccatcttcccgatctgccttccagcctcgcgggcaacgtcctgggacgtgggctgctgactctttgcgggagcctgcgccctctgcctactgccggcggccttcacggtgccgcccgccgacccctttgccggcgcgtaggtcttcacgggcgccttcccgcgctcctcctccgagcggtgcaactcaccggccaccttgggggcggagaccctcacatccgcggcctccctggcctccatctgaggttccatcttcttggtgccggcttcctcctggtactcccgcttggcctccgcaaaggcgcgcttggtgtcgcccagcgccttcccaaacgcgcgggaccccttgtcgaccgcctttgccgacgcctcgtccgccttcgcgacggccttcttgccctcggccttcgcccgtgcggtcgcctccccggcgcgcgccgcggcgccgcccatgggctggagcgcccccgcagcgtcgtccacgaccatcttgcccttgcggtgacccacgagcatgcccacgggcacctccacgcaaccgatcagggactcctccacggacccgtgaccaacgtagaagtcacgcacccgccagccctcggggtcaatcgcgatgtcgcggacgtagcccaggtccttgccgcccttggtggccacgtccatccccagccacatcacgcacgagtcccagtcgtatcccaggcgcttgcgggcggcctcgtccaggccgtcctcctggttggtcacgtgcaggccgtcctccttcgcggcaaacgcgtcacgggcgagaaacgcgtcctcgcgcttgaccacgcccgccacgtcgggccgcttcaccaggtagcccaccagctcgtcgcccgacggggagaacacgacgaggtggaccctacccagcttcttgaccttctcggcccccttgcggccggccttggtgtagtagaccttcttgcccacgacgtcgttggccctgatcatgcgagacgaacccccaatccaatggaggggcgcgacgtcctgcgccgcacccctcccgatgcattcccgttggcgccaatcactactcggcgctggtctggccctcctcgggctcgctgccaacgacctcaacgtgcacgccctcggcctccttctcgcctgcggcggcagcggcaccggcaacgcccgcagcctggccggcaacggtgttgaccacgtcacgcacctggtcggaggtggaggtcacggtgtcggagagcgagctgcgaagctggtccatgcgctcgcgggcaaggtcgaccttggcgcggagctcgtcggtcgtggcgtcgacgccggggcgcacgttgccgatcttctcgcccaccacgcgcgagccacgctcgtaagagtcaaccgcggagtcccacgcgtcgttgacggcgtcggccgccatggcacggctctcggcgccagaacgcggtgccatgaggatgccggcagctatgcccgcagccacgcccacgaccgtgccagccacaaatccaagcgtccccttactgctcattgcatcctccttgtgccgaccccgcttccgcggggacatcgtcatccctggcgaggcgggacctcgcccacagaccactttagccacatgttacccagtttgaagcgagttaccagcaagcgcgcccatgtggagaggatacggcaggcgccgtcaggcctacccctccccctccgggggatcccaggggagagggaccttgccctctccgctgccagccgctccgtcgggcccgccctgccctccgtcaccgccaggggcatcgccctcgccgcccgtctcgcccatgtcgacgtgcgggcgcgtcgcaaacgcggtgttgagctgcgaggcgtagtcgtcgtgcccatgcgtgaggacgggctcctccgggggctcgggggcaaacgcgtggcgcgagacgggctcgtcctccccgctggggaccggctcctcgacgggcggctcccatgcgaccccctccgcaagcaggtcctgcgacgactgatacgcctcgggagaggaagcgaggatgcgctgggcttgtgcggccgaggatgcgctagcggtatccccctcggtcgcccctgctaaagggccgtcgtcctccacggcccacgatggacgcctctcgcgctcctgggcctcgcgcgcctccttctcggcgcgcaggcgctccctggcctccgccgccttcttcacggcgatggcctcggccgcctcgcgacggcgggcgagctcctcctcgcgctgggcgaggagctccttgcggcgctgctcgacctcgtcctggatctggcgctccacctgctcctcgtactgccttgcgggctcgtcacccaggctgctgaccaggttggtgaggccgctcacgatggcctcgatgtcgggctccggctctccgccgccactgaacgcccagttcatgatccacacggcgctggagagggcccccgccaccaggacgtcgtccgggcacgagagctggatgtcgtacgtgcggttctcacccggcaccggggtcgtcttgccgctggtgatctcgcccgaggcgctggactgcgagaggagctcgacggtcacgtgctccaggaggtgcgcaagctcggtgttgcccatgacctccttgaacgtctcgctggagtcccccaggcacacatggtcgatgatgtgaggcatgaggttgtagacgcgcgtggtcgctcgaaggtcgccactggtgaggagcggtgcctccttcgagacccgcacgcgggcggtgaggttcttgagccccacctcgaccctctgtatctgtatgatctctgccatgtgggccaaccttccagagcggcgttgcgtgctcccattgtagttaatagggccgcgacggacgggccgcctccggcggggaggctacccctcctcctgggcgggctcctcctccgtcgcctcctgcggctcgggtgccgtgacgcgcagcatcgcaacgcgcctgccgcgcatcgactgcacgtggaaggtgtacccgtccaccacgacctcgtcgcccggcttgggcaggccgtcgaacttctccagcacaaagcccgcgaccgtctcgtactcgtcgctgtcctcgatgggccagcccagctctatcgcgtcgtcgatggagaagcgcccgtccacgagccactcacgctcgctcatcttggtgaggtacttgttgtcggggtcgaactcgtcctcgatctcgcccacgacctcctcgacgatgtcctcgatggtgatgacgccggcggtgccaccgtactcgtccaccacgatgaccatctggtcgtggctgctctgcatctcggagagcagcgggatgatgtccttggtgtcggggacgaagtcggcggacctcaggaagccgccaatcggctcgtccgccgcacgctcgtcgatcatgggcccgatgaggtccttgatgtgagcgatgcccacgatcctgtccacgtcctcgtggtacacggggatgcgggagtagcccgtgcgccgcatgagcgacagcacctctcccagcctggtggtgtcctccacggcggtcatgtccacgcgcgggaccatgacctcgcgcgcgatggtgtcacccaggtcgatgacgtcgtggatcatcgacttctcctggtcactgagctccttggtgtcggtgaccatgtacttgatctcgtcctcgctcacgttctggcggtcctcgatgcccttcacgcccaagaggcgggagaggcccgtggcgcttgccgccgtgagtcgcaccaggggcttggtgatggtcgcgaacgtgtggagcgggccagcgacgcgcttggcggtaccctccgcgtctgccatggccatgcgcttgggaacgagctcgcccaccacgatggagacgtacgacacgatgagggtgatgaggacggtcgccaggccgtgcgcaaggctctcgcccaggccaaagccctggagccaacgcccaaacggcgtggagaggctggtcgccgcaaacgcggacgagaagaacccgagcagcgtgatggcaacctggatcgtcgccagcgagtcgctggggtcgtccactaggctcgccgcggaggccgccttcctgtcaccctcctcggcatcgtggtcgaggacgaccttctttgcggtagagatggccatctctgccatggagaagtatccgtttgcgacggtcaggagcagggtgacgagaatcgatagggctatgtccatgcgcttgggcgcaacctcctcgtagaaagcgttctgaccactatatcagacggttgtttcggcgataccaaggaatggcataccccatttggagaccttcgggcagacggaggctagaccgcggtgatcctgtagagaaccatgtcaccctggcgctgcacgacctcgaacccgggcgtgtcgtccgtgatcccgttgatgcccgcccactggtcctccttgtagctccacttgaaggagttgagcgggttctccttgcagtcctcgagcttgatgacgtagcgggcgccgagccgtcggaccgcgtcctgcacctcgcggtcggtcgccacctggtcgagccgctcgcggagtatcgccgcgtcggccgcctgcgggccctcccccgtggcgaggtcgcggaacagcacgcgcatgcccgcgtcgccatatgcgatgaagctcccgtcaaagggattgttcaccacgagggcgtcctggccgccctcgtgctcgatgcggtcctgactcgtcctcacgaaggcgcgcttgcgcgtgttgatggtctcgtagtcgctgtagacggccctcatggcactgcgcgtcgactccaccttggtctcgaccctgccggtgtctgcgctggggtcatcgagggtgggcatgttgaagcttgggaagaaaacggcgatggtcaccgcggagacaagcgccacgggggcgactgtggtggggacgctgctcccccaacgcccctccgccctgaacgcgcgggcgagcccgtgcatgagccaggcaaagcccacggcggcgaggggcacggcgcagatggcggcgagcgcggcgaggcggggcgggtcagagtaccagaatcccgcgatgatctgtcgcgccatccccttgagtaggccgttgccgacgatggtgaggcatgcgagcgcatacgaggcgctcacccagagcagcctgcggttgcgcagggtccacacgatgcccaggaacacgatcaggccgaggacgggctgtccgaggtcgcccacgaaccgcccctcgtacgcgaggaagaagatgttgacgatgctctgccagatcgagctgtcatagttccacatggagaaccgcaccacgctcgccatgatcgacgagcggttgatcgcaacccacacgagcgcgcagaacgcgagccatgccaccacgagggcatgggggccaatcctgaggcgacgaatcctgacctcggccgaggtggtgaggatgcgcgagcacacgtacggcaccaggatgatcacgtccacgaagagagcgctggtctgcgtgagggcgaccccggccgcgcaggcgaggaacgcaatcaaggcgcgaacgcggtcacggcgcgagaggtcggactcgaccagcagcatgaacgcgacggcgcacgaggggatgagcgagaagcccgcaagcgtggggaagatggggccaaactccaggaggtaccaggggtagggcatgaacatggtgcaggcgatcgctcccaggacggtgacgcggcgcgacgggggcatgatccagcgcagcagcgccagcacgccgagcggccacacaatggccaccacgacgaggttgaccgcgttcatggccacggccgtctcgcataccccaagctgtacgagcatggcgcaggggatgtaccagccggcgggatagaagccggatcctatggggttgatggcgaggtccgccgtggtctggtacaggctcatccccacggaggagaagttccccgactgcgcgaaggcgcaaaccccgttgaggtggtgggcaacgtccttgccgaccataatctggttggggccgggaaggggcttgaggtacacgaacgccgctaccgcaaggccaagcaccacgtagagcgccacgtacccccagctcaggcatggcaggttcctgtccggggcgtccttgcgcggaccacggcgcgccaggagcgcggcagccgcaaacagggcggacggcaccacgacctcgctcacgacgttcgcggggatgcgcgccttgccgtagacgacgcccagcaccgccatgacgccaaatgacgccgcgggcgccaggcacacggaccatgcccgggggagcctcagcgccctcaggagcaggtaaccgggaaccagcaggaagagggtcgcgactgccgccgcctcagagaactcaatccacatagtcacacaccatcactcgtgagcagattcgcatctatggtaggccaggcgtggagcctcactcgaccttggcagagacgagctcgcctatgtgggccatcgtctccctcatgacctcgggcctgccaaactccaggaacacgacccccagggtctggccgctgttgacgagccactgcaccggcgtccccatgggttggtagtactggacccgcgtgacgttgtctcggatgcaggggtctatgctcaccccttggaacgcgccggctttgccggtggggtggagaacatacgaggcgacgcacctcccgcccccgtcaaatgcgacgtccatggactcgtcgcccaacgcgtagcgcacgcacgcctcaacgaggtcgatgccggacacctgcgtgagctgagcggggatgaggtttccccccgccctgcccccgagctcgacgatgtagggcacgcctccccttgcgacgatgacctcaaggttcatctcgccaaagttgagccccaggctctgcaccagtcggttgacctcgtcctgcagacgcctgcgccactcgtcaccgatgccacaggggtaggcctttcccactggcaccaggccgttcacggcctcgtcacgcaggcagtccatcaggccccagaaccgtaccctcccctgcgccacgaagacgtccccgcctatgacgtgggggtactctgcctcgatgaactcctccgcgatgagcgtcccgtttcgggagtactcccttgcgtagtccagcgcagcccccaggcggtcgcggtcaagctcgcgcagcaccgtgacccccttggacccagaggaatccgtgggcttcaggagcagtggggcgtggacgcccgccccgcccaagaggtccacgagctgcgctggggtgaccgtcgatgggaacgagacgtgcgcgggacagttgaacccatggtcgcgaaggtagtccctgaagaggtacttctcgctcagggtgaggaccgattggtaggggttggtgggaagccccagctcctcgcacacccgggcggcgatgggggcggcggcgtccgagccaaacgagatgaccccgtcaacgtgctcgtcgcgcgccacctggagcatctcgtcaaagtccgtcgtgctcttgaggtagaagcggtccgccacgtgctgccctgggttgtcgggcaggtagtcgcacagcacggtcctgaccccaagccgcttggccgtctcgatggcggtcacctggtgctgagcaccgccaaggcagagcagtgtcttactcgccatagaagtccctcaccgcgtggatgaccgtgttgcggtcatcctccgtcaacccgtagtacatggggaggcgcaccaggcgatcgctctcactcgtggtgtagcggtcctctccgttgaaccttccaaacttcttcccggcgggcgagctgtggagggggacgtagtggaaggtcgcctgaatgtcgtgccccttcaggaactggatgagcctggtgcgctcgtccaggtcggcgcacttgagatagaacatgtgcgcgttgtgcctgcagccatggggaatgacgggaagcgagacgagccccgcctcctccagcggctcaagcccctggcgataggactcccagctcgcaaggcggtcgtcgttgacctggtccgcaacctggagctctccccacaggtacgcggcgttgaggtcgctctggaggtacgagctcccgcgatccacccaggtgtacttgtccacctggccgcggaagaaccgctggcggttggtccccttctcgcggatgatctcggcccgctcgatgtacctggggtcgttgatgacgatggcgccgccctcgcccatggagtagttcttggtctcgtggaacgagtagcagccaaaggtgccgatggtccccaggtagcggtcgtggtaggtgctcatcacgccctgggcggcgtcctccaccaccagaaggccgtggttatgggcaatggagacgatccggtccatgtcgcaggcgacgccagcgtagtgcacggcaacgatgaccctggtacggtccgtgatggctgcctcaatgcagtccgggtcgatgttcatggttgcggggtcaatgtccacgaacacaaggcttgcgcccacggcctggaacgcggtcgccgtggacgagaatgtgtagctgggaaggatgacctcgtcgccggggttgaggtcgcagaggaccgccgccatctcgagcgccgaggtgccgctcgtggtgagcatgaccttctccgcgttgaagcggtcctccatccaggtgtggcacttgcgggagaagggaccgtcaccgcagatcttgtggttgacctcggccgcctcgcgaacgtactcgagctcggtgccaacgtatgggggaacgttgaagttgatcgtgacggctccttggcctggcgacatcaggttgaactccatatggaaacgaacacgtacactgtaagccagcgagtgacctaaaacgctcggggttgaaagtcccctgcaacccacaaggcatgaggagccgtccatgaattggtcccagtacatgtacctggcatgggtctgccttgcggggctgattcttctcgccctgctcgtgcgcttgctcccctccctttccgccgagggagaagagaggcgcaggaccgcgcccgaggtcgccctcctgcttgccgcgatggtcctgggcatcctcgcaatctactggaacttcctcctcggggacgcgcgctttggctattgggaccttgggtcggataccctggagcagtacgtccccttctatctcgagctggtgaggggcgtaagctcgggatcgtggggcccctggaactttgactacggtctgggcgcctcgcttcttgcctttgccacatgggcgaacgacccgttcaacctggtcaccgtacccctgaccctggtgctgggaacctccaggcttggcatcgtgctcgcgctggtgcaggcgctgaaggtcatcctctcgggtctcctcttcgaccacctgctcaccttctactgccgcgcccccctctcgagggtgttcggctccctcctgtacgcctttggcggatggctcatcctctgggggcagcactactggctggggaccgtctacgtggacgccgtgctgctcgccctgttggtggagctcctgatggagcgctggactaccccgcgcttcgtgggcctcatggtggcgacggcagcgaccgtcctcatgagcgtctactccggctacatggtcctgctgtttgcggccgcctacgccatcatccgctccatccacgtgtccgaggcgcaatctcccctgcaatggctccgcttcttcctcaagctcgccgcccccgtggtgtgcgggctgctggtgagctgcgcgctcgtcctcccctatggtgccctcattacgggcgagacctcgcgcgtcaccgcagcgggcgggatgtcgctctcgcggcgcgtcgtcaagtacctcacggggttcgtccccctgaggtggcttcccctcatcatgagcaggatcttgggcaacagcctcgtcaccacgggcgacgtgttctcgcagcaggcgattccctacgacgcctcccagggttacctcatgaactcgtacgagttcatcatggccggcgtcggcggcggggcggtcctgctcgtgtcgcagtgcctctcgcacgtgcgcagggagtgtggcacgcgcgaccgcgtgctcgtcgccctcaccgccgccctcacggtgctgttctgcgtcaacaacttcctccccgccctctcgagcgtgttcgacctcaagttccgcggctccttcgtcctgatgttccccctggtcatcgccgcctccgtgggctgggagcaagttgtcacccaccacgagttgggacgtccctcgctagtcgctgcctgcgcggtcgtcttcgcgtcacttgcctggtcgctcctcaacacgcagaacggcaggctcgtgtgcgtcttcttcctccttgccacgacggtcggcctcgtctgcctccttctgggacgcgccggagaggggctgagcagccgggttgcggtcgcaatcgcatgcgccgcatttgtctccatgtcggtcgtggacggcttcttcgccaccaacctccgcaccttcgcgaccacggagaccttccctgccgccagccacaaggatgatgacacgctccaggcgctcgcgtggatacggcagggcgacgacggcttctatcgcatcgacaagacctaccgcgactggaccgcctataacgacgcactcgtgcaggggtatcacagcgcgagcgcctacaactccaccaccgactccgacgtggtcacgttctaccgccaggtctggccggccgcagccacgggcggaagcgccgcccatcgcagcttcatcaacgaccccgacgagcccgtgcccgccacgctggtggggattcgctacgtgctctccaaggagccgctctcgtactcgtggctgaggctggtccaccagtccggctcggtctacgtgtaccagaacgtgcaggcgacgtccctcctcacgctgcacggcagcacgaccgaccgtgaaaccgcggacgccctcgccagcgccgaggagaggcaggcgcttctctccacgtccatactcgccgagaatacggaaggcgtcgacctcagcgagcagggagacgaccccgagtactcatcggacatccgccaggtcggcacgcagaccctcagcgggacggtcaagacctcgggggcggcgtacgcctgcctgcccgttccctacaccgccaagtgggtggtcaccgtggacggcaaggaggtgcccaccttcaaggccgactacgggtttgtgggattcaagctctccgcggggtcgcacaccgtgaccgcgacctaccagctcccgctcctgccacaaggcatcgcctgctcctgcgcgggcatcgtcctcggcgccttcctgtgcgcccggggacagcgcaaggtgggcgcccacatgaggtaggccgcgaggccgtccaagggcggcgtttcacatggaaccatggctggcgacgccctaacggcttgccatgcccctctcccctgccgccttggtgcgcgtaccgcagccaagcgaaagacacagcaggatcggcagcagcgtggccatggggagcgcatagcgcattgatgcgtggaggggcgaggcgcactccacgaggaacaccatccccgccatcacgaacacggggagcgcacgacccttccgggtgagaagccacacgcccaggagaaggcacgcccacgagtagaacgctggctggtcgagcaggccgaggacggggatgccggcaaatgctcgggtgagccccccaaggatggcgcgagccgactcaaagcccgtgtggacgttggcaagaccggagagctgtcccgagaacgcgtagccgatgcccctcatccactggtagtggtactcgacggtgttctggctgtagtcgaggtcctggatgctgtcgtacggcatgagcggacaccagtagccgacgttgccgcggaggaaggcgtcaaggtagatgccggggtggcgcaggccctgcgcccgccaggcgctcagataggccgagagacgcgcggggtcgtccgcgtccgcctgcgactgaatgggatccacggtggcggggtcatagaggctcccgacctggtcatagtcaaccttgagtatgccctggatcgccttgcgctcggagtcggtgacgtcctcgggggcataccgctggcatgcggccgtctgctggaggggaaccgtgagggcaagggccttgtcggtcgggcgcacccctagggctgggagcaggagcgacgtccacgcgccgtacgccaccaccacggccgcgagcgagagcgcgaggccacgacgcgagggacggcgcgcatacggaagggcgacgacgaggccggcggcaacgaggtagacgcagttggcgcgcgtgagcgagcacaggatgccgcacagcgccagggagggggcggaggtcgacttggttggctcctctcccctgccctcctgccacaggcgcgcgcccagaagcgtggcaaagagcacgacggtcgccgcggagagcgtgtccttgaccagcacgcgcgcgaagagcgggtagatggggcagagagcctcgaacgccagggccacgatgcgtaccgcacgagggacgcccatccggcggaaccagagctgggcgtacgccagggaggcggcgaggcaaatgacctggaccacgacggtgagcacgagcgcgacgcgagcccctcccagcacgtagcccagctcgtagagccacccaaagaccatggtcatgaggacgggatggtggttggtgagcggacggtcgccaaagaactgcgagagctggttgaagtagtcgaagttgatcgccccgggaaggctgatcaccacgtagggcagccagcaggccaggagcacggcaagggggccgaggaagtggcagggggacgctccggcgcactcgtcgcgggggaggtccgcaagggcgtcgagaccgacaaggaggaggccgcacaggagcgagagaagcgcccacgccaccacgaggaaggcgattgagaggaggacgtgcctcccgtcgtggagataccccgtgcagctcccggtcaccacgatggccctgccgacgtagcaccacagcgcaaacacgaggcccaggacgatggaggatgggcgcgccatcttggtgacgagagacttcgccctcccggcccttgcgtgcgctggcccggccatgagaccctccttcctgcccgcgaaaccgctagagcgtgacgccctggccacggaggctgcggaagcctagcgtggcataccagcggatgaagcagagcctgtagcggaggcggttcctctcgcccctgagctcacccaggcagtctgcccggctgaacgtcgtggcgctgggaagacgcctggtccatttgagataggtgcggtagtactggagcttggcggcctcgatggcgtcggggttgcccaggctctgggcaaacatcacgcacgtgcggccaaagaggatctcgttgcgggcgtagtcctcgtcgatcctcacgtttgccgagtagctgctgccacccttcttgacgtggcggtaggcaccccaggtctggggcatgcacttgattcttccgcaggtcaaaaggcagaaggcgttccgtcggtctgccgcgtagaagtcgtactgctgcatgctggtgaaggcgtcgcgggcatgggcgaactcctcgcgccggtacaccgaggtccccgtctggccagggaggctgcacaggaagaactcgttccagtcgtactcctccttggggcactcgggatacttctcgccgttgggcttggagtctgcccccaccaccgtgacgtggtggtagcaggcaacgtagtccgggtgagactccaggaagtcgacctgggcctggagcttgccgtcataggtccagaagtcgtcggcctccaggatcgccatgtacttgcccctgcagcggtggagaaggtcctggcagttcttgttgcccctctcccccatgttctgggggcggaggagaaactcgaagccgtcggggtagttgccctggatggagcggaggaggtcctgcgtcccgtcggtggagcagtcgtctcctatgaggacctgcacctcgaagtcggtcttctgcatcgcgatgctgtcgagggtctgcttcacggtcgccttggcgttgaagcagggtaccacgacgctcacaagggggttggttgccggcatgcccctaccacccggcgcaggagaggacgatgtcgcacaccctgtcgacgtcctcggtggtgaggtatgagctgaggggaagcgagagggcgccggccgccgccctcatggcgacgggggtgtccgcgggatcgaaccccggcttgcccctgtagcagtcgaggtcgttggtgagcgggtagaagtacttggcgcacgagatgttgtcctcgagcagggcttcctgcacctggtcgcggctcgccccgaagacgtcctggtcgaagatggcaggcatgtagacgaagttgtgcttggtgttgggcttgggtcggcacaggttgatgcccgcgacgtcgcccagccgctcccagtagcgctccgcggcggcacggcgcctgtcgatgtactcgtccagatggcggaggttgcagatgcccatggccgcctcgaactcgttcatcttgttgttggggcccacgtagccatagacctgcttgccggtggtgccaaagttcatcttctggtcgagcatgacgcggaagtcgtggttctgctcgggggtccagcccttcacgtggatgcacgcggcaccgccctcgatggtgtggaacgccttggtcgcgtggaacgagaacatggaggcgtcacccaggcatgcggcgggaacgccgtccttctcgacgccaaaggcgtgggcggcgtcgtagaggagcttgatgccgtgcctgtcggcgatctcgcgcagggcgtcgtcgtcgcacaggttgccatacacttgaaccgcgaggatggcgctggtacgaggcgtgatggcacgctcgacggatgcggggtcgatggtgaagtcgtccgccttcacgtcggcgaagacgggggtgagcccccggcggacgatggcgtgcgtggtggatgcgaaggtgaagggggtcgtgatgacctcgcccgtgagctcgagcgactcgatcacggcctcgatcgccgagtggccgtgatcgtagagcgagatctcggggcagtgcaggtagtcgttgagctgggcgatgaagcgcttctcgatggagccccagttggagagccagtgcgactcccacagggggcggatctcgtccacgtactcctcgaaggggggcatggaagagagggttgtggtgattcgctttggctctgccatcgtctgctccaactatctgattgccagcttgctcaactgcttcattctatgttcagggcgctcatggctgccaggaagcggccaactaggcaaaaacttcagccatccggtctggcgtgatgcaacgccgcgccgccccgctcctatgcgatgcgcgggcataccagtccgccgatgcgacccatcgcgtcctcgagctgcgcgaccgagtcaaagcgcaggaacagtatccccagcgccttgttcgcaccgtcgaaccgctcgaccctggcgccctcgttcacgtacatgacggtacggtagaggtggggctgcagctctgggtcgatgtccagcccttggaacacgccgtcgaccgaggcgtggggaacgtaggtcgccacggcggcgtcggcggagtcgaacgagacgtccatggagtagtcgcccatggcgcaacggacgtttgcctcgaccaggtcgattcccgagatgtccgacagctggacgggaatcatgttcccgccggcacgggcacccagctcgaggaagtagggcacccctccacgtcccacgatcatctcgacgttgaactcgccaaagcggatgccaaggctgttgacgaggcgctggatctgctcgcgcaccgcgcgcgtctgagcgccggagaggcccgagggatagcgctcgcccacgggtaccaggccaccgagtgactggtcgcgcaggcagctcatgagcccccagaagcggacggtgccgtccacgacgaagacgtcgccgccgatgacgcgggggaaggtcgaggtgatgtactcctccatcaggagcgttccgttgcgggagaactcgcgcgcatgctccaccgccgcacggaagcgctcggggtcgggggcgtccaggatgctgatgcccttggagcccgacgagtcggtgggcttgaccaccacgggaaactggaggtcggacgagaggccaaggagcctctcggggtctacgtccgaggggacggggatggacttggggcaggggaaggcgttctgggcaagatggcgcctgaagaggtgcttcaccgagagggtctggaccgccgcaagcgggttggtgggaagggagagcgcctcggcgacgtaggccgcggtgggggccgccgggtcggaggcgtaggcaaggacgccgcccacgttctcctcgcgcgctatgcggagcatggcctcgcggtccgtcgtgctctcgaggtagaagcggtcggcatggtactggccggggttgtcggggagatagtcgcagaccacggtgcggtagcccagcctcttggccgtctcgatcgccacaacctgctggcgcgaccctcccagcatgaggatcgagcgcttgccctcggagctctgttcgggcactagtaggcacctccgttgttgcgtcgcctcagcgcgtccgcatcgccggaggcgacgatggcgtcgatgcgggcctccttctcggcaaagtacttcgagaggaaggggtccctcttgaaggggtggtagcactgcaggtacttgacccccgagtgcgagttgatctcgatgatcttgggccccctgtcggtgaagcacacgtcgtagcccatccactcaaggcagccgaggtgcaggctcagggcgtggagcctctccctcaggcttggccagcagtcgatcttgccgttgaacgagccgcccgtctcgggatggacgtccgtcttaaccacgcggttgggatagatgagctcgcccttgccgtactcgccggtcaccaggtcaaagtcgacgttgatgtcatagatgtcagccttgtccgggtaggtgtagttggccttggagtcgtcgttgttggtaccgcccgcaaagcggaagtaggtgccggcaaagcgaacgtcggtccccgttgggttggcggtgagcaccctcagcgtgtggatgacgggagagaccttctcaagccccatgcccgggtggaagaactcggtgaagatgtcgttgccgtggttgtcgacgaagcgacggacgtcctcctcgctcgccgccttgttgttgacgaagtacttgccgcccgagtaggcgagcttgttgaagcccgccgccctctggccgttgcagggcttgcaggcaaactcgcccttctcgcggagcacctcgagaaacgcgccgtatccgcccttgccgtgggcgttcgtgagcgggagaaggccctttgtggaggcgtagaagtaggcctcgggcatgaggtcctgccactcggtgccccagagcatgtagttcatggtcatcttgtcgtcgatccacgccttctgccagctgttgatgggccagcagcggtggtactcgtagtcgctcaggtagtcgtcgaccgtctcctcggtaagcccgaaggcataggcgtctatggcatagaagccgtggccgtgggcccactcgcggtagtcggggtcaaagatggggttcttgtcctccctctccacgacgcccaggtaggcggcggcgagcttgcgagagaagccgttggcgagaagcgcttccatcgtgttggtgacgatcatgctggctccaagcgactcgtgtttgtgacgatgcccgcgtcccaaggcacggggcgcggggttgcatgcagggatagatgatagcccacggcaatgctgcggaaaccttctgccagacggatggacgaatagccctcgttaacagcatccgaggagtcatcgagaggagggctcgagacgctccgcgaaggggagcgccaaggcaagcggagcccagaaccaaagcggtagggcgtagcgcacgagggcgctcaccggagacgcgcaacacgtgagcgtaagaaggattgcagccatgagaagcgaccaggcggcgggacgtagccatgccagcctctcgccacccacttttccagccacgctcagcgtctgggcgcagcacagcagcatgacccagagatacgtggccggatggaagagcagggagacgacaggggtctgggataggttccagaccgcatcatgcaagctcacccgtgcctcggggaagggcgccgaggttggagagagccccaggtccgcccacatggtggagtcggacgaggcactgccgaccatcgccatgtcggcgtagtcatcatttgtctgcgcgcgtacgccaaagggataccaataccctattgatccctctatcgcagagaccgcgtaggtcccaggttcctcaagtccctgctgcgcccacacgcgcaggtacgcgaggaggtttcggtacccggtgaacctaaagcggtccttcaccgggtccgatatggactcgtcatatacctgcccaagcgtgtcatagccaaagaacgtctggttgagtacggagcgctgctcaggcgtgacctcgtcaggatggtcacgcgcgaacctcgccgtctgctgcatggggagcgagagggcttctccaagctcgcccttggcaattcccatagcgggatagagggcgttgttcaccaggaaacagagaatgaagaccgttagggcgcagagcatcgcggggcatagctcctctccatgtccttcaacctttcccccgcgaagatggcccgggcgccgcgacgggaccgcaagggcataggcaacgagcgcgaccgcaacgatgaagacgttgttattgcggagaaggctcgccaagacccccatcacgccaatggcggggaagctcaggacccatggaatcggctctccccctccccgcttccaggccctcgcgaccagctgcgcgcagaacaggtcaagggcgcaggtggagtagacgtccttcacgatgaactgcgcgtacgttgggaatattggcatgagggagaagaagcagagcgagagcacggtgagccaacgacgatgggccaatcggtcaaccaaccacatcgtcaccgcaaccgctgcgcccatgaaaaccacctgggagatggtgagggcgaacatcccgccgtttgctcccccaagaagggaccccagcttgaaggcgatgccgtacagggcgatgaccagagggggatggtgcgaggtcatcggctgcagaccaaagaacatcgggagttctccaaataggtctgcgccagcggtcgccggaaagcaaactacgaggatggggatccagcaggcgattgctatccccgcataggcgagaggatgccagccgaggccgttggagtccaccctgcggctcaagctcgcaaagcaacttgaaagggcagccatcacgaacgtcgagaccaagaacgcggcgagcgccgacagggcgacggacacaggctgttctcgcatgtaccccatggagtcatagcgttcggtccagaagcccagggcaaagagaagggcgaagatgatcgaaagcatcacatgccacccgcaaacgtgcttcctcacccagtcagagatgccacacatcgtcaattctccctgtctcgcatcaaccgttcagaagaagagagggattcgcacctcgccgcgaatccccctcccgacttcgctcaggagcccaaggaatgtgtcctagaacagatagacctcactcccaaagcagttatcgtagatgaatttgacctcatccaatcccaacctgatgcatccgctagagacgtgcgtgccgcgaccgtccgagtcgatgacggtgttgttagttccgatcttgtacaggatggagtggaagctttgccagctttttccgtcaccagcgtagcagcacagatagtagtggactgatggcggggtcacgtcctggtaaatccgatgggtaaagcggaagtaccccctgaaggtcctgtcaccgcgcccagtaccgcatagccacacgcgagatgtctgccacgggtcgtccgtgccgcagggccggtcaaacacaaacgtcaggaagtcatcaaccgagaccgagagataatacctgtcgtttccaccgcgggtacgggcggcattgtatgccttgtcatatgcggcggtgatgttcttgttgcggtagagacagccgtcgttattggtcccccaaagttgattcccgcgtccgatgagcacgttgcgcgctacgtaaccgttcctcttgtagccgtaataatcgtaagaacccgtgccgtcaggaccaggagcagagaagaaccccgtgagcgcgccgtgcatcccgttcgagaggacggcgatgtagtagcgctggagggatccagcataggcgctggtcacgagccagccaaggttccaggcgagcgaccccgagttgtccgcgaggacgacgccgttggcgacgcgggagacgcccctgaggacgtagccctggtcggtgaggccccagtagttcttgccgtcgtcggtgaagtggccggtctttgccaatgcatacccactctggttcaccagccagtagcgctgttttttgccagcgctgtacatgccggtaacaaaccacccgtctccgtctgggcgctcgcttgcaagcctgccgtcgttgttggcaaggtagaagtagccgtttccggcagacgtgcgaccgcgcaggatggctccggtgcccgtggcgtaggcgtagtaccctgctccctcgcccggagtgacgaggcgcgagaccgccagccttgcgtccgagcccacccagtagcgctggagggagccgtaggcgttggtcacagtccagaacccgtcaatcttgcttgggtcggccttggcgccgtaccaggcgatgccctcgaacttccagccaaggtttacgaggttcttgttctcggcctcgttcgaggtgaagttatgcgcaccggccttggcgttggggttgtactcgcgaagaatccgcacgccggtgacggtgtcggagtaccagccaattccctcgtacttccatcccgcccgcacgagcgagtcgcgctctgtctcgctcgtggtgtagtgatggtcacccgcattggggttgtacaggcgatagaccggcgcggttgaggtgttgggtgcgacccaggcgatgccctcccagcgccagccggcattaaagaggaacttggcctcacccagactcgccgtatagaagtgctccccactgttggggttgtagaggcgatacatgttgctggtgagagtggtagtgacgacagcgttggcatctgcggaagtgcgctccgctgccagagcagggtcgtccgcggcggcaggcacctcggctgcaccatcggttgcctgcgaccgaccgggtgtcgcctcctgcccggactgggccgtggtcgcgccgtccgcggcggccgaggctccgctgtcagcagccccctccgtgggggccgagcttggcccaccatccgtcaccgtcccggtctgctcggacacctcgcccgcatcgacggaggtttttgcgtcagtcgagggcgtcacgactccggaagaaccgttggtctcctctgcgccatcctgggcttccgcctgggagacggtcgccccctggctcgactccgcgtcgattgcctcagcctgcgtgacggtggcattgggctcggaggagacctggtccacggcctcttgctgaacggtcgtctggttgtcgaggctctgcgttccgtcgacctccagacccctcgccatcgtgggggctgcagtcgttgcggtgacgaatccgattgccgcggcaaacccaagccccgcgaatcgcgccgcgattgacgtgcgtgcgtcttcttgcttgaacatgtgaccctccgttgaacagaattaccgggtcgtagcttgcaggtgacttgcagaagcaacctgccctctcactaaggtaaccactttacccccatttcatgtagcccaagattgactaaggtggtccaagggaccgctcaggcaaccttcatgcctctttcaccctgttttcacacgcatgtcgcatcctagttgcggcccaaggcggtaacccccgggttgcccctgatagactggatgccacagggtcacgaagggattcgcctcaatgagagttctcgccatcattcccgcctacaacgagcaggagagcctcctcgacaccgtcaatatggtgacgagcgagtgtccgggcatcgactacctggtggtagatgacggctcctccgatggaacggcacaggtcatgagatcgggttgcctccacggggtgagcctacccgtcaacacgggcctgacctcgggcatcaggacgggcatgaagtacgcctaccgcaacggctacgacgccgccgtgcagattgacgcggatgggcagcaccttccccgctacatcgctccgatggcgcatgcgatggagaaggagaaggccgacatcgtcatcgcgtcccgctacctcgacggaacggtaaagccggagggtgcgcgcggcgttgggtccaggctcatctcgggactcatccggcagacgaccggaaccacgatcaccgaccccacctcggggatgaggatgtacaaccgccggatgatcaagctctttgccaaggggttcgacgtggcccccgaacccgacacagtcgccctcgtggcgaggaagggcggcaaggtggtcgaggtcccctgcaccatgcgcgagcgccagggcggcgagagctacctcaagctgggcaatgccatcaagtacatggcacgcacctgcacctcgatccttctcttccagtggcttcgttaggagacagatgagcctctaccttcgtatcctcctcaccctgggcgcgctcctgaccctgtggaccatcgccaagcgcgtgaagcgcaacaagatcctgatgcaggacgccatcttctggttggtcctcgccgtcgtcctggtgatcatggcgctgttccccgggctcatcatcacgctcgccgcaaggctggggttctactccgccagcaacttcgtgttcctggtcgtcatcgccctggtcctcgcaaaggagttctccaactcgtctgagatctcgatgctccgccacaaggtggaggagctcacgcaggagattgccctcagggacctgcaggaccacgaggaccccgacaagtccagccgctagggaacggcgctacagccgtcccaacaggaacagcaacctgaccgcgacctctccccccgtcgtctggcgcaggcgcatcgggagcgtcgccttgcgccagcggccgccgtcgatggcaaggcgcaggagttctctcctctcccccggcatctggtcgccccacagctcgtacaggcgccgcagctgggcggtcacctttgacagctcgtcacccgtcagatagcgcctcaccctgttctgcagcaccttcgcggcgccagagcccgttgccgatgcgttgctgcccgtgcggcggtagtcgaggcacacgaagtcgtcgtagtggagctcccccagggcagacgcgacgagcgcaagccaccagtcgtgggtgtagacgcctcggattccagcttctcgcacgagttgtaccagacgccggttaatgaccacggtgttgcccgacaccacgttctcgtagagcatcttggaaaagtccacgccaatcctgttgaggtgcgaacggcccgtcgggttcatctgggcgtcgcagaactcgtactccgcgcaatacagctggggcacggagtcgtcgcagccgctcagcacccccaccgcacgcgaaaccttgtcggggtgccaaacgtcgtcctggtcgcagagcgccacgtagtcgtactcgtccggcacgctcgtgaccaactcgatgaacgagccggtggggcccatgttcccgccgcagtcgagcgagaccagccccctctgctcgtaggacctcagtacctggcggcacgcctcgtggggcgagccgtcgtccctcgcgaacacgtccacgttgggatagtcctgggcaagcacgctatcgatctgggaagggaggaactcctccccgttgtaggcggacaggaccaccgcaaccctgggcatgctcggatccacagactcgtcctcccatccggtgcgtggagaacggcttccccaggcaatccgcgtcgattcgaccctagtataggtaaagcaacgtatccccccgaaaggagaggcgcatggcacaggaggcggagggcaagagggtctcggtggtggtcccctgctacaagtcggaggcctatctccccaagtgcctcgactccctggttgcccagaccatggacgactacgaggtcatctgcgtcaacgacggctccccggacggctgcgagcgcatcatgcgcgagtacgcggatcgctaccccaacctggtccgctgcgtctcgcgcgagaacggcgggctctggaacgcgcgctggtcgggaatagacgtcgcccggggggagtacgtgggcttcctggacagcgacgactgggtggaccccacctttgtgcgggatctctacgaggcggcgcgacgcaatgacgccgacatcgcggtgtgcgggttcaagcgcaccgacctcgcatccgggcgggtcatctcggacgagatgggccagccgcggcaggacatcctgctggaggacgacccgggcatgctcctgggggtcaactcggccgcatggaacaagctctatcgcgcgagcatcctcagggacatgcaccggctctcaaagcccccgtcgacgctcgaggacgtgatgttcaaccttctggcctacctcgagtctcagggcagggtcacgttcaccggcacaagccccgtccactacatggtgcacgccgactccatgatcaacaccatgaccctctcgcagctggacgaggtcaaggcgtgcctgctcgagatcaggagcgactaccttggggacgaggccgaccaggacaagatgcggatgctcgacgcgaccgccttcctccacgtgggggtcgccatgagcaccaggctcgccgccacgcccggggtagccatcggcaaggtggtgggagagacgaccgactacctcgaccgcaacttccccacctggcgtcactcgccgtacctctcgcatgcctacgcaaggggcacggggtcgagcggcatccgcaggctcgccatcgcccacgacttctggctcgcccacctcatgacgccgttccttgccgcctacaaccttgtgaccgcacgtctcggcatcgatatcaaatggtaggcggccacctcgggccgcctaccatttctagaatgcgtataccgtggttccaacgggaacgttgtcataaatccactttgcgtcatcgttatcgagacaggtgcatcccgtcccaccatgtctgctagacgtgggcttgttggcccagtcactatacccctcgtggaagccctgagcgttccaataacccttccccgcctcgtagcgtccatgcgagataccaccaaacacgtaggtgggcgactgctcgtagtacaaatccgttgcggtgaaccatggattgacgtccgcgccgtccttccaaagcgcaccattgttatcaagcggcgcctttgcaacgatcttcttcacacccgtgttggtcttctttccgccattccagttgatgcgaatgttcttgtagacgctccagctaccattctggcgcttgagcacggtcagcttaaggccccacacgtcgttgataaggaagtagtcggtgtcactcccgtacttctcggcgattgcaacggaactcttctcggcatcggagagcttgcgctcgacttccttgatcgaaccatttgtctgaacctcgtacgtcgcaggatatccccacgaggacgactcaagccgaaacggcgcaccgggcacaggaacatagtcgccctccgcgccgaccttccaggcgttggtgctctcgagcctccagccgatcgacttgaggtagttggcctcgccggcggagcgggtgtagtgatgctcgcccgagttggggttatacaggcgatagaggttgccgtcgcccgcctcgtaccaggcaatgccctcgtccttccatccaagggagacgagccagttcttctcggcagcgctcttggtcaggtgatgccggccaccaggatttgggttgtatacgcgatagaccgggcttccgtcctcgggggacgtagagtcggtgaagccgattccctcccaccgccagccggcagtggtgacgctcttggcctcgcccagcgatgccgtgtagaagtgctcgccggtgttggggttgtagagccggtagatgttggtcttggccaccacctgcgcctctgcccgcgcgggcgagaggaacgcgagggacgcaagcagcgcaagcgccaccatgggaacgaccgccaggatcttgttcgagcggaatcgatgcatgggacctccaggaagacggggttcactgccttccgattttcgtccctcttgccgaaactttcaaccaaagcacaggtagttgcatcagttccataggttgtggtgcacacccgccgcccttacacgccctgcgagtagatgacgatgcccaggatgatcagcgcgagcgcaaggaccttcttccacccaaggtgctcgtggaagatcgtcacgccaaacagcgtcacatagatgtagccggtcgcatcgagtatgggccccatggagagcgggatgaccttataggcgtaggtcgagaggagcgtggagcccacgaagaggacgtagccccctatgaccagggggttgaggtactcgcgcaggggagagctgtaggacctgttcgcggacttcttgagcatcacctggccgatggaggccacgaaggtgccgaagagggcgaagagggcgtacgtggtgacctcactcatcggccccaccgcccctcgtctcttccccatccgtggcagaggcgtcctcgctatccgccagggcgaagaggacgacccctgccaggaccacgagggcacccaccaccttgaggggagacacgccctcgtggaacaggacggcgccccagatgatgccccagatgaccgtgaccgcacggtttgcgtacgcggtggtgagggggatgcgcttgatgacctgctgccaaccgatggcgtacacgcccaatacggcgatcatgccgccgtaggagaggatgaaccccgggctcatgaaggggtacctggcggcggtcttgctcaggatgccgctcgtggaatacagcatgagcagcaggtggagcgccaggagcacgccgagccgcttgcgcctctcgcccatcagaggttcaccgtgtccctgacgatgtactgcggggtgctgttgacggacaggacgatgtcccccacgtactcgccgatgattccgagcgccaggagcacgagtccgaagaagaacagcaggatgctggtggtcgaggcccatccggcgaggatggaagggtcgatcagcttgcgaatcacggtgacgatgccgaagacgaagcccacgatggccgtcacgacgccaatccccgagatgactcgcaggggcaggacggtgtagttgaagtaggcaagccacagcttgacgagcttgccgagggtgtagccgctcgagccgtactcgcgggcatggtgctcgaccaccacgcagccaacgttgtcggtcatgcgcgagaagagcgcctcgatcatggggttgtagttcctgaacctgaccacctggtcgcgcagcttgcggttaatgagccagaagctgctggtgacaacgtccttggaacggccgagcatcttgcgagcggtcaccttgttgagccacgaggtgaacgtcttgacctttgagttcttctgttcctcaaacacgccgtagaccaggtcgtagtcgccctcctccatctttgcgaggagcttgggaatctgggtcgggtggttctggaggtcgtcgtccatacccaggaccatgtcgcccttggcatagttgagtccgcacatgatcgcgttgtgctgcccaaagttgcgcatgaggttgatgccgtgcacgttggggtgctcctgcgccaggcggcagatctcgccataggtgtcgtctgccggagacccatcgttgaccagcacgaactcgcactcgtagtcgtcaagcctgtcaaactcggaaatggtgagcgagacgacctccccaatggagcgctgcgagttgtagcaggggatcacgacggagacgagcatgagacgacccttcgatacggaggcaggatacatccgcgccttggccccgtcgattgggacaagtcatccactggaatggtgcaggagtcgcaaagcgcactgaaaactctagcagtcagaggcgtcggcgttcccgtttccgcccgaacccctcattcccctcacggtgccaacgaggtacctcagctcctccacgcgcaggagccaggccaaccccaggtaggtgacgccaaaggcgatgatctgcagcaggagcatcgggacggtcgagaggggcaggagtgccacgagggacccgaccgcataggcgagcgcggcaaggccgaacgcaggcgcgacgtcgcggatctgctccaggtacgagtagccgatgacctgcttgttggggaaggcattgatgaagttgtacacgaagcccgccagaacctgcgcagcaacgatcgcatacaggttgtgcagcacgaacgccgtgaagcagatcagggtgactccgatggccttcttgatgagctcgagcctcaggaagacgtcgcttctccccatgccgttgagcgactggaggttggtggtgttgatgggcaggagtgcgtagatgaggcagtacatctggaggaacggcacggcgggcagccacttctgccccagaaggatgaggacgaggggacgggcaacgagcgcgaacaggaccatggacgggacgatgaggaacgtgctcgtcttgagtgcgcgcctgaccaggcgcttgacgcgacccaggtcctcctggacgcgcgagacggcagagagcatcacgggctggatggcgccgtcgagcacgatgcccagcgcctgcgggtaccgcttgccctggttgacgtagcccaggctcgtggagtcgaacacgcgaccgatcacgaggtcggagaagctctggtacagctggtcgatgacgccggaggcgaggagcttccagccaaacgagaagagctcgcgcgcacggacccggtcaaagcgcggccggggcttccagggaacctggatcgcaagcaccaggcacttgaccacctggaacgagagctgctgcaccacgagcgcccaaaggccggctccggcgacggctgacccgatgcctgcgatgccggaggcgaccgccgcggtcacggtggccctgaacgtcttgttgaagtcaagctcgcgggcgacgatggcctcctggatggagttgtaggcgttgaccaccaggatgaggacgagcacgcgcaggggcgagacgatctgcggcatgtggtagaacgcggcgaccgccggggcggcgaggaacaccgcgaggtacaggacgagggagatggcgaggctcatccagaacacggtgtcgtagtcgcgctccgtgacctcgggcgcctggatgatcgcggtgttgaggccggactggacgatgacgttaccgacgttcacgaacaccagcatgatggcgagcatgccaaactcattgggggcgagcaggcgcgccatcacgatctggaccacgagctggatgagtgccgaccctccctgctcgaagagcttccagaacagcgagcttatggtggcggatttgaggtccctctgggccacggggtgctccttgcatgcatgagggtcagttgaccaaaaaatggtagcagagctgccgcgacgtcatttcccgcacacatcgccgacaaggggaggcgcctccccccgaggggcggcgcctccaaccacggagtccgggccaggactcgtgatgccctctacctgccctcggcgcgcctctcggcgtactcctgggacagctgctcctggacgtcgtggggcacctgctcgtaccccgacatctggagctcgtactcgcccgttccgcgggagagggaacgcaggcgggtggagtagtcggttacctcggcataggggatcgtcgcctcgatggtggtgtagcctcctccgggcatgtcggcgctcgtcatgccctccacgcggccgcggctcgccgagacgtcgcccatgaccgagccggcatagctgtccggcacggtgatcctcagatgggccatgggctcgagcaggacgggctccgcctgtgccacggccttctggaagccgatgcgggcggccgtcttgaaggccatctcgttggagtcgacggggtgatacgaaccgtcgtacaccgcgaccttgacgtcgatcatggggtagccggccaggacgccctcgcgcatggtctcctggacgcccttgtcaatcgcggggatgaagttgcgcgggacgtggccacccacgacctcgtccacgaactcgtaccccgccccggggttgggctccacgcgcagccagcagtcgccgtactggcccgcgccaccggtctgcttcttgtggcggccctgggcggaggcgacgcgacggatggtctcgcgataggggatgcgcagcttcacggtgtgcgccgagacgcccgttcggtcctccagccggtcgaggagtacgctcacctgggcctcgccgatggcgctcacgacggtctggccagtgttctcgtcacgcgacacggagagcgtggggtccgcggacgcactcttctccagaaaggcgtagaccttgccgtcggttccctgcttgtcgggctcgatggcgatgcggtacagcgagttggggaagcggaacgcggccgcctcgacctttccggtgaccgagagcgtgtccccggtcatggcctcgagcttgggaaccacgcagacgtcacccgctgccacggacttcacgtccgacatgtcgtggccggtcatcatgtacaggtggctcagacgctcggtcttgcgggtgcgcgcgttgaccagctccaggccgggcgtcagcgtgccggcaaggaccttcacgaacgagagcttgccgttctgtgcgtcgttgagcgacttgaacacgaacgcgacgggtcggtcgtcgtcgggcgagatgtcaagctgctcgccgttgacgagggggacgcggccaaagtccgccatggtggggaaccatgcggcgacggcgtcgaggaacgagatgacgccctcctcacgcacacacgaggcggcgaacacgggcacgaagatgcgctcccgtatcgcctgggcgagaaggccctcgagctcctgctgcgtgacctctcccccgtcgaggtactgcatcatcagctcgtcgtccgcctcgaccacaagctccaccagggtcgagcgcgcatcctgcgccgcctgctcgtactctgccgggatgtcctcgctcacgggcttgccgtcctcgaggtggcgcgccgtcatgtgcacgacgtcgatgatgcccgagaagccgtcaccgctgcccatgggtatggtcacggccgcgaggcggctgccaaagcgctcctgcgcggtgaggagggcggtgtcccagtcggcatcgggccggtccaggcggttgatcatgatggcgcgcgccagcgagaggtcctccgccgcgtaccagagtcgcgtggtgatggctcccggaccgcttgcggcgtcgatcacgaagagtgccgtctcggcggctgccagcgcaccatacgcgtcacccacgaagtcggggtagcagggtgcgtccagcacgttgatgcgcgtgcccttccacgtcaccggggcgatcgtcgtggagatggagaagccgcgcgcgccctcctcggagtcatagtccagcgtgggctttgtgccggcgtgcccgcccagacgggtggtcctgcccgtgaggtggagcatggcctcggccagcatggtcttgcccacgccgccttggcccacgagcgcaaggttctttaccctctcggtgcctgaatcagacatagtgcctcctcaaaccaaccaggtggcgccatcgcccgagagaccgcaacggcgatgtgccacgccattacaagccgcgccgtacgcgcttgcacaaaccttacccgtggccggcgggggcacgacagtggcatcgactagtggcggaatgggggcgctggaagttggtggggagaggttcggcggcaaaaagggggaggccgcccccctcgggacgacctcccctgtccagacgcttccagctggtggctagtctacgactgcctcctccttggcgtcctcctgggcgatgatcttggccttggtgtccacgtccaccgtgctcatgtggtccgcgtagaccttcttgccggtgggatgctcctcgagccagagctccttggccttgggggcccaggcctcggcgtagggcgtggtgcgcttgcacaggtcctcggccgactccggcgccacgtactcgctcgtcttggcgccggactccttcacgatctcgggaaggatcgtggggttctcgagcatggggcagggctgcagcatgttgtcgttccacggccagtgctcgcgatacgcctggaagatgggctgctgcaggcactccagccagctcttctccttgatgttggcgttggagtagtggatgaacacgcagggctccacgtcgccgcgggcgttaacgtggcagtacacgcggccgccggcgatgcagccgccaacgaactcgccgtcgttctggaagtccatcgcgaagatgggcttgccgccctcgacggcgcggacctcgcggatgcggtgcagcatgtactcgcgctgctcgacggagggcatgaggtcggcgttggcgccctcgcccaccggcatgtagtggaagaaccaggcccagcggcagccgtgctcgatgaggttgtcaaagtactcgtccgacgagacctcctccacgttgtacttggtgtaggcggtggaggtgccatagagcaggccgtgctcgtgcatcaggtcgaaggcgcgcatgacctcgtcgaaggagccggcgccgcgacgggagtcgttggactcgcgcgtgccctcgaccgagacggagaacacgatgttgcccacgcgctggacgtccttgcagaacttctcgtccaccaggctggcgttggtgaagatgttgaactcgcagtcgtcgtgcttctcggcaagtctgaggatgtccgccttgcgcacgagcggctcgccgccggtgagcatgaagaggtgggtgcccagggccttggcctcagtgatgaggcggtccatctcgtcgtacgtcaggttgagggcgttgccgtagtcggccgcccagcagccaacgcagtgcttgttgcaggcgctcgttgggtcaaagaggatgatccagggcacgttgcactggtacttctccgcgttggacgtggtgttgcgcaggccacggaacgccgcctcgtaaccgccgttgaggacggcggtcttgaggacgttgtggtcggtctggtcgatcacgtcaaagaggaacttctcccacttggagccggggtggagcccgttgcggataccgcgcgttgctccgggcgaggtgtccttgagcagcttgccggccatgtccacgaggtgatcgatgctcttctcgcggtcggggccggaggcggtctttatgacctggtcaagcgcgacgctgaaagccttgcgctcggcggcatgcgcgatcttggattgcatgtgccctccttacttctgcgtgggcacaccctggagcccacctgtagcggttgctacattactctttggtacccctcgcgaacaaggtgcgcacccccgatttaaaaattcgtgcctggagatggcagagaaactcgtgaaaacgttcctcggtcaacatccctggcgggcaccctggcgactcggttcaaaaaaggccaccccgtacggggtggcgcctgcgagctcgggaacgagcgtctctcacccctctgatgcaggggggaaggatacgtcaggaacttggtcgggatacaggttcctgggtcggttgccgggcaggaagtggtctccccagtacttgtccgagatggcgacgggatactcgccggtgaagcaggcgcggcagtagcccgtcttggggacgcagctcatgagcccctcaaccgacaggaaggcgagggagtcggcaccaatgtactcgcgtatctcctccacgctcttgttggcgctgatgagctcgttctggtccgccgtgtcgatgccatagaagcagggccacacgacctcgggggaggcggagcgcatgtggacctcggtcgcacccgcctcgcgcatcatgcgcacgatctgcttggacgtggtgccgcgcacgatggagtcgtcgaccatgaggatgcgcttgccggccacgacgtctgccagcggcgtcagcttgaggcgaacgcccatctcgcgcagactctgggtgggcgcgatgaaggtgcgtgccacgtagcggttcttgaccaggccggtgccgtagggcaggcccagctccgcggcaaagccctcggcggcaggggtgccgctgtcggggacgctgatcacgaggtcgacgtcggccggcgcctcgcgcgcgagctgggcgcccatgtcgtggcggaccttgtagaacgacttgccatcctgcacggagtcgggacgggagaagtacacgtcctcgaagatgcacttggccgtctgcctgggcggcagcccctcctccgagatcagcccgtcgtccgagatgcggatgatctcgcccgggcgcacctcgcgcacgaaggtggcgccggtgatgtcgagcgcgcaggtctcgctcgcgacgacccactcgccctcgccgagcttgcccaggacgagcgggcggatgccatgagggtccctgaacgcgtacagggcgttctcgcggatgaggaccatcgcgtagccgccctcgatcatctgcatggtcttgcggatgccggagcgcaggtgcgacgtggcgtgcgtgaagtagccgatgagacgggcggcgacctcggagtcggtggagctgcgaaacggcacgccggcgtcgatgagctcgcggcggagctcgtcgaagttgacgagggtgccgttgtgagccagggcgatgatcacgtcgttgatggcggagaggtgcggctgcgacgactcccagccctttgcccccgccgtgccgtacctgcagtggccgatggcgaccttgccctgcatggcctgcaggtcctcgtccttgaagacctcggtgaccaggcccatgtcctttctgaccagcacggtcttgccgttgcccacggcgatgcccgcggagtcctgcccgcggtgctgcagcgccctcagggcgaagtaggtgatgcgcgagacgtctcggttgggcgcccacacgccaaagacgccgcattcctcgtggagcccgcgggggcactcccccatcgagctggtaccggcacatgaagccatggtctcccctatcgcaggctagaatgtgaatgcgccgctcggggcggcgccgctgcttgcatgcctagtttagggcaacgggcaggcgtgagggcgttcgtgagggggagccatgggctttcgcacatatacctgccccatctcgcgccgctgcggcggatgcgagtggctggcggtgccgtaccccatccaactccgccgcaagcaggagcagatggaggagctctttgagcccgtctgccggcgtgacggctgctccgtctcgcagatcgcgggcatggacgacccccggggataccgccacaaggcggccacgccttacgcccccggcgccaagggtcgcattcgcagcggcttctacgagagcgggagccaccggctcgtgtactgcaagtcatgcctggtcgaggacgagcgcgcgcggcccatcctcaacgacgtcgcaatcgttgcccagcggctccgcatacctgcctaccaggaggacagggggacgggagtcctgcgccacgcggtggtcaggattggctacgccagcggagaggagcttctcaccgtggtcaccaacggcgacaccctgccccgcgcccgacgcttcgtgaccgccatccgcgagctgcacccgcacctcacctcggtcgtgcagaacgtgaacgaccggcggaccaacgccatcctcggcaggcgcaacgtgacgctctttggccccggtcacatgcacgactcgctcctgggctgcagcttcgagatagggcctacgagcttctaccagaccaacccccagcagaccgaggtgctgtatggcctcgccatccgcgccgccaacgtgcggggcgggatgcgcgtgatggacgcctattgcggcacgggcaccatcggcatctgccttgcctccgaggcacgcaggcagggggtgggcaacgtccacgtggtgggcgtggagcaggtggggaacgccgtggagtgtgcgcggcgcaacgtcagcgccaacgacctggcggactcctgcgagttcgtgcgagacgacgccaccgccttcatggcgcggacccagcgttgtgacgagagggtcgacgtcgtggtcatggacccgccgcgggcggggtcgaccccggagttcctccagggcgtgtgccgccttgcgccggagcgggtggtgtacgtctcgtgcaaccccctcacgcaggtgcgcgacctcgcgattctgcagggcggcggctaccgcgtgacctccatcgagcccgtggacatgttcccccacaccaagcacgtggagaccgtggtggcgctctcgcggcgatagcggggcgctcgttcgcgtgtcggctgcgtgacgttttgcccatggggacgtcgacatgctgcgtgggcgttgtccctctcccataacgtgtcatcctgtttcgggccttcctcgggaggctcgaagagaacgtcactcgttgtgggagaggctcgtccgatggttgttgatggcagctcggaaggtatggtcgctttcgggggcaacccccttgccggaaggaggcggcgctggtgggttggcctgtccgcgttcctcctcctgttcctcatgggcgtgttcgtcgagtttggcaacatggacaggggcgtcctgcatcccgcggcacagaccgccgcacgctaccaggccatgctgggatgctttgccctcgtgctaatctacctggttccgttcctggcctttgtgcgctacacgcggctcagggccggcgtcccccgctggctggtggtccttgcgctcgcgagcgggctctttgtccccggctggattgcaggcgagctcaacgacgctgcgaccaccctcctgggcatggtcgcatccaaggggttcgtggacgcatggggcgacgccatcgaggctcccgtcgttgaggagtccatcaaggtcctgacggtgtgcggcatgctggcgctggtgggaaggcgagacgctcgcgactggctcgtgggtggcatgtgcgttggcatgggcttccaggtctcggaggacctgagctacatcgagggccagatcgccggttcgcacaaggacttcgccacggcgattccctttacgctggggagtcgcgtgtctggcgccatggtctcgcactggacgtacacggcgctcgcggcggtcgccgtgtggctgttcttctgccagcgcaggaggcttcgcggcctggtggtcttcctgatcccgctgctcagccactttgcgtgggactcccccatggccgactggggcgtcctgccgatggccctgatctgcctggtcgccgccctcccgttcctgtacgtatggggtggcgtcgcgtttgacggcggcagggccctggcggcaccccggtgcaaggcgcagcccaacggggcaagggcaggcgagaaggacaaggtcacggggcaggatccctcccccatggcagccgggccgtccgatgccgcggcagtcaaccaagtcgagtccgacgacggggcgcaggtgcgaggcgagggctgagcgcacgtctcatgcctgcatgaacgacgggccggtccctcggtgcgaggggccggcccgtctgccttggttgctgcgcctctcccctactcggggtcgatgaccaccttgcggccgtccacgtgaacgcgaccttccgcgagcagctggatggtgtccggatacagctggtgctcgacctcgtggatgtgcgcctccagcgtgtcgacgtcccagccctcctcgacgacgacggggcgctgcgcgatgatggggccgcagtcgtagctgtcgtccgcaaagtgaaccgtgacgccggtcaccttgacgccgtagtcgtaggcgtcctggatggcatgggcgcccttgaagctcggcagcagggccgggtggaggttcacgacccggttcttgaaggtctcgagtatgggcgcgtggaccatgcgcatgtatcccgccatgatcacgtagtccacctggtgggccttgagctcggtggcgatgacctcgtcagccgtgatggggtccgcgtagatctccttcgagagcgtgagcgtctggaggcccgccgcctgcgcacgcttgagcccgtaggcgctgggacgcgagctcaccacgagctcgatgctcgcgtccagggtccccgcggcgatgcggtcgatgatcgcctgcaggttggtgccactgccggagagaaggactcccagcctgattgggtcgtgcctctcgctcatcgatacgtcaccttgccctcgccggagacgcactcgcccatgacaaagggctcgaagcccttggacgagagggccaccatcacgtcgtccacgtcgtccttggcgacgatgatgctcatgccgacgcccatgttgaaggtcttgtaggcctcgtcgggggtaagacccgcggcgttggcgcagtaggtgatcacgggcgggaccttccaggcgggaccgtcctcgccaccgcggtagaccacggcgtcgacgttggaggggagcgccctgttgaggttctcggtgatgccgccgccggtgatgtgcgccatggcgtggaagggcacgccctccttgaggagctcgacgagcttgcccgcgtagatcgtggtcggacgcatgacggcgtcggcgaggctctccccgcccagctccggcaggggctggttaagctcctcaacgctcttcccctcgatggcgaccttgcggacgagggagtagccgttggagtggatgccgctcgaggggagccccaggatgacgtcgcccacgttgaccttgtgcggcccgatcatcttgggacggtccacgacgcccaccacgaagcccgccaggtcgtagtcgttgggattcatgacgccggggtgctcggccatctcgccgcccaccagcgcgcagccggacagcttgcagccctctgcgatgccgcccacgatctttgccatgtgctccgccttgagcttgccgatggcaacgtagtccaggaagaagagcggctccgcgccgatgggcaccacgtcgtccacgcacatggccacgaggtcctggccaacggtctcgtgacggtccaggagctgggcgatggcgagcttggtccccacgccgtcggtgcccgagacgagcaccgggtcctccatgtccttgaagcccttcatcgagaagcaggagccaaagcccccaaggccgcctatgacctcggggcggttggtctgcctcacggcctccttgatggcgtcgaccgcgcgggcgccctcgtccacgtccacaccggcgtcggcgtaggtaacgtgcttgccctgctggctctgcatggctcgtctcctttgctagttgctcgcggcagtcgccgcgtttgcctctgactttggtacgcacaccaggatggagcgtccgtacccctcatagtagttgcaggtcgagagggtcagcacgtgactggtcccctggatgatctgttcggcatctgcccgccgcgacacggccttggcaagccgctccatgaggtaggacctgaactcctcgtcggacgagaagctgaactgcctcacggtggtgtcgttggggtccgtgaagtagacgaagagcggctcgagctcgtaggaggtaccctcggtcaggtaccagatcgtcggcgtgttatcgaacgtctcctggtccttgagaaggaacaggggctgaaacatggtgccgttcttgaggtggtggccatacaggatggtctgctggtccaccatgccgggcgcagtgttctggtagtccatgaacacctggccaaacacgtcgtactccttgttcggcccatgggtgaggtagaacgagttgtccgagtgctggaacaccgcgtagttcaccacggtccccgggacctcgatccagcccacggcctcgtcgttcatcgccttgagggacgaccagtccaccgtgggggcagtggacgtcgccgacgagtccggcgaggagggctcggtcacgtacttctgcgccatctcttgggtcacctggtcctgccgccagtaccgatactggttaaagccccagatgccggcagcgacgacgagaagccctacgccaaccacgatcaggatggtcgagaggacccgacgccagccgcgacggcccctcccgccgcccggttcggcggctggggcagcgtgcgtgcctctcctctgcctctttgccatgtcttcctaacgggatgcgctaggcctcggccatggagcgcttgaagtcgacgatcgcctggcgccactcgggcatggtcgcacccaggatctgcgtggcgtagatcgcggcgttcttggcaccgccgatggcgacgcatgccacagggacgccggagggcatctggaccatggagagaagcgagtccatgccgcccaggtcgctcgtcttcatggggacgccgacgatggggagcggggtgtacgccgcgacgacgccgcccaggtgcgccgccttacccgctgcggcgatgatcaccttgatgccgcggtcggcggctgtggaggcccactcgtggacctttgcggggttgcggtgggcggaggcgatcaccagctcgtagggaaccccaaactcgtcaagctgcttggtgcacgcctccatcgcggggaggtccgacttggagcccatgatgatgccaacaagcggtgcgtctgccattgcttcctccttgtcgcgggacaaaagcccgctattctgtaatgacccaccaagtatagacggcgtgggcacccatcgcggccagggtggggggcatcggggcgtcaccacgtcttgtccccacctcgcgctcggacgcatgcgtccgcaccccggcgccgtctctcgcatgcgaggagtacccatgcccgagcaagacgacgtgttcctgtatcaccgcgagggcccctacatcccccgcatcgccgcggtccatgacctctgcggctatggaaagtgctcgctcggggtggccatacccgtcctctcggccgccggctgcgatgtgtgccccgtccccacctcgctcttctcggcccacaccaagttcccgaccttctacatgcacgacaccacgcccatgctcgacgagtacctcgacgcgtggggtcgcgagggcgtggaggtcgatgccatctactcgggcttcctggggtcggcccagcaggtggccgcaatcaggcgcctctatcgggagcaccccgacgccctgcgcgtcgtcgaccccgtcatgggcgacggcggccagaagtaccccacgtacacggacgagatgtgccaggccactgccggccttgtcgacggggcagacctgctgacccccaacctcaccgaggcctccattctgacccacctgccctacgagggccagtcgcccgacgatgcccaggtcgcacgcatgatggacgagctccttgccatgggcgcccgctacgtggtcatcaagggcatcgtgcgtgggggagacaccatcgtcaacttcgtcgggggccgtgacatgggcatgcggccggtcgagggcaggctgctgccgttcatgatccacgggacgggcgacctctacgcctcgtcgctgctcgccgccatcatgtgcggacatgggctcgtggacgccgccgggttcgccgggagcttcgtccgacgggcgatggaggtcaccaggctgcagcccgactaccagatgaggggcgtcagcttcgagacggtcctgggtgacgtcaccgcacttgtggggtagcctcaggatcatatggcaagagacaggagggggaccgtccttgcgaacggtccccctcccccttagcgctactttccggccgacgaggagtcggcggagtcggagcctgccgacgaggccgacgtcgcggacgagtccgcctcgtcgctcgaggacgtggtcgtgcgatccacgatcaggtcgtcgtcgctactgctgctgtcgctcgagtcgctgctgccgaggacggagctgatgatctcggacggggtgaacgacgaggtgatgctgtcgtgcagcttcttctgcatggtggagtcaatgcccgtgatggtgcagttgaacttgacccccgaggtcgtgttggtcttggtccagatgaaggtcatcagcgtcttggtctcccccgtgggcttgaggaacccaaacaggctcgacgtctggatcttgccgttctcgtcctcatggacgttgacgtgatagatgaccgtgttgatgttggggttgagcagcgagttcacggcgagggccgtcgcctggatctgcgatccggagaacacctcgagttcgttggtcgaggtcgtgtccgtcaccgtgacctcgatgcgatgggtgttctcgtccgcctcgacgacctggaagtcctcggggaactgggtgaagccattgccccactcgacgccgccctccagggcggaggcgaccgtggagacgctcacgtcctccgagaggtttgcggtgctcgctcggcgggcggcggcacacgagacctggccgagcacgaccaccaggaggatgacgatgacgaagccgatggcggtacgggtgatggtggtgcccacgtttgagccggaggggtcggcctgggacagcgggtcgatgtcgacgccctggcccgcctgctcgcggtgacgacgctccttgcgcgccgtctcctcgttggtgtgaccggtctcgtcgacggtggcaaagagcttctcggcctgctcggcgttgagggcgcccttctccctgcgcgctccctctctcttctttgccatctgaagtctcccgtaacgaacgtatggtcacaacgcggacgcggcccacgaggactgagtatagataatgagtcgcatccgtttcttaatgcggccccgtcttctccccaactgcacgtatgaggaggggatggggccgtccggtcactcggagcccgcgactgcgtcaggtgcgagtcgacgcgagaccgcgtcgcagatgagggcacctatcacggtcttcgcgtcctcgatccgcccgtcgagcaccgcgtccacaaactcgggaaggctcaccaggtcgacgttgatgaactcgtcggcatccgggctcgagtggtcgagcgagaggcccgtggccatgtagatgtggatgagctcgtcggcaaagccggcggacgtggcaatcgtggtgagaaacgcgatgttgcgggccctgaagcccgtctcctccagaagctcgcgcgaggcgcagtccagcgggtcctcgccgggagagagctttcccgcgggaatctcgaccgtgaccctgcccagggcggcgcggtactgcctcaccaggcagatcctgccgtcctcggtgagcgccacaattgcgacggcaccgggatgcctcaccacgtccctgatggcgggacgcccgtccggaagcgtgaccctcagccggtcgacgtcgaagatcttgccccgccactcaacctgctcggtttccacgcgctcggtcagtgcggcgtcgcgcgggtcctcgtccccaaggacgaggtcacggcgctgcggctcacccgagacgtggtcctgggacgagcggtccccgtcgtaggtgaaggccagggccgaatccctcacgctcctgagggcacccgcgagcggcgaggtcccctcgtcggtcctatccccgtcttccgatgctgacatctctcgcacctcccggacctacaggttctgacgacccttgatggccttgatgccaatgtcgtgacggtaggtcttcccctcgaagaagatcttgtcgcatgcctggtaggcgcggttgcgggccgcctcgaaggtgtccgccacggccgtcacgtcgagcacgcggccgccgttggtgagcaggctgccatcctcgccgagcttggtcccggcgtggtacacggtgacgccgtccatcttgtttgcctcgtcgacgcccgtgatgaccttgcccttctcgtagtgaccggggtagccggcactcgtgaggaccacggagacggcccagtcgtcgtcccagccgatggtcgcgggatcgagcgtccccgcgtcgcaagcgaggaacgcctcgacaaggtcacccttcatgcggggcagcacgacctgggtctcggggtcgccaaagcgggcgttgaactccaggaccttggggccgtccttggtgagcatgaagccaccgtagaggcagccgctgtaggtgatgccgtctgctcgcagctggtcgatgaccctctgctcgatgtccaccatcttctcgagctcgccgggcaggaggatggggacgggggagtacacgcccatgccacccgtgttggggccaaggtcgccgtcgtaggcgcgcttgtggtcctgggacgttgcgagggggaccagcgtggtgccgtcggtgagggcgaggagcgagcactcgggtccctcgagcatttcctccaccaccacggtggagcccgcgtcgccaaagctcccgccaaagcactcgtggacgccctcgagcgcctgctctgtgctctgggcaacgatgacgcccttgcccgccgccaggccgtcggccttcaccacgcaggggccggcgagctctcgcacgtactcctcgcagggggcctgctccgtgaaggagcggtagcgggcggtgggaacgccggcgcgtgccatgacctccttggcgaacttcttggagccctccatctgggcggcctcctccgagggaccaaacacggggatgccctccgcgcggaccgcgtcggcgacgccattgacgagcggcgcctcgggtccgatcaccacgaggccgatgccgttctcgcgcgcgaacctcgcgacgtcctccggggagtcctggtcgcagtccgcctggctcgccatcgccagcatgccgccgttgcccggagccacccacagcctccccgcacggggggactcggccagcttcacgaggagcgcgtgctcgcgcccgcccgaaccgagcaagaggatgtcgatcttctcttcgttactcatgctttcctccaaacgtcacccgtcagggaatgtagcgcaggatacgggccgccccctccgcggggagaagcgaatgcggcacgtaggcaaggcccaccgcaccgacgccgaggagcgccgtggtggtggggttggtgttgagaatcgccgccctggtcgcctcgaactcgttggtgtcgagcggcttctcgatggtcgagaggagccggggcacgcccgcgttgatctcgacgtaggtgagcgggcccaccacctgcgagtaggagctcatcgagcgcgccatgttgccggcgaggagccggatgtccgtggagcggaactgctccacggctacaccgtcgtcaccgatcgagaagcagcggcgcacccccagcgcacgaacgcgcagggagtcggcacggccgagaagtccgcggcggtggcgcgtccccacgagggtcggactggcgtcgggcgcgggtatgatgagcgcccgcgccgcctccgcgacccgcacggcactctccaccgccgcctcggtcgacatgccagcgtcgcggtcgaggacgaggcgggcaagcaccagggccatctgacccgagacgcacttggtgtccaccacgtgaacgttggcctcgcggaccctgtgcgccgccttcacggcaaggtcgtacgcatcgcggatgtgcgacgaggcgtgcagcgagacgatgtccgtgtagcccctgtcgacgagggagcggtagacaccctcaaactcctccacggcgggggtgaaggtggtcacctgccccttggtcgaggagagctggacgaagaagtcgacggggttgaggtcgatgcagtcccggtagctgtggccggccacgcgaacgacgagcggaacgagcgcgaccccggccctctccaggttggagagggggaggtcgcacgcgctatcgcacactatggcaaagcccttgcgggcggaatccacggtcaaggctagttccagtagcggttgatcgtctgctcgcggtcgggaccgacggtgatgatcgaggccctcacgccggcgagctgctccaggaagtcgatgtagtccttcgcctctcggggaagttggtagaagttgcggacgccggagatgtcgcacttccagcccgggagggtctcgtacaccggctttgcgtggtagaacacgctttggtgctcgggcaccgtggtgtagcgcttgccgtcgcactcgtacgccacgcagaccttgatctcgtccaggcagcccaggacgtcgagcttggtgatcgccaggtcggtgagcccgtttacgcgtgcggcgtagttgaccacgaccgcgtcgtaccatccgcagcggcgcttgcggccggtggtcacgccatactcgtgtccgacctcgcccagcttgtcgccaacctcgtcaaagagctcggtcgggaaggggccggagccaacgcgggtcaggtacgccttggccacgcccaggacgcggtcgatgcgggtggggccgacgcccgagccggtgaccgcgccgcctgcggtgcagttggaggaggtcacgaacggataggtgccgtggtcgatgtcgagcatcgtggcctgggcgccctcgaagaggatgttcttgccctgctcgagctgctcattgaggaagagcgagctctccacgatgtaggggcggatgcgctccgcatagggcaggtaggtctcgcagatctggtcaaccgtgtaggtggggagctcgtagaccttctccaggatggggttggtgtaggcgagcgcgctctccagcttctcgcggaagatgtgctcgtcgagcatgtcctggatgcgcaggccggtgcggttcatcttgtccatgtagcagggaccgacgccgcgcttggtggtgccaatgaggttcttgccgagcttcttctcgtgcgcgccgtccaggtccttgtggtagggcatcacgatgtgcgcgttgcccgagatcttgaggtcgtcgcacgagatgccctgcttctccaggacgtcgatctcgcccaggagcacctcggggtccacgatgcagccgttgccgatcacgggatagacgcccttgtacatgacgcccgagggcacctggtgaagcgcgagcttgtgcccgttggcaatgaccgtgtgccccgcgttggcaccgccggcatagcggcagaccacgtcgaattcgccagagatgaggtcggtgaccttacccttgccctcgtctccccactgagttccaactagcactgatgccggcattgagtcccctctcgaagctgcgttcgatactcagtcaagtatacgacggacccgctggagcccgtcccagactgcgtgggcactcggagccaccatctgcccagcctagtcgtggtgcatgtccacttccacaaacttggttgacccgggaaggaaggtgagcgggacgatgtcaagcgggcccgagcggttcttggcgatgatgaagttggtcacgttgaagtcggggcggtcgctcgcctccgcctcctcctcggtcatggagcggtccaggaggatgacgacgtcggcgtcctgctcgatggagccggactcgcgcaggtcgctcagctcgggcctcttccccttgcggtcggtgacggcacggttgagctgtgacagggccacgacggggacctcgaggtcctttgccatgatcttgatgccgcgggacatctcgctgacctccgtggcgcgcgagtccgccctgtggcggcccgcggggggcgagaggagctggaggtagtcgagaaggaccaggccatgctccttgccctgcagcatgcgccgtgccttcgccctgatctcggtcaccgtggtgccgggggtgtcgtcgatcatgatgtcgagcttggagagatctcgcgttgcctcgaggatggtcggccactggttgtcctggatgcgggcgccacgaatggccgagaggggtatgcgcgcctgcgccgagaggaggcgctgcgcgatctcgaccttgctcatctcgagcgagaagaacgcgatggacgccccgtgggccgccgcgttgaccgcgaggttgagcgcgaaggaggtcttgcccacgcccgggcgggcgccgatgacgatcatctggccgggacgcagtccctgcaggcgctggtcgatgcccgagtatccggtcatgacgcccagggagccctcggggttctggcatgcctcccccagctcggtgtacaggtcgcccatgacgtcggccaaatccgagtagctgtcaccgatctcgcggttggtgacgttgaggaggaggttctctgccgagtccacgacctccttggtgtcctcgggtgcatcgaacgcgagcgccgtgatcttggccgaggcggcgatgatcgcgcgcagcgtcgagtcccggtgcaggatctcgacgtgatggcgccagctcgcaagggcgaacgagtctccgttgagctcgaggaggtacgccatgccgcccgtccggtcgagctggccctgcgacttgaggtggtccgccagcgagatggggtccacgggcttgccgcggtcgaacatctcgctcatcgccaggaagataagcctgtgggagtacaggtagaagtcctgctcctccaggtcgatcagacactcctgcagaacatcctgcgagaggagcatggcagagagcacggacttctcggcggcaagatcctgcggcatcgaggcgtcgccggcagacggcgccggttctctgtcgtaatcgatgggggcgtcttgcatgggacctccggtgatgggtgcatttggtctaactatagagcctttgaggtggcgggcctcatactccacacgcgagttggcaacgtgagcccgccctttggctggcgcgcgactgcatacattcgcatcatttctccccgcgcggcgtatcccgacacggatggacccatctcgcccgcaacagagacccaactgggcattgttgacactgcgatgcgtctagcgggggtgttagaagttttcacagttttcaacaatttgcgaaagcaggggatggcacgcatcgccttacacatccatagcagggctttttcagtggcatgacccttttacgtgggattattcacccgtgccgttgcgaggagccatgatttcgcaggtagaaggcccatacctggcgttccgcatacagcggccccccgccggactgaatccgttggggggccgcagcagactttggggctgtgcgtcctaagacgtccttgccggggaaatgttgatttcccttcgagagaaaccgctactcggcagcggcctcggtctcggtggcggcagcctcgtcggcctgggcgtcctcctcggactcctcggcctcgggctcctcctcgttcacgcccacgaggacggtgacgatcgcgttgatgtcgcgatagaggttgacctcgacggggtgcttgccgacggtcttgatggtcgcaccacggccaatgcgcttgcggtcgacctcgacgccaagctgagccttgatcgcgtcaacgatctgcgcggtggtgatggagccaaacagctggtcgttctcgccgaccttggcctccacggtgacggacttgccgtcgagcagctccttggtggcgtgcgcgtcggcgaggcgcttggcctcgcgcttctcgatgcccgcgcggcgctcctcaagctgcttcaggttgcccggggtcgcgggctgggcgatgcggttggggaacagatagttctccgcgtagccctgggcgacgtccacgacgtctccctcgccacccttgcccctgagctcacccaaaaggatgactttcatgggaactccttcggttggtcggcctaggccgactccttgctcttctctcttgggccagactctctcccccgccttccacgaccgaggccgcggaagttggcgaggaggtcgacgaggcccacaatgccgacgacggcaaacgaccattcgagccagaccgccaccatgaccgcaagcgccctggtgaagggatcaaagcccctcctctccaggaaccacgcgatgagcgccatcccctgaagggaaagcgccacgcgcgcggccacgagaacgttggtcccaacgaacccaaccaaggggttgaggtccgtgaggtaccgcggcgccaccgccgcagcggcggacaggacgaacacgatgcccatccaccgcggtgcgtcgtaggacgagagtctcccaacgggaagactcacgttcatcgaccgcgcggccagcttggtcccccagtgcgcgaacaggacgattgccccagccgcacataggtaggcaagcggccagtaggacgccacgagctttcgtgccacctccacctgggagctcatcgtgaggttcatggaacccccgtacgaggcacccatctggcggaggacctcgtcaaacgcggctggcaccgaggtgccgttgagtgccgcggctgccgagtccgaggcgagcaccaccaacgtggctgcgatgatggcgaggcttaccctgcccacggtcacctgcctgccatagaccatgcggaccatggcgagacagacgagcgcaatcaggactgacattgggatctgccaggggttgtagaggatcgagacgacgatccccgcacccgcggccatcagcgcggccgttctgaccgattcccggtcgtcgctctcgttcacgaacgagaggccgtacgtcgtcaggaccgccgcgatctctgcgctcaggggagcgcaggcaccgccgagaatggaccacatcatgccccgccggtagcgcatccgccccatgccgtccccctggccacgcgcgccaaatgggacgacctcgcggctctcgcccatgccgtcaggtctgaccggcccgttctttttctcgctatcgttcaacgattgcggtccttagccctttggaacctctacccgcggttgcggccgccgcggctggagaccacgggaaccgtgtagggcagaagtgccatgacgcgggcgcgcttgatggcgaccgcgatgtcgtgctgatgctgcgtgcaggcgccagtgacgcgacggggcttgatcttgccacggtcggtcatgaacttgcgaaggagctgggtgtccttgtagtcgatgtactcgacatcctccttgcagaactggcagtacttgcgacgcggctggcgctgttcaacttgcctttgcttagccatgtctttgttgcctttcaactggtggctcgcgccacctactcactagaacgggatgtcctcgtcgtagacgtccgcctggggcggggtctggacgggacgctggggctgtgggtttgccgcgggcgcgggtgctgcgtagctcggcgagggggaggacatgtacgccccgttgttgcggggctcgtagccctggccaccgccttgctggctcctggaggagaggaactcgacctcgtcgacgacgacctcgagcttgctcctcttctgaccgtcacgctcccacgagctgtagcgaagcttgccctcgatggcaaccttcgagcccttggagaggaaacggctcaggggctccgccctgttgccaaagacgacgcagtcaacgaagttgggaacatcctcccactcgcccgactgtgggttgcgacggcggtcgttgaccgccacgccaaacgacaggatggcggtgccaccctgggtctgcttgagctccgggtcgcgcgtaagattgccggagatgttcaccctgttaatgctcacgtcgctcactgcctctcatccgcgggcgcaatgcccgcctctcatgactagtccctgtcggagcggcacacgatcatgtgacgcttcacggcatcgttgatgcgcagaactcggtcgagctcggcgatctgtgcggggtctgcatggaagttgatgagggtgtaatccccctcggtgagcttgtcgatctcgtaggcgagcttgcgcttgccccagtcctcgacgttgtcgaccttgccaccattctcggaaacagcgacgtcaatacgcttcatgacggcggcgcgggtctcctcggtgcttgcgggatcgacaaaatacagcagttcataagccttcatgtggtcacctcctctgggctaaacggctccggttagtgaaggttgcctccggagcaggaaaggtcaaggtgcgatgttaacacacgatgccgcggaagggcttgcggcctctcccacggcatcaacaacacgcagaccccacatctatgctaccaagggcacgggagcctctttaccccctgttcctgacaaggtggcggtatgcgggagacgactccccaaacgctttcggaagcctcgctcgggagtttccggtccttacgaatccactaggcgagaggttcctcccccgtcggatgagaggaatcctcgctaccggcgggttgggtcgggggctcctgggccacgccgttctcgccttccgattcgtggggctggggcgtgacgggagattcggacgcctccccctccgaagagggcgactccggggcgaccgggtcgacggggcggcactcggaggacgagggcagctcgggggtctggggcagcgggtcgccgctggcaccccatgcgggcacattgaactggcgcatccacaggccaacggcggtgatgagaatcatgtccgtgaaggtgctgaggaagttcgtggcaaaaagcagcaggactgcccacggcgcgatgtccgtgaacgccctcgtgattgcataggcgaccgcctcggtggtgccggagtaggcgatgatgctgatgatgctgaagaccacgggcgcgaggaggataagcgcaaggacgaagaggatgaggccgatgatgagttggatgaccaccgacagcccggcgatcctgaagaaccctgagccatcccgcttcagcatgtcgacgatgcggtccgccctatacccggcagtgaagttctggtatatggccgcgcgaagggcgcagatcttcgtgacgatggcaaagaggatgcccgcgacgtcgatgaggatgctcacgaacgaattctcgttggtgacgtccctcaacatggcgcctatgagggcaaagatgaccacccagccgatgacggagacaaagcccctccatcccgccttgatgcacttacccacctggacgttcttctgctttggcgaggagtccactccccaggcggtgaggcgcgcccactcgagctcgtagccaaacacacccagcgcccccacgatggggacgaagagcgcaacggacatgaccagcagcggcttgtaccatcccttgtccctggagaggagcttccaggaccgggagtaatacccttcgtttccgtcagccaaggggttctccttccaagagccaacagtagacggttgggcaatgcgagagggttctcgcacgcccctttgaaagagtatcccccaacctcggttccagccccctgagaatggagggcatgcgacagacagtcgtcacgatgcgctcttgacacaaaaggggcccgtcagagacggaccccaaagtactcaatggcggaggaggagggattcgaaccctcgtacccgcgtagcgggtaaacggttttcgagaccgccgcattcaaccactctgccacccctccgaagggtgtgaaagcggcgcccgcaggcgccgctcctcattcgctggcggagagtcagggatttgaaccctggatgcgctttgggcgcatacacgatttccaatcgtgctccttcggccactcggacaactctccgtaaaaccgcaaggggaagtatacattacttactcttgcgatgcgactctcactttttctccaataaggtttgggtggtgcgggaccacgtccgacattgtgtctatctaattttctccgcttgaggaaatcgagaagacacccacacttaactgtcgattaatgacttgcttttcacgaatatacatttcacaaataatataccagttaattaaagcgcttctattctgttttatgtaacttagtatggaagtgaggtgtccgagtgtcgcgaatccacatcacctctgaaacggggagactccggagggttctattgagcaaaccggggagggagctggagaaccttcacccgttcatgctagacgagatgcttttccgggatacaccatttactccccaagcccaggatgagcacgactctttcgctgacattcttcgtgaatgcggtgtcgatgtgctgtacctgcgtgacctgttcgagcaggcaatgtcaacgcccgatgctcgaaaatccttcgaggcggagttcgtaagagtgtcgggcattgcctcggactccctcaaggaggcagtgcttggctattacgacgggctggacacaagcacctttgtcgataccgtgttgtgcgggattcgctctgacgatccactcctaatcccagacaacgatcttggctccctcgttaaaaacgacagcccgttcgtggtcaaccccattcccaacatctacttcgcgcgtgacagtagcattaacgttggtaacgaggcaattttctctcacatgtatatgaactaccgaaagagggaacccctcctcctgcgctatattcaccactattccgaatactttgcctctgagcccaccgtcgatctgtatgacgccaaggcaccatggaccatcgagggcggagacgtgatggtggcgtccgacaaggtactgtgcattggttgttttggacgtacgcaaccgggggcaatcgagcgcgtcgcctcatcggcatttcatatgggctggcagaaagttctcgcctttcacctgagggacccacatgtgatgcaccttgatgggatgctgacgatggtgagccctgacacattccttggcaaccccctcacgctgaaacgcgttgaggtcttccggctcacaccgggaccaagtagctctaataccaagcaaggcattcagactaagctgctggacggtgggtggaaacaggcactgagagaggcagcaggaacaagcacagttcgattcctgccatgtgggggcgatgatccgctacgcattcgctgggaggcttccaacctcgcctcaaacgttctcgctgttgcgccaggagaggtagttgcctatgaccgaaaccccgtgacacttgacgaactagatcgcgcaggaatcgtagttcacacgttctctggctccgaactggcgcgcgggaagggcgggccaagatgcatgtcgatgccaatctggcgtgatgaccctgagtaacatccgagcactgatgtcattgaaaatggagggcgccatgaagggaatgacaagaaggacgttcgtctcctcgttgatgggcggaatggccgcaatgacactatttgggtgtggcgcatccaacaattcaagtggagattccgacagcaccgccgccgcgacggaggtcgcagactacaagctcatcaaggatgggacgcttaccgttgcgtattcgaacggtttccccccaatggagttctccacggaggatggctctgatacccaagggttcgacattgaccttatcaaggcagttgccgacaagcttggattagagtgcaagattctcccctcccaaaactttgacaccctcatcccaacgattaagacaggtggcacggccgacgtggcggtctcctccatcaccatcaccgacgagcgaggggaggaagtcgacttcaccaatccctacctcgcttcaaaccaagctattctcgcgctcaagacctcgtcctacgacaccgcagacgacttcaacaagtctggcgtaaaagtctcggccactgcgggcagcacgggggaggcatgggcagaggaaaacctacccaacgccactttcgtgccggtagatagctacgtcgatagtttcacgggctgcctgaccggtttatacacggcagtcgtcgcagacctgcccgtcgcaaactatctggttaagacctcatatgacggacttaaggtctgcgttgagattccaaccggagaggaatacggcatcgcagtctcaaaagagaatccaaatcttaccaaggcaatcaacaacgccctttccgacctcgacagcgacggtaccatggacagcctcaagacgaagtggttcgggacaaccgaggggatgtagcccgtcaccctacgcaatcacattgccactccccgagggggacgaaaccgtcccgaccgcgcctggcaggtagcgcgcactggcgttaccatgctccacggaatgtgggaaacgcgtccgggcgctgcccgatgtgggggtacacgtgatacctgaactcttctcgagctacgggccggacacggctgccgtcgcgattcccgcctggctcgacctctccgcagttgtggcaggctcgttcacgggcattctcgttgccaaggagaggagcctcgacctggttgggtacctcgcgctctcgatcctctgcggccttggcgggggactcatccgtgacaccatcatgcaggtcggcgacgtgtacatgctccgctcctcctacgccataccggtcacggtcattgccgccatccttgggtttctcttctcgggcgtgctgcacaagtttcccaacctgctcaactgggcggacatcatctcggtcggcctcttcgttgcggccggcaccgacaaggccatcgtctatcacctcagtccgtgggcgtgcgcgctcatgggcacggtgaccggagtgggcgggggaatgctccgcgacatcttcctgggagacataccgaagatcttcaaaaggagcaacctctatgccctctgcgccgttgcggggtctgcggtctattacgtgctggttctaatcctctgcatcaacaggccatgggcggctctggcctgcgtcgcaatcgtggtcgcactgcgtatgtggtcgctcaagttcaacgtcctctcaccgtcagacgtggacctgacccccaaagcaacccacgcggcgagggtcgtgtatcaccgggccatggcaaggggcgagcacgagggaaagacctacgtcacccgctacaccacgaggtccgacggggacgatgaccctcacgagaatcgcccgagcaggacgtagcccaaccagtttggtgcatgggaacgaaacgcggggtccaagcgactgctcggaccccgcatcgtctgtctcgcttgtctgcgactacttgtcgaccatcccgtgacggacgcgccacttgcggcgctcggtctcgttgaggatgcgcttcctcatgcggatgttcttgggcgtcacctcgaccagctcgtcgtccatgatgtactccatggcctcctcgagtgtgaaggtgcgcggaggggtcagctgcacggcgatgtcggcggtggaggagcgctggttgcccaggctcttggtcctcgcgatgttgacgaccatgtcgcccggcttggatcgctcgcccacgagcatgccctcgtagcactcggtgccaggctccacgaagagcgtgccacgctcttggagcgtgccgagcgcgtaggcaacggccttctcggtggacatcgagatcatcgcgccgttctggcggccgccgatctcgcccgcgtacggaccgtactccaggaaggtgtgatagaagacggcctcgccgtgggtcacgttgaggatgcggttcttgaggcccatgatgccgcgggtcgggatcttgaactccaggtgggtctgggtggcaccggtgtccatctgcgacatggtgccgccgacgttgccaaagagttcgatgaccttgcccgcgtactcgccggggcactcgacgaccgcctgctcgatgggctcgaccttgttgccgttctcgtccttcttcaccaggacgcggggacggccgacctggaactcaaagccctcgcggcgcatctcctccatgaggacggagaggtgcaggatgccgcggccggcgacctcgacgcccgtcttgtccgggagctcctcgatgcgcatggtcacgttgttctcgcgctcctgctcaaggcgctccttgagctggcgcccgcccacgatgtcgccgtcgcggccgacgaggggcgaggtggagggctcgaagacgaccgcgagggtcggggggtcgatctcgatgggctcgagctcgacggggttctcggggtcggtgtagacgtcgccgatgtccgttccgtcaacgcccacgacggcggcgatgtcaccggccccaacctcctggcactccttgcgccccaggtagtcgaaggtgaagagctgcttgacctggctcatggccctgctgccgtcgttcttcacgacgaggatgcggtcgccgtcgtggatggtgccggagtagatgcggccgatgccaatgcggccgacgtagtcggagtggtcgacggtgacgacctgcatggcaagcgggccctcgaggtccgcgtcgggcgcgggcaggtcatcgacgatcatgtcgagcagcggatacatgttgtcgttgccgtcgttggggtcgagacgggcgtacccgttgaccgccgacgcgtagaccacgtgctccatagagaactcgaggtgctcgtcgtcggcaccgaggtccatcatgaggtccaggcagtcgttgagggccttctcgggattggcgccatcgcggtcgatcttgttgatgcagatcatgatctgcaggccggcctggatggcgtgggtcagcacgaagcgcgtctggggcatggggccctcagcggcatccacgagcaggacggcgccgtccgccatcttgaggacgcgctccacctcgccgccaaagtccgcgtgacccggggtgtcgatgacgttgatcttgacgcccttgtagtcgatggagatgttcttggccaggatggtgatgccgcgctcgcgctcctggtcgttggagtcgaggacgcgctcctcaacctgctggttggcgcggaaggcatccgttgccttgagaagctggtcgacgagcgtggtcttgccgtggtcgacgtgagcgatgattgcgatgttcctgatgtgctcctggagcataggtccctctcgatcagatgatgcgtttatgtgcagagatagactcacgcactgtatatcagtcttgcccatgcgtgcgtaaggacggtgtcattccacctaaactgcttgttgtcagatgaggggatccaactcccccgccggggcggggtccgtccagcggaaatcctcgccctctcccacgccgtccacgaaggagtacgccgagtagctgcggtagcccctctcgccaaactcgaggagaaccgcggggagatatgcgcccgtctcgtcggcgatggatgcctcgtacgcgattgcatagcgcacgggcagggcgatgccggcggacgagtcgccgtcgccctccacggtgcggacgaccttgtcgcgcgccgcgtcgagacaggcctgcgggccatcgtcggcaaactcgtaggaggccaggttgccgtcgccgtcctgcatcaccaggaggacgttaagctcctctcccctggcgagcgcatcgaatgcgtctcccatgagcgttgtgctcatcaggtcaagctctggggagacgccctcgcggcgactccgagagttcccttccttgtcagccattggcccatccttcccctcgtcaacgggtcaatagtacttcagggcggacgtggcgggaacgcaaacggggccacccgcctgacgcggatggccccgtcttgggcactctcgtgcgagcgttagtccattgcgacctcgatgccatcgaggtaggtcctggcgaggttgagctcgcggtccaggacgacgaagtccgcgtggcgtccaggcttgatgaatccgcacacgtcggcgatgttggacgagacggccggaatctccgtggccatgcgaatcgcctgctcggcggtgacgatgttccagtcgtagacgttcttgacggcctggtgcaggcagagcacggaccccgcaatgctgctcatgtcggcgaggtagcagacgccgcccttcatgaccaccgggagcccgccgctcatgtagttgccctcgggcatgcctccgcagccaaggcagtcagtgatgagcgcgacgtgctgccagccctttgcgcggaccatcgccgcggccgccgcgggaaccacgtggtggccgtcgcagatgagctctgcataggtgtcgggggtgaccatggcgcatcccacgacgcccggctcgcggtggtggagccccctcatgccgttataggtgtggacgaagacggtcgcacccgcgttgaccgaggccaggcactgctcgtacgttgcgtcggagtgcccgagggaggtcacgacaccctcccgggcgagacgggcgacatactccggcgcctcgggatactccggggcgagcgcgctcttgacgatgaggccgcgggcacgctcctgccacttggcaaacacatcgtacgacggcggcatgaggtacttggggttttgcgcgcccttgtgcttgagcgtgaagaacggaccctccaggtagatgccggggattcgcgccccgacgaagccctcgccgcgggagtcgacggcgtcggcgatggcggcgcactggtcccctatccgctcgacgtcgtcggtgaacgtagtggggagccatgccgtggtcccgcgctgtgcaagggcgtggctcgcctcattgatgccgtcggggtcgacgtcggtcgttgcgtggttgtggaacccatggatgtgcgtgtccacgaagccgggtgccacccatgcgtcaccaagctccagaacctcgcccgcgggtttctcgtcagagtacgcgccaaacctgccttcatccacgacgaggtaaccagggcccttcacgcacccggggagaacgaacctctcagcatgaatggaatacgaagtcattgcccctccctacgcctcgagcgggtggatggtgacgccctttacgacacggttgacggttccggtgggagaaggggtatcgggagtgtttcccaccttgatggacgcgttgagcgccaccgtctgggcaaacatgacaaaggggagcgcaaggtagccctcgggcagcgcgtcgtagtcagcggagaaggtgaaggactcgccctcgaagagctcgccggactgctgctggattcccatcgtgtgctgcgctatgccgtcgcccgcgatctcgtgcaggatgtcaaggtcgtactgacgggtgtaccggtcgttgctcacgaagtcgaagacgagcgtcctctcgttcacgaaggacttgggcccgtggcggtaacccattgacgtgtcgtacgacgtggcgatcttgccagcggtgagctcaaggatcttgagctgcgcctcgcgcgtcatggcgccgagggcaccggagcccaggtaggtgatgcggtcgaagtcgccggccaggaccttctggatttcggattcgcgtgccaccacatcgcggcccatggccgccgcaaccttgacccagtcgcccttctcctcacgggtcgcctggtcaaagatcatgttggagaggagctccatgcagctgtagctgccggtcatggcaaagccctggtcgtttgccctggggatgagaagtgtgagggcaccttcgtgatcctcgaactgcacggcgagcttgccctcgggggcgcaggtgatgttgaggtagagaaggtccctcacgacctggccggccctctcgacggcagccaggctctcggggctgttgccgctgcgggcaaacgacacgagcaccgtggggtcatcgggacggaggtagtcgtagggggcgctcacgatgtccgtcgaggcgagggcctggaactcaaagctctcgttgtcacccgcgtggcgcagatatggcacgagggtgtcgccaacataggcggaggtgccggcgccggtgaagacgacgtgggtcttcttggagccgccgagcgccttcgcgcgggcgacgaactcgtcgatggcggccttgttgtcgtcgtagatcccgagcgtgtcctcccacagatcgggctgctgcttgatctcgcgcgtggtgatctcggcacccatcttgagcagggtatccttgtccttctcgaacatgtctctctcctttcgggtcagcctgtcggctgccccctgtagtgggtgatcttgtacttgaactggtctgccctcgcaacgctgtgcgtgtactccacgatctggccgacgtcgtcgcgcgtccgtctcaccagcctgaggacggccgacccctcggagatgcccagcctgaacgcctcttcgccgctggcgaggcttgcgctgaactcctcctttgcctcccggatgatcaccccgtacctcttctcgatcacgtcgtagagggggttgtgctcaaggagctcgctcgtgagcccggggaacacgctcgcgggcaggtaggtgcgctcgaccatcatggggaccccgtccgcgagacgcaggcgcctgaagctgtagaccatcccgccaaggggaaggtcgaggttgctcgcgacctgctttggagcatcaaccacgccgaagtcgatgatctgggtgctggggttgcggccgagcctgcgcatctgctcggtgaagctgtacgttccggagaggttggtcgcctccacgtgcggctcggcgacgaaggtgcccttaccgtggcgcctgtcgacgagccccatggactcgagctcgcggagggcctgacgaacagtggtgcgtgagagaccatagtgctctgacagctcgcgctcggagggcagcaggtccccgggctccatgtcgctgtcaatcttctccctgagtgcgtccaccaactggacgtagagcggctgtccgtatgtcccgcttgccatcttcacgcctttctcccgcggtgcgaacatcacagtaggccaagtctcgccaacggaatgtgggccttctgcgtggaagacgggacggctgccgtcccaaggaggggtgcgcgggcactgtgtccgcgcaccccaggggagactcgctctgggctagccccagatgctgggccacagaccaaacgggccggcgcccacgatgccgatgataaagacgaggacgatgcccttcataggcgtgaagttcttcttggcgaacaggtagtagagcagcatgacgatcgccagcgggacgagcttggggcagatgctgtcgaggatgctggcaaggtcgatggtgacgggggtctcctgcgtctccatgtaggtgacctcgctcatgccgttgccaaggtcggtggcgcctgcggtgaccgcattgccgtccgcgtccgtggtggtgagggcgttgccgtccttgtccaccataccggtgagggtggtgtccttgccgtcgtcgctcttcttgatgacctcgaacttcttgacgtcaccagttggaacgaccgcggtcttggccacgtaggactcggtggtgccattgggaatctgcacgttgatctgggtgccgcccatggtgacggtcaggcagccaacgacgaagacgcccaggatggaggctgcgcgcgtgaatgccttcatgtgttccatgaggtagtcgagcgcgttcatgcccatcttgtaggaccagttcatgaggccgaagcgcagtgcgaactggaccgcgttgaagatgatcaggaacaggatggggccaaagatgttacccgagattgccatgttggagcagatgcccgccgtgatgggcacgagcgtcatccagaacagggcgtcaccgatgccgccgagcgggcccatgagcgagacgcggaccgcgcggatggtcgggatgtcgaccttcttctgctccatggacaggatgatgcccatggcgaaggtgacgaggaacgggtggatgttgaagaactccatgttgtgggtcatcgagagggcaaggtcatccttgttggtgtggatcttctcgaggcccgggaggatggagtagagccagcctgccgactgcatgcgctcgtagttgaacgacgcctggaggaagcaggagcgccatgccatctggttgagcgtcttctggtcgaggtcgggtgcgggcgtgaggtcctgatactgggtgacgccctcgaagcgattgaccttctgcgcctcggtctccttagatgccatcctcttcacctccgtcattcatagaagctgcggtagcgccgccaagctcggtgttctgctggtagtcccaataggcgaagccaaagccgatgagggcaaggatgagcaggccgggggtggcgagtgccgagatgttagagacgacgatggcaagggcaaagccgaggaagtagaagccccacatgtccttgttcatcatgaacttgagcaggatcgcgaagccgacgaagcgcatcatgccgcccgcggcggagaggccgttgttgagccactcgggaatcgcgttgacgacggtctggccgacgctctggccaccgatgaagaacagggtgacgacgacgccgaaaatcaggccgagcaggcacatggacaggtagttgatgtgctcgatgcccttggggttggcctcggcggcgtactggtcgcacttgctcatgaggggagacatgagggtgaagatcagggtcacgccgtactggccgagcagggagaacggaattgcagtcgcaactgccacgttggcatccaggtgaagcgtgatggcgaggatcgccgccatgatgccaccgacaaccgcgttgggcggctgggcacctccgataggcatgttgccgatggtcatcagctgatacgtaccaccgacgatgaggccagtctgcacgtcgcccaggatcaggcctatgaccattcccgtgacgaggggttggtacaaggactcaaggaagctgaactggtcgattgccgcgatgaacgtgacgatgaagacgagaacgacttgaagaatcgaatactccatccctgttcctcctttcgaactgcattgcccgtgaatttgcaaagcttgtgccacaccgcgcgccttcccctaacgcgtggtgtaagtaccaaagttggttgttgctgacgcgctactcgaagagcttctccgtcgactcggttggggtcgatgggacgcgcttgatctcgagctccacgccatggtcctgcagggacctgaaggccgcgacatcctcgtcattcaccgcgacggacgtggcgacttgcctcttgccctcggacatgtgcatattgccgatgttgagcttcttgatgggcacgccaccctcgaccagacgaagagcgtcctccggggtctcgacgatgatcatgatgtgctggcggggtgccgccttgtggatgacgtcgatggtcttctggatggatgatatggctgcccaaattcagacacgtttgaagccgagctaacgaaagccctaggatgtgccgaaaggcacggaagggctattgccatgagcaagacgacgagaaggaagtacgaccccaagttcaagatgagggcgccctcgaggttctacaaggggagaagaccttgagtcaggtggcaagcggagaacggcgtaggccgtctgtcgcgccgccagtggaagggacagctcctcgaggagggtgccgccgacgttgttcggcaagaaccagaaggagcgcgagaggagccagggaggaagcgcggaagaaggagcacgatgagatgctgactgaagagatcggccagctcaccgtcgagcgcgacttcctccaaggtttttgcgacagcaaggctacgaccccaggaccggtgccgggcagccgcaggtgagcatgacggcatcacccgcaagcgtgcctcagagcttctgggcgttgcccgcctcaagcacctattacgagcacaaggagaggaagggacatcggaggacgacgaagcgcctcatggccgagatagatgagatccacgtcggtacacctgcctacggggcaagcaagatcgcaaggcagcttgagaaatgacggtgaggacgtcacccgctggcaggaccaggctcatgcacgagatgaacgtgaggcccgctgccctctgccctcgctgtgtctgcgccttccaagcactccagagtttccctactgctccacggcaaggtcgctccgcttcccccaaccaggttgggtcgaccgacatcacatatgtgcagctgggaggacaccatatgtttactaacgccgtgatcgactgggcgcgccgcactcggggatggagggctcttgacaccatgagggccagaggagggtcgtcaagtgcgcgagcaggccttcaaggcaacatggcacacgccctcgctaatgaactccgacagggctctgtttcgggttcgatgctacgtgaggctcctagcggacagcacgtcgcccaggagaatggacggggcgtgcacgatggagagggacaacggggtcagggagaaaggttgttccgcacactcaagagagagcatctaaggacgaacgagtaactcgtactgcccgagcttaagagtctcatcgccgacttcgttgactactacaaacaaccgccccgcatgccaccggcgcttggctacgacacctcccagccgactggtaataccacaggaatcaacaaagagggcagcctagatgagaaggactacgatgggacaccatcaggcatggctttcgctagccaacgctcgtcgtgtccgaggattcagccagttcagagaagtaatggtgcgactccctgaggcgccgacccccactagttcatcaggttttgagcatcatgattattagcgaaactaccgtagttggcatttacgagatggcccagcaaagctctatcccaccaacttccctggcgtcttgccagtcacacatcccgccaccgcccccttgcgcagccttcacgacatcgcccgtggatgagggcggtgtctacttctcaccaacacgatgtcggcctctgccatgaggctcaccatcccttctcccaaccgtcggttgggcagctcgttacgttgacggatctcatggattgcgtagcgggaaacctcgatcacggcaccagacttggaccttgtgtagcacgtctcggtccccagggtgcgaaacgatctatccgtacagccccccgcccaaatgcgacattcttgtcccttattgagggtctcggtgacggtatcgtagtactgcttctgcttcttggccttggacgagcggacggcaaagtagatgaccccgacgccggttcaggaggacgagaaggacattgaagaggcaaggatcgggagtgagggatgacaatcagacattccacctcctcttcgccgtccgtcagcgccaaggtcctccgtcgggagctgggcgtgcgcgacgcacgttctgcaagaatcgactgcgagcaccgacagattgtcagggcgtggaggactcgttccttggaatgacgcctcgacaggcatggggagttggttacgctaaccacagggagagaagccctttttcgggccgcatctggcatcatgatattggttgtaaaggcgtcccccccatgaggtaattagtttcatgtgaacaccccaacgacatagcccttgtgcaagaaggcatcgaatgcggcggccaagctttccgggaaagtcggctgcctcgtcctcgtggaagggaacccgcaacaagggcgtcctgtgggcccaatcatctcgaggctccgaagcattccctcggcaaaggtccccgtgccggtgatgaatgcaacctaccatgtgccgatcctctatactggctctcctttcgtggctccgatggtagccggagcccgtggcccaaaaggcactgggaaccacttgagtgccctcttgaaaatcccctgacacaaaaacgaacccaaaaagagcatgcgtttcgaatcggtcccgacgtttgccccggtggtctcaactggtacaaccacagaccagttattcacggggttgcatgatgtcacaaaagcgacaggtggttccgtgactgtttttgtcttaggtacgtcgcgccagttggatccattccaccagtcaaacatccgatgtagcatagcgaacggtctcaaatttacctctattggattgcaaatcgctggtggccccaacgtctttactatgagcttaggtattggcttcctcacttgtgacgagtcttgcttttcgttgggaattttggaattgtattagtgacataaccaggtaggccttattttgactgggaggacgcccttgtccgtccaacccgggtcaggcgtaagagcaatcgaggcattggaggactgtgatatgcaccgtcacgctcaagcccttatattgacaaggcctaccggatcgcggcgacgggagtgggaccgcatgcgttcctcgacgcacaggaccgcgtgcggcaagggacaagacgcacgtgctaagtcgcgc

SEQ ID NO: 420 - DNA, 9752 bp, Unknown
  Metagenome-assembled genome
ccgcaaatgcgcccaatcgccaacacctagtagtcggcttaacaaaaggtgaggagacctcttttcgcgacctcctcaccgtttggctaacttaaacatccgccgtttgtttgagtgtcccctacgcctccacgggcctaccacagagtgaccccaagcgtcggccatgtaggcgttcgagcttccgacacctcgcggcggcgttggaccccacctcgccgagccttggcgtacgcccctctcttcagtcttcaagcatcgacgtgcgcactgtcctccgcgcgggtgggtgaggcggttctcgcaccggcccgattacccgaaacatcgtcgtgcatgtcgatgccctgcctgttacgtttgcgtagaccatgcggcgagtcgtgtagtggcagtccgtctgctgggcctcccctcacgagctcgcggcctctccctcgccctgcgtgaggtcgataagggagaggacgctgcatccgtctccgactcacgtcacggggcggggcacgaggcctcatcctcttccttccaacttcgtccatctcctctaccaggcagatttcggacgccaatggcggccattcaatgcgctgcccagaaaaggcgatggactagtagggcaggcagcgggctgcggctttcgtccccccccttttgacgtgagtccggagacgatgcagttcctctccccctcatcgacctcacgcgggcgaggccgcggcagctcgtgagggaggccagcagaaggaccaactacacctcggcccgcatggtcacgcaaacgctaaccgcatgcatcgacatgcacgacgaattctgggcggtctacatgggcggtgcgagaacgccctcaccaccctctgcggagacgttcgccacgcgatgctttatgacagaagcggggctacgccagtgctttcggcgaggtgtgtccaacgccgccctgcgaggtgtcggaagcctccgaacgccctacatgtcggcagcgcgggggtcacctcgatggtcggcccgtggaggcgtaggagacctcaacaacggcgatgttatagttagccaaatcggtgatgagctcgcgaaaagccggtctcctccccttttttaacgcactactcagtttggcggcaatttggcggcgcctttgcggcacaagagaacggccgagacatagccctgacctgcgaatgtgttgtgggcgtagaatgatttgaacttctgacctcgttcctgtgcatgcgaacctctcccctgactaaacgcccgaacgcggaacgttgggggacggcccgtccttcgggagaatataccgcgcgcgacgtcccaagcagggagacggaccgcctccacttcgccgcctccacatgccgagcttatgcgcaatcgacgcctgggtacttgcacgggaagcaaccatcgcgaggcttccgacgcagtgccacttggcgccggtgggagggtctcggtacagttcgcacgcattcctctccctggcagattccaacactgtgccaaacgtgggcggtacgatggtccatccaagcaacgccaggctcgcttgcggaggctcgcacgactgggaaaggtgacgattcccagggggtcgtttttcgtgttgaagaggtcgactcttctctggtggctggagcagcgcaaggagcttgccgagggtgaacagagcgcttgctgcccgcactctcccacgcccgcgctgattctggtgaccatgatctgacatcaacggtgggctctcctggtggatggtcggatgatcagtcgcgcgttctggggccgttccagggcgtcgcgtgcatcctcattttggtacggcggggggcgggaccgccgcgcgcgagacgcggcgccgctcgttccggacgtctgcgtccccgccacatctgcatgtgacagcgcatcaaagtcgtaggtgtcgtgcccctccacccagctgtcggacgggacccggcggtggtggcgtggctggactgcgacagtccgagaaggcctcgtcacaggctgacctgcgcgaattcagctgctgcgtcgttatgcgaggagagcgtcgcaactcgtgccgtttcggctaaggcgggggcggcggtcccgaactgtggggtgctgatgaaaaatcactcttgcaatcggagggcttcaactgcttagaaaccgaccttccggcgcgctggagcctctcgactggccaagggtctatgttttctcgtagattccgattccaaattgccaaaggttcaagttttctacgggggaagcccaaccgctggatccctccccctctgaagggggctcgtactctcgtcacacccctgcttcaaccgtgatcccgctacaaggccagcttcggagtaggggcatcctccggctttggctcggggcgacgggttcttgtgtgaacctccccagagcctcctgccttcctcatatagacagtcgtggcgggaagggctgccgcgaacccctcgcgcccacttcgcactgctgccccgtagacaagccacttccacgatcatcgcgctgttttcgctccatctcggctatcttctcgtcgaccttcgcgtcgctgctcgcggaagagctccaccgctcgccgtatgtgctcgaccctccttgcaccattccatgaatcgctctgattcgcggatctcgagccccgaccgctgacacgcgatcaccggcgggccctcaatctgttcgtctccaaatcgcgggtgcccgacggccgaaaaaagtcgagggatagtccctcttgtcgtagtacgaagggtcgaacacctggagccgaactccggacacctggcccccattgtgtacttcattgcacctcaaattcgtatctagactagctagttgaattctacaactagggggacgtccaggacgaaagaccgcatgcgcggacgtcacctatcacaacccctgccgcgtccactttgttcccaacgcgctcggacgagctccccttcgagctcgcggattttggcccaaggtccttctaccgagggcggcgcgcatgaagaggacgggtctactaccaaggtcatctgccgcgcttgaggccgccggcaagaacctgttcgaggtccccggcgtcatgtccaaccccacccgcgacaagcttcgcgaggttccaaatgtcgcacgcgagaacgacgtggacctgtcctggcggtggggccggcggatccaccatcgactacgccaggcgtctcggtgccgcgtgaacagggcggaccccgggagcaccggaccttcccttggaggagccgaccgcaaggtcatccccgggggtgacgtgctaccatagcgcaccgctcggagatgaacgcctgcctcctgatcaccaaccacgaggagtcctcaagatcggccacgtgttgccgccaccgtgatctccgcgcttcgccatcgtgaaccccgagctcaccggaaacgtgcccgaaccagatgcgcgcctgcatctacgacgccttcaacacatctgcgagtcagtacttcttctccgggaccgacgacaacaccagcgcgacattcgccgatggcctgcgcatcctggtgcacccagccgctcgcctaaatggggacccgcacaactacagctcgctccaacatattggttttgcaccttcggcgctccaccacgcgcatcgcggggggcaagtcgaccgcctgggtgtccacattctgggccaggccatcctgcgcggtgccaacgcccacgcacgcatgacccctccgccgtgagcctgccttactatcgcctgggcatgcctctatggtgagaagttcgctcgctttgcaccgggtggtgtgacgtgacgactccgagtacctagcgcgaggtcgggaggctgggtgatggccatgaccctggattgaccagatgggggggtgaaagcgcccgcgagcgggggcttaccgaggagaacatccccgacgcccgtagcgaaccttcatgcctggcggcggctaccacaagctcacgaccgaggagtcgagcagatcttccgcagagctggtagcgcgcggtatcgggggcacgagccgggcgttaacggtagggcatcccctcgtcccggccctcctctttttcgggcgatgaggctaaacgcatactcagcttcgctgcagaaattcgcccgtagtcaatcgtgggtcccgtaagggtgagcgctgcagtctgcgcgaccaccccgtgcttagggaaagtcggtggtggcaatggcaggggcattcagctgagaaacggcgactgtggtcgcgcgagggagcaccgatggtgccctcgcgacgccgatgccgtggtcctcggcagaatccgcctcagattgccacacactcgcatttcctcacaggtaatgggtgcacgtgccttctcgaggccttccgggatccgcgcacgcggcaaaagaaaacaggccagagaacatagcctctgacctgcgaatgtgtggtgggcgttagaagatttgaacttctgacctcttccgtgtcagggaagcgctctccccctgagctaaacgcccgaatacgcggaaccgttgggggacggcccgtcatgcgagggagaagtatacgcgcgcgacgtcccaagggcaagggagacggacgcctccaccttcgcgcctccacatgctccgagcttaggcgcatcgaccccatgggggtactttcacgggagcaaccatcgcgaggcttccgacgaagtgccactggcggccggtgggatgggtctcgggacagttcgcacgcatgtctctcccctggcagattccaacactggtgccaaacggtggcggtagcgaatgggtaccatccacgcaacgcagggctcgcttgcgggaggctcgcgagcgactgggaacgtttgacgattgcaagggggtcgttgggatggcggagaaggtcgactattcgctggtggcggagcagctcaaggagcttgccgagggtgacgagcgctggcttcccgccctctccaacgccgcggcgctgatctgggaccaggtatcggacatcaactgggtgggcttctacctggtggatgggtcggatgatcagtcgctcgttctggggccgttccaggggcgggtcgcgtgcacgtccatcccatttgggagcggcgtgtgcgggaccgccgcgcgcgaggactcggcgcagctcgttccggacgtccatgcgttccccggccacatcgcatgtgacagcgcatcaaagtcggaggtggtcgtgcccctccaccgccagctgtcggacgggagccggcgggtggtgggcgtgctggactgcgacagtcccgagaagggccgcttcaccgagcgtgacctgcgcggattcaggctgctggcgtcggtgatcgaggagagcgtcgcactcgtgccgttcggctagagggcgggggcggcggtcccgacaggtggggtgctgaggaaactcgactattggcaatcggagggcttcaactgcttagaaaacgcgaccttcggcagcgctggagcctctccgactgccaaaggtcgatgtttctcagtagattccgattccaaattgccaaaggtcaagttttctaagcagcccaaccgctggagtgccctcaccctctgaagggggctcggacgctcgtcacaccccaggcttcaccgtgaggccgctacaaggcacagctcggagtaggggcatcctccggctttggcatcgacgggttcttgtgtgcagcctcccagagccgcctgccgtccgcagagagacagtcgggaaggtctgccgcgaacccctcgctcccccactcgcacgcctgcccgtagtaccagcacttccagtcgatcatcgcgcgggtgcgctccagctcggcgatcttctcgtcgaccttgcgtcgctgctcgcggaagagctccagccgctcgccgtaggtgctcggaccctcctggcaccagtccatgaagcgcttgatgtcgcggatctcgagccccgaccgcttgaggcactcgatcacgcgcagggcctcaatctggtcgtctccaaagcggcgggtgcccgacgtgcgctccagtccggggaggagtcccatcttgtcgtagtagcggatggtcgacaccggtaggccgaacatccgggacacctggccaattgtgtacgtcatgtgcacctcaaattcgtatctagacctaaagctaggttgagattctacaactaaggggaacggtccagcgacgaaaggaaacgccatgctcggagacttcacctatcacaacccctgccgcgtccactttgggcccaacgcgctcgacgagctccccggcgagctcgcggagtttggccccaaggtccttctgacctatggcggcggctcaattaagcggaacggtgtctacgacaaggtcatcgccgcgcttgaggccgccggcaagaccgtgttcgaggtccccggcgtcatgtccaaccccaccgcggacaagctgcgcgagggcgcaaaggtcgcacgcgagaacgacgtggacctgatcctggcggtgggcggcggatccaccatcgactacgccaagggcgtctcggtgtccgcgtggaccgagggcgacccctgggagcacctgtacctgcacatggaggagccgaccggcaaggtcatccccgtgggtgacgtgctgaccatgagcggcaccggctcggagatgaacgccggctccgtgatcaccaaccacgaggagggcctcaagatcggccacgtgttcggccccgacgtgatcccgcgcttcgccatcgtgaaccccgagctcaccttcaccgtgcccgactaccagatgcgcgccggcatctacgacgccttcaaccacatctgcgagcagtacttctccgggaccgacgacaacaccagcgactacatcgccgagggtctcatgcgcagcctggtgcacgccagccgcatcgccgtaaaggaccccacaaactacgaggcgcgctccaacatcagttgggtttgcacctgggcgctcaacacgctcatcgcgtgtggcaagtcgaccgactgggaggtccacatgctgggccaggccatcggcgcggtgaccaacgccacgcacggcatgaccctctccgccgtgagcctgccttactatcgcctggtcatgccctatggggtggagaagttcgcgcgctttgcccgtgtggtgtgggacgtggacgactccggaaagtccgagcgcgaggtcgcggaggctggccttgaggccatgagcgcctggatggaccagattggcgtggtgaagagcgcccgcgagctggggctgaccgaggagaacatccccgacgccgtgaaggcgaccttcatcctgggcggcggctaccacaagctcacgaccgaggaggtcgagcagatcttccgcgagagcttgtagggcgcgcggtattcgggtggcacgagcagggccgggacggtaggggcatcccctcgtcccggcccgcctctttttcgggcgatgatgcgaaacgccatactcaagcttcgctgccaggaaatatcgacctgtggcaatcggtgggtcccgtaagggtggagcgctgccgtctgcgagaccacccctgctgaggaaagtcgagtggtggcaattggcaggggcattccgctgagaaaatgcgagctgtggcagcgagggagccccgatgtgccctcggcgaccgccgatgcccggttttcctcggcagaatccggcctcagattgccacaactcgcatttcctcagcaggtaaggggtgcacggtgccttctcgaggcttccgggatcgcgcgcacgagcgtggtgtaagaaggcacatcacctgctgccgacgctgccagaatcctactccttcttgaggccgcagctctcggctatctccgagactatctgtgcggccctcctctcgagtgcctccctcctcacctcgagggggcctccctgggtccggggtccctgaagccgagggcggcggactcttcgctgaagacgcgctgggtggcgtggcctccatactctaggaggaggggcgctgggccacccagcgcgtcttcagcgagagtcccgccgccctcggctcagggaccccggaccaggaggccccctcgagggggaggagggagcactcgagagagagaggcgcgcaccgagtagtctcggagatagccggagagctgcgtgcggctcaagaaggagtaggattctggcagcgtcggcaggcaggtgattgtgccttcttacaccacgctcgtgcgcgcgatcccggaagctcgagaaggcaccgtgccaccccttactgcctgaggaaatgcgagttgtggcaatcatgaggcggattctgccgaggagaaaacgggcatcggcggtcgccggagggcacatcggggctccctcgctgccacagctcgcattttctcagcggaaatgcccctgccaattgccacccactcggactttcctcagcaggggtggtctcgcagacggcagcgctccacccttacggggacccaccgattgccacaggtcgatattcctggcagcgaagcttgagtatgcgtttcgcatcatcgcccgaaaagaggcgggcgggacgaggggatgcccctaccgtcccggccctgctcgtgccacccgaataccgcgcgccactacaagctctcgggaagatctgctcgacctcctcggtcgtgagcttgtggtagcgccccgcccaggatgaaggtcgccttcacggcgtcggggatgttctcctcggtcagcccagctcgcgggcgctctcaccacgccaatctggtccatccaggcgtcatggcctcaggccagcctccgcgacctcgcgtcggactttccggagtcgtccaagtcccacaccacacgggcaaagcgcgcgaactctccaccccatagggccatgaccaggcgatagtaaggcaggctcacggcggagagggtcatgcgtgcgtgcgttggtcaccgccgccgatggcctggcccagcagtggacctccagtcggtcgacttgccacacgcgatgagcgtgttgagcgcccaggtgcaaacccaatgagttggagcgcgcctcgtatgtagtttgtggggtctttacggcgatgcggtggcgtgccaccaggctgcgccatgagaccctcggcgatttagtcgctggtgttgtcgtcggtcccggagaatactgctcgaagatgtggttgaaggcgtctagatgccggcgcgcatctgtgtgcgggcacggtgaaggtgagctcggggttcacgatggacgaagccgggatcacgtcggggccgaaacacgtggccggatttgaggccctcctcgtggttggtgatcacggagccggcgttcatctccgagccggtgccgctcatggtcagcacgtcacccacggggatgaccttgccggtcggctcctccatgtgcaggtacaggtgctcccaggggtcgccctcgtgccacgcggacaccgagacgcccttggcggtcgatggtggagccgcccgcccaccgccaggatcaggtccacgtcgttctcgcgtgcgacctttgcgccctcgcgcagcttgtccgcggtgggttggacatgacgccggggacctcgaacacggtcttgcggcggcgcctcagcgcggcgatgccttgtcgttagacacgttccgcttaattgagccgccgccataggtcagaggaccttgggccaaaactccgcgagctcgccggggagctcgtcgagcgcg

SEQ ID NO: 421 - DNA, 42645 bp, Unknown
  Metagenome-assembled genome
aatgatgccctaacatttagaccttaaaaaactcgtcagcaagcaagacactgctaaataaaaaaaagccatatcccccaccgaaccaaaggttggatacaagctaaacggatagaaaacactattactagtggttgtcgtttgtactctattttagcacagggacgaagctaaaaaggagaaatataatatggcaagggatgaataaacccccccccccaaccatggcaagaaacgcgtgttgtttgtatctgtcacggaagggaacggttaagaaaagaacgttagcgaacgttcgcaaccaaggaagagaaagaagcatcaaaaatgggccaccaagatggaagctgaacgacaatgatggtgttagcattgttggctctaacatggcatttgcggactactacaagcaatgatgaaaagttacaagcatgaacgatgtgaaaagcaagcggctcatttacaatcaagaagcagctaccagccagtgtatatttggcgtataacgaggcacaattaacgccagtactatacaagcctaagatggacgattacggtgaaggatcaagcttaaaagcactgtaaaatgacctgctagttaatattaaagcctcactacgagatggcctgtatgagatatattacgcgcgacatatacgcacgagttttaaaccccacggtgggctgaacgggttaatgaaaaacaaacgtcttgtctgcaacccaatttgaggacgttgcagagaacctattgaatgctcacacgacgatttacagcgacttagcatacttgttatgatagagacggaatacgcgtatgagagggttgtttagggctgaaaacagcgatgtttaattcgggtgatttgttggtaattacaaaaacggactcatctactgttcaaacaaattacgactccctaaaaactgcgagcgtgttcgcaatataaaaatcactcatgagttaagcgaaatgatcacagcacgaactgacagaaaagaacgccactcgaaattcgaaactcccaccatgcaaaattcttatcgcttgaacaactcactaacacaactgggcatcactccaattactatccatggattacgtcatttcacacgctcgtatctgctctaagggtgtttgtgtcgatcaattatgtatcagctcgattgggcatacaacaccacaatacacaatggttatacgctcaacatgctagaggaagaacgggtcaatgaggcagacaaaacggtggaaatactgtccaagtccccaattgtccccaagaccaagatgacccattgatacatcaatgttttagaccccctctgtaaagattatgtaaatatctggacataaatttaattttatgccattaataatgggtagactagttttaatgttttgtttatttgattagaaattcggctcattattggaggagtcactttgattaagcatttattattaatgacgaaacagttaccactattcattccgatcaatgcctattgcaacgaacaaaattggttcgttcacaacacaaccagttctgccgaagcgttaacgattctaaaaacgcaaactgtggcggctgtgctatgggatacgacatcggtcgactttaatgagacactcacggcgatctcacatatgcgtgaaaaagtgatgatccccattattatgcttgctaaagagcgcaacccagaacagatgcaacaactattccaccaccatgtcgatgactacctcgttgaaccctttgattacccagagatcattgcaattctcaaacaacgattttggttatatgatcagatcactgatgctaatactgagtcaacggacactgctcaccaaacggttgaaccgtcagcccccaagcaactcaccttcaataacctcaccattgatcttcagcactatcgggtattgcgagatgatcaggatctaggactcaccccgaaagaattcaagctactccactacctaatccaacatcctaatcaagttcttagtcgggaacaactattacagggcgtctgggattacgatatcttaggtaactcacgaatggtcgatattcacatcagtcatttacgcgataaaattgagccagatcctcaaaatccaatctggcttcaaaccgtccgtggcttcggttacgttcttaaaaactaaaaaatcgatttaccatgatcggtaaatcgattttttgtttgtctaagcgccccaaacctcttcagcaacgtctttaaccaattggatcttggcccattgctgatcttcagtgagaatattcccctcttcagtcgaggcaaatccacattgtgtactcaaacatagtcgatccaacggaacatacttagctgcttcatggattcgatcaatgacagtttgcttatcttctagttcaccagatttagaagtaatcagtcctagcaccacaagttgatcatcttgaatctgagcaagcggttcaaaaccacctgaacgatcattgtcatattcaagaaagaatgcatgcactttttcccgagtgaatagaggttccgcaacactttcgtaaccaccagctgaggcccatgttgaatgataatttccacggcaatcatgcgtattcacaatcaggtcctctggtaatccctcaataaaggcattatttacgtttacatatagttccttgttcttgtcaatttcggcttggtcaattttatttgttccatccttggcaccagcatggaatccagctaacatcccccaagtacaatcatccagttgtaatactcgcaagccggcatcgtaaagatcaagtgccacctgttgataaactttggcaatgtccgcaatcaaatcggcttctgatgaatagtacttgttggtagcttcaatattttcaggacggtataattcggcaatgaactgtgcgggggctggaatcgtttgtttagccgtctttggatcagctaaatgagctcgtaagaatttaaaatggtcaacgaatggatgattggtccccgtaatcttaccactcaagcgtgccgtttcagctcgggtttcttcatcattaaagatgtagccctggtccagtgccgtcttctccacaccatttaagccccagaaaaagtctaagtgccaccagctgcgacgaaattcaccatcagtaattgattgtagtcctgcagcttcttccttcttgattaattcaataattgattgatcctcgacctgctttaagtcggctgctgcaatgtttccagcggcatactgcttacgagcggcctttaatgctgcaggacgcaagaagcttcccacgacatcaaaacgaaaaggtgaagttgtacggtttgttaaagtttgttctgtcattattaaattcctccaaatagtaaaaacttaagtaagtcgtctgtttaatcaactaatcgaacgaaccgtacatgacttgatcaccaatgccgtctcctaatagaaaacaggcggtcgtcgtcttattggaatgtaagtagtaaatgatttgtaaccgcatgttttcacttcccttcaagttaatctttagtatttaagcgtcccaaatttcgtcagcaatcgactttaccagatcaattttggcccattgttgttcctcagtcaaaacattgccttcttcagttgaggcaaatccacattgtgtcgataaagctaggttagccaacggaacatattgcgtcgcttcatgaatccggttgatcactgcttgccgatcttccaactgaccatccttcgatgtaatgagtcccagcacaatctttttgtcagtccgtccattaaaaattgtctttaatggttcaaaatcgccatcacggtcactatcatattcaaggaagaacccatcgtaatccagttgtcctaaatattgggcaacggcttcatacccacccgaaaagaggaaggtcgacttaaagttaccacggcaaatatgcgttgttacggttaaatcttctggtaagccagccaataattcgttaatcacccgcgttgattcttcagccaacgtaacgtatttagcgtgttctgctggttgatccttggtttcatttaacttactaattaaaaaggcccaagttgtatcatcaatctgaatgtagcgtgcgcctaactcgtagaagtgcagaatcgtttgttggtaggcatctgccaatgcatgaaggtattcatcacgggtatcataaaactgtggccaattatctgatcgattgtctcggaaaagcattgatggagatggaattgtttgtttagcaacggttcctgctgggacgattgaatttaaatattcaaaggccgcgaaaaacggatgattgggattgtaactcactttaccggttaattcggcgttatccgttcgtgtcttagcgcccttaaacttatagctggccttgtaatcatacttggccacgccattaagaccccagagaaaatctaaatgccaccagctacgactaaattcaccatcagtcaaccccttcaggccatgctgtgcttcagtggcgaccagtttttgaatttctgtttgttgaatcgctttgaagtcatcatccgtcaagtcaccagcacggtgcttagctaaagcatccttcaatgcaggtgtccgtaaaaaactaccaacaatgtcgtaacgatatgggccaattttagtttgtgttgtcataatttttgatctccttgttatttaaaaaagtataaaaaaaatccctacttctgcattatgcaaaagtaaggacgatctctcgtgttaccaccttaatttagaatgtattcacatacactccctcgctgagtacaaccatactcgcacgcggtaatgggcgtccccatgaatgcctcgcatacgctcaacattcctcacttcaagaccatattcacaatcaccaaccttaccccttttcaccaaccagaggctctctaaaaaggtgttaactgctactcatcttttcatcgttttttaatatttatgttgttattatcataaaacgctcataattaaatgtcaattacttttttactgatcttctttttatcataccgtcatgtcttaactaattacattttatatcaaaaaactttcaacttaaattttaagtcgaaagttttttaggtcaattatgattttataaatgtttctgtaatattttaggaaattgaatttttagggagtgatgcataaaattacatatcatttaaaaaattccctaaattgacctggcgtcaccttttctctttttttaaacgctgaaataaaatagctattagtgttaaatccaactaatttgccaatttgttcaacagtttgttcaggattaataactaacaattctttagccttccgaatccgaaaatcattcagtaaagcacgcggtgatctatgaaaatattgctgaaaaatttgcagaatatactgtaaactatagtgactaagtcgcacaaaatcttcatttctaacttcattcatgtagttgcttttaatatattccataattgggttaacaatattattcatctgtcgagcattgacattgtcatttatataatttttcttaattaaaattaaaaattgatatactaaaaccgaggactcatacatatcaagttgatttttttgaatttgccagtaacactcattaacaaatcgacttaactgctcatcaggctccttaatattaatatattcagtaatactcaacgttgacagcatttcggaaattaactctccaccaaatgtaaagtaggctgttgtccacttgccatttacagaatgataagcatggcgaatatctttgtttattaaaattccttgaccaggtaacaacctgatagtctgtccattgactatgacttctccctcaccattaattgtctgtaaccagtgcacataagggtatcctttttttctattaatatcctcttgctcccagttattgctcacactatcaatgtacaaagggagtgaataatcagtgattccaaagctatatcgcacaacctatcatccttcacaaactgaattacagttattttttattagtatatttttgaagtagtgtcgcatattctgaatagtaatcacaattttcgaatttaaagctttgtaacttgtcagttaactcctcgaaagtcattttcctcaacaacggtttcaatatactttcttgctgataacggtataaaatcccacgaattctaaattgtgattcatattcaagtacttcatcatgaaaatcgaactcattggaaatgtttttaacaatttgactggcctggctcatttcaccataatgtgtccatttttgatgaatctcatctactaatttcatccacgttgagtcagtcttaggatgtgtaattcccataaaacaggcatctttgtatgcccaaaggcaccatgaaataccatgattttcaaataaatcaacagtatcatcaagtaaatccatactaaattgtacatcatctgcatcaatatcataaccagcttcaccacaaattagcggatgatggagatgtgacattgtcgacaaaacgtcaaccaacccattatcaaattctttttttcgttctgatcgagataaatttcgatctaataaattcgacttccaaacggtcggatagtaatgaaaactaataataagcttactatcttcaatatcagtcaagtttgaaaaatccatcgcaaaatgatcactttccaaaataactgcatgattccgatcatgttgtcggatctccctgacagtatcaccaaaaaattcattcaagtatgtccaatttgccattgctggttcatttaacaaatcatatcccaaaagataactatatttagctccaaaccgctttgcaatttcaccccatactttaaccaattgatctcttaattgcttaaactcccaaaactgtggtacacctgttcgattatcactatgccagtctggattttggcctcctggagcagtatgcatatctaacatacaaaaaatatgatgtttttcacataaattcagtaatttagttactttttcaaacccaaactctttaaattccatcgtgttatcatccaaaaaaagacggtaattaattggtactcgtacaaaattaatgccctgctcatttaggaaatcaaaatcatccgcacttataaaatcatcaatataggtgtttaaaaatgcctcccccttaccttctccatagatgtcatccatactactcaaaatcatactctgcggaccaggtagtcccaccataaagtgttcaatattcatccaggttccgattccaagtccgcgcaacaccagtggacgatctgcaaaatacatcttatcttcttttacttccacaaaattcatgtaatcttcctccactatttagtttccgatgccgaaagtggctttataacaaacagcatgcacgccccagcaataatcaaaagcaccccaaagaatttaaacgtaaaagctaaatcactacttgaatgaaatttaccaattacgccgagtactaatggtgtcataaacgtcccaacattacatccaacaatcatcaaagaagtggcaagatttaacgaattcttaggtgcaatttcaggccccagattaaacgcatatgcaaccacaattcctgaaatagtacttgttaaaatcattcccgttccaataatcactgcattggatgacataccaatcattaactggcttacaccagtaagggcaacagtaattggtaaaaacgttgctcttaacattctcaaaaaccatccaaacaaaataccagttaaaataccaccaaattgcgcaatacttaaaacaattgccacttttcctagactaatgtagccatttgttgtaactagttcggtaattcgcgtatatgaggcaataatcggtatcaagtataaaatacagaatattgtccaaaaaataacttttccattcactgactgatgttcttttttctttgcatttcctgctaaaatttcactttccgcttttgcagaaggctctggaacataaatcgcaaataggatcgttagcgcgaaagctaatgcatatacccaaaacgcggcatgccagttaaatgcaactagcaattctccggcaataaaagtcgtaactgaacttcccaatttttcacaagaactacgaaagcccatcatgtttgatttctcttgacctgagaaaaacattccaatcatactaacagcataagaattgactaatccaaatccaacccccaacatcaaacgtgatgcaaaaaatgctgcgtaattcgtaactaatgctggtgttattccagcgaaaccagcaatcaacaatcccacaattacggttctcttcacaccaatcattttagcaatccatgtactcaataatgttgcgaaaactactgatattgacggcaaagtttgcaataattctacatttgagcgagcaacgcctggaaaggcgtttaaccagcttggaatagtggccgcaattgccgttcccgaagtcaaaataattgatattgatagtaatgatgctttcatcatgttcgaataattaccatgttctactagttcagaatctgatttatctgcattacttgcagttttttccatttttttcacctcataatttatttgaaactagttcaaaatcacaacatcaaatggtgctaacgtaattcttgtaccaaatttttttccacttaataaatcataggtaccatatttatgattattaattgtttgtgtttcatcacttgtattgatcaaaaaaacataatttttggtcttgaaacttcgtactgtaatctcaactgacctattaaattcatttttgtagtttggtatcatcttagcaaaaaggtaactaattcctttttcgtccaatcccgcaccgcaataatacgattcaccttgaccataccgatgtctcgtaattgccgcgtagtcactatagaacacatcatctgaatacgttgccaaggtctctgcatcttctggaatcactaagtcacatacacccgttgccgtgccgattaattggcctttttttgaaataatatcaattggttgatcatcacgtcgggcatctcgctcatcgactgaaacacccattaattctttaataggccccaaatagccaccttcaaaaatattatctgtttcgttggcaattcctgacatatatgttgttaaaaatttgccaccatttttaacaaattgtttgatattactggcaaagtcattgctcaacatatacagtgttggtgcaatcacaacatggtaattatcaaaatcatcatgtttcgaaaccacatctaccgtcacatcatgttgatacaaacttttataaaatcgcagaacttcattcatataactcaaatttgcaatcgggccaatagaattttctagtccccagaaactatcccaatcaaaaacaatggcaattgaagtttgaatattcgtctctaaaaatgaatttggtaattttctcagttccgctcccaatttggcaacctcgcgaaaagttcttgtattttcactattactatgcgaaaggactgcgccatgaaatttttcagctccacttctagattgttttaattgaaaatattcaatgctatttgcaccatgtgcgatagcctgatagctcagcattctcatttcaccaggcttttttaaaacgttgtacggataccaattttgttgattaggcgtttgctccatcaacagaaacggtttcttctttaagcctctcatgacatcatgttgaaacgcattctgatccgcggtatcatccggcattggataactatcccaagaaatcacatccaaatatggtgcccattcaaaatagtcaatatccttttgcggttgaataaaattggtggttaccggatgaatctgatcaaattgcttaataatatctcgttcaagcctataattagacaacaaactttctgattgaaatcgtcgataatcaatggcagcaccactaataacagacttttgatttggaaataaatccgttgtcatcattggtggctcaatctcatcccaatcataataggtgtggctccaaaaattagtattccattcacgattaacattttttagtgtcccatactttcttttaagccattttctaaacgcttttgcacaattatcacaataacagtatccttcatactcattagatacatgccaacagatcaaattcgaacaatctgaataacgtgttgctaactccgtaaccaacccctgtgtcaattttttaaaatttgaactgtttggacacgcattgtgccgtttaccttgaatttgatgcttaccataaatatctgttcgagatacatccggatatttatgactaatccatgcaggaatagccgccgttgatgttgccaaaatcatcttaatatcatttttattaagtaaatcaacaattttatccaacattttaaaatcatatttatcttctcttggttctaacaaagaccatgaaaaaacattgatagtggcgacattaactgatgctcgttttaatttatcaatatcattttgccaactactttctggccattgttcaggattataatcaccaccaaaaagaactgaatcattttttaaatctgccaaattcaaaccacctcaaaacctatctctctttttagaaagcgctttcgttaatgataatagcatatgggttcttcggtgtaattaaacagagttctgataaaataccacattttgaaactatgtatataaactatacttactttctgatgtcccacatccatgagatttctacatacaaacatatttatattgtctttcagtgataattgatacaaaaaaataacgggatgaaattcataaacttagaatttcactccgttatcttcaaatttaaagccctttttcactccaaatatcatcacgcaaatgatccatcttttgatccaaatgggccacataggtcgcagtgtgcgagagatcctcgcgaatcatctgcttattgggaatatcttttttatagtttaattcgtgttcgacggatgcccaaaaattcattgcaatcgttcgaatttgaatttcaacagcaatattttcggttccattcgtcaaataaattggcacagtcacaatcagatgtaaactacgatacccgttttctttgggatgcttaatatagtcttttttagtgacaaccttaatatccggctgctcaagcaacatgtcttccagcgtatacacgtcactaataaaccgcgtaatcactcggactccggcaatatcatgcagttggttaaaaattgtatcacgcgtttttggtaagtgttttcgatcaaccttttccaaaatactatccggtgttttgatccgatgctgcatgctatccactaaatcatagtcgttttgtagtttaaactcgcgacttaaaaaattaagcttatcaattacaaaatccatcgctgttcggtaacgaatcataaaactttcagctaacttcatcgaatccgcaatcgtccgatgatccacgatatcgtcatagaatgctcgattatccatcattattttattgtaccccatttttagtcgcccattatttttaactcataacccgtatatcggtattataacgttatttcaccgaaatttgtatggaattactcagacaaattttggtgcagtcattattgatccggaccattttctattagtgctgatctccacaattagggcgtaacccgtgacacagaaacgtcgtcacttgctgcacaacttgttgttgattcagattgggctgatccgtcatgattcgcggtaatatagcccctagccataccgacaaaattagccgtaaaatatcataaccagcccagtttaccaactcgccgcttacttggtaacgcgtaaataattcatttatcgtactattttgaaataattgttgccgtttttccgctaattgtgctcgaatcaatgactgattaagcgcctcctgatacaacactcgtaactgcaatcggttttgatcgacaaatgccaatctttcttgaaaaacggtggtcaacacttccgtaaaactcatagccgttttggcctgaaattccgctaagagcgcgtcaaacgattcaggcaccacatggtcgatcattggtgtcacaatcgcagctaacagcgacgctttatcgggaactatgttttcagaaacgcctgccatgcgtgcaatatcatgggcggttgttttttcgaagcccttagcagaaaagagcgtcaagcttgctcgcaagacgcccttttggggttcagataagtgtaattgattcagggtttcagcaaaaatggtttcaatcattcgatgattcatccgtcatcactccctttcaatcaatactactttaaaattccttgacgatccttctttagaggtaatagatagatcaaaattaaggccaccacaccgataatgccgatcacccacgcagaactcatcgtcgtcgacgacccattcgtaaagtacagggcattggtaatcatatctgcactaaagcgcatcggaatccaactgtaaatccagtttcggtaaagagccggcataatttctggcgcataagctaacactgctgccgcacatagccatagcacaataatcaacggccagcctttaaatccggcccagtcaagaatacaggtttgcaacaagaagaagacaaatacattgcccattagaatccaaatgaattcgctggcattgggtaccgccatcgcaaaacaggtatgggcaaaaaagtaaaatgatagcgccacgacaacactcatcaccgcaccagctaataactgactggtaatgtgcttaattgtccaacgaccattcggtttatttttatggtaaacccgccataacagcattgatccgattagtgaccccaaccaggcaaagacgatggttaacatcggtgcagcaccactaacactcttacttgggattttgttaactgttttttgcgttaccttgattggattagaaattgtctgccaactcgccgccgaaagactaacgtcgttttgctgaagaactgttttttcctgctgactaattttctggttcatcgcattgcccatagctggtaaggccgtcgtaagggcttgcgccacggttgcgttcatcccctgattcacgattaccgtcatctttgcactcgttggtgtttgggcgagttgtgcttctgcagccttaatttgcggtgacaaactcgttgtcagtgcagcattcttttgcaccatcgccgttagtttatcttttgtgaccaacgcctttaaatagttctgagactgtcccaattgttgagaaaaatcatgatcaataatgagtgcgccatagtattttttatcattaaatccctgtttgagatctttttgatgtttgacgacaacccatttaatttgagcgtcatgacccgcaaatttcttttttatctgtttcactaatttcatactggtttgcccagaatcctcattcacaagtgccactggaacttgatggagcttgatattatttttgaccccaatttgtagaaatgaaaaaataccaattatcgcgatcaccgctaccattgcaagccaaactcctgcctgtttaaatattttaaacatctttttattcccccttctctttgctttcataaaaagtatagagggcgcattcatctcgctcaagttgcatttccttgtagaacgggtccttatctgtacatatattgacaaatgtcgcctaatttgacatatgctataatattgttaaaggagaccttttatgacagacttaagaattcgacgcaccaaagctaacattcaacgtgctttcatccagttagtcaatcaagtcggtttcaaacacgtgacggttaaatcgatcgcggataccgccttgatcaatcgacaaaccttttataaacactatgaagataagtatcaactcgctgacgaaatgattgatgacttcgtcgtaatctacgatcaggaactggaaaaacgactcgtgcttaaagctcaaaatgtatcatttgaagagtcatttggtatcttattccccgaagtacagcagcttgttacccaccgttttgacacgcttaacgctctattaaccattcaaacggatcagccttcacttgaaaaaaaactacaacagcttatgatccaacatttcaaccagttcttgccagaagaaatgacggcgtttgaaaaagtcattatttcttccttattggttaatttattcgattacttcgtcacacataaacaattacctgaactggcagacgtgaaaaaaacattgacggactttctattactacttaaataaacagcataatttttcatcaattcagaatttaatctaaaaataaaccctctttatagaagtcagtcagttgatacatttttatctgacttctataaagagggtttgtaactagcttaaaatcttactatctaagtagttcttttatactacattctaaaactaaaataattacttaattcctttaaccgacatgataaaggaaacaccaacaacagcaaaaatgactgaaacaataaatgctagatcatatccagcagtaatagtcacaataaatgatgtcgctgctggcgcaaccatttgccccatagtattggttaaattaccgaatccaacgtatttaccagtaatcttgttttcctttgcaaactcaggaataacatcaacgttcaaggctccatcaacagacgaataaacacccgttcctaatcctgctaggacggtatatacaatcacaccagtagtggatttcataatcagtggcgtcaacgttccagctataattaaaattgcagcaaacaagattggaacttttcttctcttaattctatcagataatggaccagaaatagctaatccaatagttgaagtaatcaacgtaaacagtgatagcttattaattgtagctgccgcctgtaacgtagtttgaccaatgtaattttccaaaatataaagtaaatactgcccaatcattgtgccactagtcatcatcagaaagcgccccacgcaagctttgtaataattatgagcacctttaatacttggtggaagtaaatcaagcagcgattccttcactgaagctgatccagtatttgcatctctagatggtcgttccttaggaataattaacagagctacaagtccagaacatgcaataataactgcaccaacaacaaacccccattgttgatatggttttcctaggaaaaacgaactgataaattgtccaattgggccaccaattgctgttgcaccaaatccagcagataaagtaccacgcacattttttggaactctatcagccaaaaaagcatacatgggtgtctgaatcgcattatttcctaaagtattaagaatatatgcacccgtcaatgtaattgttgttgaaaatactccaagtaaacataatccgattccagcaacaatggaaccacagaagatccaaggggtacgctttccccagcgagatttcgtcttatctgaaagtgtcccccagatatatcctgcaaataatgacaccaaagatgtaactgatgtaataataccaaaagcagcagtaggatttgccattccaacatcttttagatgttgtggcaaaagcgtatttccgttgatagtgaaagccatattgttcaacattgcatatacaataaatgctactaaatatcttgttgttgtcgccttagtaaaaggttttcctgtttctggtgataatgtatccggatctagttttaatgatgttcccccacccgataaatcattaatgggttgaaaaaaacgaaaccgcctgttcttaaacatattgcaaaccttctttatattattttcgaatagatcgtattatttgtgtatgaaaatttaattttaaataaagttattatcatacattaaaaatacggtctacattcaagaaactaaaactaagcttagaaatataaccagctgatttacacattatgatagcggtttcttcaattattcaaaacctgcaaaagcacacgaatagtatacttttttgactttataatttttattatttatgcacgaagtaaaatgaatttttatacattttgtgcaacgtaaagtatcttcctatttaaatttaacaggaagatactttactttttaatttacttgcttaaaagcaaaactccgtgtattggaatttcaacaccactttgtaaacttactgtgctgtgcttccaaatatcccacatattttcaagtggtacaccaaaatcttcaaatgcttttcctgatatatttaatacttcattcgaaatattaaataagccaaaatattttttactttcactgactgctttccatactacaaccttatcatcacgatatgattgatatttttcggttaccttgtcatcaatttctatcaattctcgattactaattaagtcagtcgtccacttatcaagatccgttaactcacacccaagaatcaacggtgactgcatcaaactccaaagtgataacattgtcttttgctcatctttagtgaagcgcgtccagcgatccccgccaggtccatctgacgaacgtagtccaatatgccccagtggtaacatatcacaatctggccaatttcccggacgcgaaaatggcgcccatttttcacatcgttcaaacatgtctaataataattcccacttgtcccaaaaatcatcagtcaagcgccacatattcgcatttttttgcaaaaacgccccatcatcaactcttgcaggcccgggtgataaggagagtacgatttgcctcccgcatttatcaatcgcccgtctaagaccctcgatttccgcagaatgactttcatcataaagtggagaatatgcaatatcatcacatttaattaagtccactccccaggaagcatacatatctactattgaatcgtaatacatctgcccttcaggaatacccatatttacgccatacatatctgaattccaaggacaaatattattcaatgctatatctcgagccgtcttgcttgtccctaatataggcgtagcattctgcacggcctgtcgcggaattccccgcataatatgaattccaaatttaagtccaagaccgtgaacgtaatcagctaattttttgaatccacttccgtcttttgcagaaggaaaacgtttttcatctggaatcaatcttgagaaatcatccataactaacggatagaaatcgtgatacaccgatgagcttgcagtaggttcataccactgaatgtccacagtaacataatcccaaccatattgttttaaatttttacccatatattctgcattcgcacgaacttcattttcagttactgaagccccgtagctatcccaactattccatcccttcacaggtacctttgcaaaatctcttaaatttgttgccacttaaaaatccctccattttctacaaatcaatgctcatattaattaatatttgtttttgaatatttatgcctatatctaattaactaatgcgctttcatttaattgattatttataatatagtctatataaatcccgataaaaactaataaaaagatattaatggttcatttttttgacatttagttttataattaatagtaattgaagagcctaattaaaggggtgaattactaatggatttttttgtttttaaaactgatcagatcattaactttagcgtaggtggttatttttcagcagaatcagggtggaaacataattcaagatatcactacggtgattatgaattaatcatttgcgtaaaaggaccaatttttttatcaattgctgataaaacggtaactctaaaagataacgatgccttagtaataccgccatttgttactatgaaaggatataaaagttcttcaaatcctattggattttactggttacatttcattcttccaaaaaatcttaaaacattcaaaaacacaacccttccacaattacctgtaattagcgatgctcataccgactcaattattcttccatctcaactacacttggaaagcatagatcggctgatggtcttaatacatcagcttctaactgtaaatcgtcaaacagcatattcacagcaagaggtagactatttaatttcacttataattacaaaattatcttcggagttaattgaacctttagacgatgataaaaatatcgcaatcatcaattacttgaaggaatggattcgtgtaaatatttatcgaccactcacacttgacgaaatcgcaaacgaagcacatttaaatcctcaatatctttcacgacttttcaaaaaaattgtcggaatttcaccaaaacattatattatacaattgaaattagatactgctcgcgcattacttcttagaagtaatctatcaattaaagaagtggctgataattcttattttcaaaatgaaaaattatttatgcgtcaatttaagaagtcgtgcggcgtaacaccgtcacaatttagaaataattacaaacgaatttataataataatgaagtcattagtccattaattccaattccagaaaaagtgaccaataaattgaatgatgtagtcgatatacaaaattcaagtaacagacattcaaaataatctctctaataaaaaggaatgcaaaaatgaggtacaccccaatgcattcctttttactaatttttatttaaagaaacagtaactacgctcatagctggtaaatttaccaataatttgtttccgtccaatttacaatcagaaaatttcttctcacatactttatttggattttcaaatgtattatgggcatccatggatgtcgcaacaataatttttgcatccacgatattcacaatattcccctcaaactccaacgatagtgaacgtgctgcagataattcatagttaacaaaagatatcgttaatcggctatctttttttgatgctgtacaactaacgcgttctggtaatattccattatattgaacattttctgctcccatatgttgttgatacaagtcaaatacataataggtaggtgttttaaccatttggttattatttgtaataatcatcgcctgtagcacatttaccatctgagcaatatttgccattttcacacgatcagcatgcttgtgaaaaacattaagtgtgattgccgcaacaattgcatcacgaattgtattctgttgaaaaagaaatcccggattagttcctttttctacatcacaccatgtcccccactcgtccacaattaatccaaccctatgttcgggatcataatgatccatgatttcagaatgttttgacagcaaataatccatatgcaatgctctgtctatcgtactataccactcattttcaggaaaactagtagctgcacccttacgtgcccatttcccagttggaatcgtatagtaatgcagactaagtccatctaaaaattctccagcaatactcattaccttgtcagtccaattatagtcatcttcgttaggtccacaagcaattttataaattggttcatttaaatcatattgcggtacaaacgtctgatattgccgatacagatcagcataatactcaggtcgcatgttgccgccaccaccccaagtttcatttccaattcctacatatttgagatgccatggttttctgcgtccatttaattctcgctgattgaccattggtgaagttccagatttagtaatgtattcaatccattcagacatttctcgtacagttccactacccatgtttgtattaatatatgcatcactatctaattgttttaataactcgaaatattcatgagttccaaaatgattgttctcagtaacatctccccagtttgtgtttacaattttcttccgatcattgacaggtcctacaccatcttgccaatggtaggtatcagcgaacaaaccacccggccatcttaacactggtatatgaagcttcttgagcgcattaacaacatctattctcattccattaatattgggaatatctgactcactgcctacgtatattccaccataaatccctgctcctaaatgttccgcaaactgtccatagatatccttatcaattacttccccaggctgattatccaataatttaagtgtcatgattattattcctccttttccactcgtttatttttttgactatttaactaagcaacctttaaatcactatttttaattaccaaattatagagtgaatcaaaattagcttgataataatcagttccccattgcagaaaaaaataaggaatatagaacacagaaaaggcatttaagattgtatctgcagttatatttaattcctctttatttacacacatgctatccctcagcaaatcaactaaatttgttctccaaactatattttcccggtttctaaaaatgagatcatgttcataaaagtcttttgataactcaaataaattactatcaaataagtaaaagtctctttgaatatgtgccaacatccataaataatgatacagattattactatctttagaataatctacaatttttcgtagcgatttatcatcttcgttaagcttatttaacgcaactgaacgaagtaaggctttcttatctttgtaatacttatatatagttgcatggctaattccaagatcatttgcaatttcaccaatttttactttatgatatcctttttctcgaacaagcattgttgcccgttcagcaatgatcgatttttccatatcgagtccctcgcttttcaagtttacacaagttttatgcagaacatattccacgagagaggttttaattcagcattaaaatcatcgccatttaattgattacgtgtctgaaatttaattctcatttcttgattttcatttgtttgctttaaaccatagcccgcaaattcagttgctaaaacaacagaacttaattttaaattctcaattttagatttaaattcaattgtttccttagacttattctctacaaaaatcactaattggtttgtttcactattaacaactgatacagaatctacatatggaacaacattgatatcctcagtactatatgctggaacatccatcaccgtatcaattacagtacctcttccataattagataattgcataaacggataaaaaatagactgataccaaaccgatggttgcccatcactattagtcattattggggcaataacatttaccaattgagctaaacaggcaattttaactcgatccgcatgtcttaaaagtgtcatcatcatacttccaacaagaagagcatcttcaaaattataatgatcttccaataaatccggaccaattctccatggctctgcttttgcatctttattatttgaatgataccaaacattccattcatcaaatgacaaattaattgtctttttactgtgctttctggcttttacggaatctgccactgaaataatgtcttgaataaattcatctaaatccactgatcggcttaaaaaattttctaaatcatttttttcattaccatagtactgatgtaaagatagatattcaacatcatcatatgtgtgatctaaaactgtttcctcccaggatccaaatgttttcattgttcttaaagaactaccacttgcaattaattcaattgttggatccactaatttcattactttagcagtttcatgcgccaatctaccgtattcatctgctgttttatgcccaatttgccaatcaccatccatttcattacctaatgaccaagttttaatattgaatggattcttcgcaccatttttaattcgtaaatcactccaatatgttccggccggaaaattacagtattcaactaaatttcttgctgcatccatacctcttgttccgagattgactcccatatccggagaacttccgactttttttgaccatttcataaattcatgaattccgaattgatttgtttcaatgcttctccatgctaaatctaatcgtttaggccgtttttctttcggtccaattccatcttcccaattatagccagaaagaaagtttcctccaggatatctaataattggtacttttaattttcgaactgcatcaattacatccgtccgaaatccatcctcatctgataattcatggtctggttgatatatacctgtataaattgctcttcccatatgttccaaaagtgatccatatatacgtgaatcaatttctgaaatttgcttatcaccatcaattttaactattgctttcaaagttctcacatctttctatgctatggccttacattcttgaatcagttattggtgtaaccacactgtcatctgtccttcacttcggttagcccatgaataatacggaatcaatcttaaatgagttttttcagtctttgcctcttcatctagcgtgtagagagtatcactagttgtattctcaattttttgtacatcgtcagtctccagagtaacaacaccatctaacaaatcacccctgtatatatctttaaagcttggatattgagatagtttatattgccatagatttttttcgttatccgtctcttcagcacaataaacaattggtccacgctgcacggcaacttttccaagattgtctttaactgacacatttgttctaatcagctgcgccttcatattaaattgcactgtaatcattgtgctactatcttttatttccacatacacaatctgatcttgaacacttaactgttgctcctcaccatttactcgaatttcaaatgaattagccgaccaatttggaatccgaattccaaatctaaatccaactttctttgaattttcaatagtatatttcaaattaccgctccaagggtaatcactatcgagattaattttaatttcatcattaaattgtgtactattagcaataaattgatcagataaaattgtattctcagaagtttcatacaaatatttatcgacagatgaaattaaccttgtaatgttagatggacaacaagcacacgcaaaccaggacgaccgccgggtagcaatatgatttttgccctggtttcctttacttgccttgggatcagcttccagtggatttacgtaaaaataatgcttcccgtcaagagcaattccgctcaacgccccgttgaataactctttttcaataacatcaccaaattggccgtctaatcttgtatttagcatctgttttgcaaaaaagaccattgcaactgacgcgcacgtttcaccataaacagtgtcatttggtaggtcataatcataagtaaatgcttccccatggccagtttgaccgacattacctgttacatacatttgcttttttatgacatcagtccaaagccgatttgctgcttttttcagttcttcatcaccagtaagtctggcaacatgtgcaagtccagtacaaaaatataaaactcttacggcatgcccatgtacatccgtttgctcagtaactggtttgtcagcaaaatagtaacgattaccaatcgttccaagcactgggaaaaagtcacgatctattccgtcagctttattttgtttatcaaaaaaactagtatctttaccgcgttgtttaataaaatattttgctagatccaaatatcttttttcttgcgttacttcatataagcgtgctaatgcgagttcaatttctggatggccaggaatccctaaaatctttccgttttctgttccaaaatgattattaatacaatccgccattttttttgcgatgtttagtgcctttacgttaccagttacttcgtaatacgcgacgccagcttcaatataatgtcccattgaataaagttcatgagattgttgtaaccgcttaaattttctttccggcatttcaatttgaaacatagtagataaatagccatcatcttcttgcgcgtcagcaataagatcaacaacagaatctgtttcttctttaagtttttcatcaggagcatagctcaaaacatatgctgctgattcaagccacttataaacatctgtatcctgaaaatccataccaaagaaatcaccttgttgttgtcctgcagcaatttttaaatttgcaatggcatgacttttatccgtagctcctccggccgcaaacgggtcatttgttacttcaactttatctctatcattaatcatattccactgaaaaggaattgactcctctgacatcaaatcacggtatctcccccaaaatttcgaattaacctttaccgtctgtactttcaaattttgatttttcattgcatttcattctccttatttcaattaattttcatacataaaaaaggttttgttcatctcgcgattctgaacataaaaacaagattaatgttttctatgattatatgattacgctttcaagaacttaaaaaaactccaaaaactaatgaaatagtatatttttttgacatttacagatttaagtaccatataaattaaaaacgttaatggcccattaaatttatgtgatcatgcttttctttagcactgccataatatgttggtacactttaaaggtatttaggtatatttttttgactcataattcgataaaaaattatttatatcgtaacttataaaaaaagaccctgaggataaaataatcttcagaatctttctttactgtttaaatctataaaactaatttcaaggtattaccaatagacaataaaatctgcttcacaataaaataattttttgaaccatcaatatttaatttacagcatttgttattgtgcttggtttgttcaaaattacattgatcccatcgattccaataacttctcaatttgccgcaaactctgtttcagttcctgccgttgtggtactcgttgtcgttccagaatgaaatctagatcactcattgccatattcacaaacaaatagacggtaaaattatcttcattgagatgaaaaacttgttgataaaattttcgaaagagacggcggcactgggcatcaaagctattggttcccagtgaaatgaggcgcaactgttgtagtactgtcgtattggtaatcagataggtcattaaatgggtcgaaaaaaattgatagtgatccatcgtcatggaccgtgactcacgtaaactctggttcagagtatcttcgataaccgtgatatagtccatcatcactgctgtggccaattcatacactcccgcatagtgcgcgtaaaatgtcgaccgatccacaagactgtcacgggccaattgcgccactgtcaaggcgtcataacccgatcgttgaatgccggtcacaaaagtccgtttaatctctcggtctgttcgttcatagcgttgatccatgatttcatccccattcttatttttattctacactgtgttggataatccagcaaactgttaactattgtggttctgttatcccccaacccctgttacgatacagatagtctcacaactgacactcaataaaggagatcgattacatggataatttaaaaatagaagtcacaattgacgatacacccgtatcacaacaaactttagaccaggttcaagccctacgaatcaagcacgtcttgcacgaaatgaaagcgcttggtgcaccagtcaatttatcagattctgccattgactaccttccgtaccccgaagctaagcaacggttgctggatatcaaggcacagtattccctgtcccaattcaaacaactctatgcagaaccgctcgcaacggccgatcatttttggcatcaagttgctgaacaatccgacggtcgtgatcatcttcaagagggtcaggttaaactgcacgttgaaggtattagcatgccacaactacaagctgtcctaggaagtgagttgggaagtgattttgcagctcgcatcaatccagaacacttctatagcgatggctcactcacagctggccaacacattattgaaatatttggctgttttggcgaaccaacagaaatgaacctatacgtcgaacaaggtgactttaaaccggtcgttcccgatccaacctatcccatccaaatgaacggctacgtcgcattgagtagtgataatgatgatttgggacagggctggcgtgcttatcaccaaattcgtcccactgcaacgggctttgatgctatcctggcagcatacctaccatctgctacaccaaccgagatcatcaacggtcataaatggcacctagccgctgaattttccgaaatgatcaagtttgccgttgctcaaaattaatatcaccaagtatttaaaggcagtagccatcatggttaccgcctttttttatatcattcacttcaattgatgacatcgaaacatcgcttgacaagtctagtgcaccatcgcatgctaacagcatagtaactcaccaatttattaatcaccaataaaaggagacttttttatgtatgctggcacaaatccaaccgcacttcgctcacaaacattacttgtcgatgcgatgttcaccttgttacagcatgatacatttgccgatattaccgtgagccaactgacacaagaagctcaactatcacgccagaccttttaccaaattttcaccagcaaagaggatgttatcaagtgtcgtattcaaggtctcttcgtcgagtttcaacaaacactcagcaggcagccgattacactgcacgcactaattactttgtttttcgcattttatcaaaaatatgcgactatttttaatttgttactcgacaatcatctagaaccccttcttacaacttacgcgcaagactgcatggcgtcactccaactcacgactgaaaaaaataaccattatagtcatagttttatcgccgccggattaactcaaattctcgttgattggcattcccaccaagatactgatatcgaagaggtcgctcaattggtcgaacaactgttaaatccaaatgcaattacaaaataaaaaacgagcactcatagtctcgttttactagctactaatttatagttttcccaaagtacatctcttcccataatccctgactttcatgggtctcactgatcgtctcaccttgatagatgtccaaacgaactttgccagagaaccgcagataagcaccgtcaaatccggttaatttggccagcacgtgcttgaccccgcttacctgatcgatcattcgatcctgcgtgatggtctgttcccataagtaggtaatccggtaatgttgttttctgtcgttataatcgtaactcaccgatttatggtatggcttacccgtcacgtcatcaatttgccgatccgattcttcatacgtgagatactttggatcatcagccaaaatacgatcgcctttggcaagcataaaaactggtaaggtctgatagccatactttttctctgcagtcatataacttgaaataacggtgtaatcatcaatgttagcgcgcccccaataccaatggtgcatcactttcattaaggcaacattaccccaattatgatcgtggtaacaattccctgataattgttcggttcctttctgcgtcgtcatcgtcacatccgcaattccacgtggtgtagccggtaaccagccaaaattagtttcgtcttggtcaccaaaaaagatcgccacgtttcgacgccatgcgggaacgatattgtatgcgtcgaccataacggtaatatcttcagcctgtacatgaatgacataatgattcaaatcaccccgaaaataattgccagcaatttttatttccgcccgttgatcagaagccgtaaattctgtggggctaaaatgcattgtatggctaattttcgtcccatctggccgcgttaagtcaatatcgatcattggcttcaatccgttagaggggtcaacaaccgatttagcgtaaaatgtgatcactaattgtgagccatccgctaaattagcatcaaaataccaccactcatagttttcgccggctgcgtccgttcgcataccatcctcccacaaggcaacctcgtgccgattaagattagcatcttcaaagtcttgatccaaatcagctaaccgtgctcgtttagccattctaaccaccatccttaaataaattatctttaactatgctcaaaattagcgaaaatcacgacaagtgtcaacgttttgcccataacatcaacagattcacaactatgtcagctttttttacttcgttatgtgttccttagccctcaatggcacgctctgatttgcaatttaatctcattattagtactattaaattcgttacacaatacataggaagactaggtacttgatacatgaaaaaaaatgaaacagaacctgttgaactaagtcgttcgctcggcctctggtccgcgttatcacttgttgttggcacaatcatcggagttgggatctttgttcgtcaatccgccgtccttgacgatgcgggttcaacgactggcgcccttctggcgtggctagctggggggttaatcaccctgacggctggtttaaccatcgccgaaattgcctctcaaatgccccataccggtggcctatacgtctacatggaaaacatctacggccgtatctggggctttttatccggctggatgcagatcattatttatggtccggccatgattgcctcgctgggggcttacttgtcactactcctaattgactttttccacatcccccatcagtggaccgttcccattgcactaattgccgtcattgccgttggcgttttgaatctcttttctaaccgctacggtgccggcttcgcgatcgtgacaacgatctgcaaactagttcccgttgccgccttaattatctttgggctcttctttggtgaccaaagtgcccttggtcattcgatcgagaccgtccatcaatcagctggtggattcggcgtcgccatcttggctaccctctttgcctttgatggctggatcttagtcgctaatcttggtggtgaaatcaaaaatcccagtaaacggctcccgcaggcaatcgtcctcggaattttggccgtcttggtgatttacctgctcgtcagttacggtgtctttcgtagcttgcctgccacgaaaatccacgaactcggcaccggcgcgatcccttacatggccaccaaagattttggcgccattggtggtaagattctcagtattggcattattatttccatcgtcggctgtatgaatggcaaaatcatgaccttcccccgcattatgtacgcaatggcgcgggaccgtgagctaccattccacaaatacttagcttacttaaatcctaagacccacactcccatctggtgcacaatcaccacactggttatcgcagcaatcatgattattttctttgacgccgatcgactgtcagaactttgtattttcaccgtatactgcttttatgtgatggccttttttggccccacaattcttcgacgtcgcaacccaaacgctaagcgcgacttctccattccgctgtatcctatcacgccattgattgcaattggtggttctctcttcgttcttatcagtgaagtaatgtcggactggcaaggtgttctaatttcgtttatttttgttctcatcggaattccggtatactactaccaagttaaaaagcatcctactaaatcggagtgacagcaatgacagcacagcctagtatcacttgtaatgaaacactggcgatttccgctcaccggattttcccagacgaactcaacgaacacggcaccttatttggtggtatcacgcttaatattgttgatcgtgaagcctcactggctgcaatggaagttgcgcgacaaacagtcgtgacggccaaactggaccacgttaactttattgccccatttcaacttcataactcaatgaaccttgaggcctacgtcaccggcatggggcatcgttcaattgaagtcttcgctaaaatcatcggcaaggatctcacaacgggacaaacctttctgggctttacatgctttgcgaccttcgtaattgaagatcagctcgctcaggtaaaatacaatcgtgtcatcccccaaaccgaagagcaacaggcaatgtgtgccggctacgaacagcgcgtgcaggaacgacgacaagaacggcagctctttcaaaaacaactagatacaataaccacgaataagccgtggcaaaattaaaaagagtaggaaacgtcatcgtttcctactctttttaattggtcatcctctgccacgaacaatttcgtcgataaacagttgatgaaaccgaccatcatccgttaattctgggtgaaacgcggtcaccaatacattggcctgttgcgcagcaacgatgcgtccgtcaggcaacgtgacaattggcttggcgggcgtctcaacacgggttaaaaatggggcccggataaagaccccatggaatggccgtgaccagcccaccacagttaactcagtttcaaaactctcacgctggcggccaaatccattacgctcaacctgcccatttaatccatccaacgagtcgggttgcgccagcaggactaaccccgcacacgttccaaatactggtagcccacttttaactagttgcttgagaggcgtcaacatctgttcacgcaccaataactttcggatcgtggtactctcaccaccgggaatgacgataccgtcaatccccgttaaatctgataattcattaattagttttgtagctacaccacaggcttggagcttgaccacatgctcacttaccgctccttgcaaagctaaaacgccaatcaccattcacttcactcccattctaaacgccacggctagccatcttttgatcttctgataatgttgaaatttcgattcccttcattggattacccaggttttcggaaacacgggcaatcagatcccaatcggttggatgagccgtagccgtcacaatcgccttggcaaacttggccgggttttctgacttaaagattccggaccccacaaaaattccgtcagcacccagattcatcatcaatgccgcatcagccggagttgaaaccccaccggccgcaaagttaatcacggggagcttgccagtttcatgaacttcctggactaattcgtacggtgcccgtaaatcacgcgcgattgaaatcaactgatcctcattggctgcctgcacatgggcaatttgctcattcactttctccatatgccgcaccgcttcaataatattaccggtccccggttcgcccttagttctaagcatcgaagccccttcaccaattcgccgtagtgcctcgcccaagttgcggcatccacaaacaaacggcaccgtaaacttggtcttgttaatgtggtaattatcgtcggctggcgtcaagacctcactctcatcaatatagtctacgccaatggcctccagaattcgggcttcggccaaatggccaatccgagcctttgccatcactggaatcgtcacggcggcttcaatcgccttaatcatggccggatcagacatccgagcaaccccacctgccgcccggatatctgaagggacccgttccaatgccattacggctaccgcgcccgcagcctctgccactcgagcctgttctacattagcaacgtccataatgacgccacctttttgcatctgtgccattccgcgtttaacaagtgtcgttcctgtttgtgtcattttaaattcctccatctctcattgaaaattggctttatcttatggtatcctagggccaattcaaaccaccaattggcaggtatttaccccaaccaatttcaaagagggtctttaaacaatgaactggcaacttccaacgggtactgatgcaccatacttaaagttgataaatttaatttcaaccgcgatcacaaccggtcaattactccccggatcacggctcccgccagaacgacaattagcacaatcacttcatatcaaccggtctaccgttcagcatgcctttaatgaactagtcagtcgcggaattcttatccgaaaaatcggtagcggcacttgggtcaactccggcaaatggggcgtcctctcccaatcagttaattggcaaagctacctcaccaccggccgactcagtgatcccgaacactacatggttcaattacgacaccttgaagccgatccagccagcatcaatctctcgcacgctagtatcacgtctaatttagctttaccaatcaccctacgcgatctgtcatccgatgaactacttaaccaagaaacacagactgccatcactggtgcaaccagccttaaaaccgcgctagttcaccgattgtcatcggttctcggcaccgcactgacacctgaccaaattctcattacctcgggcgcgcaacaagccttttacttaatcacccagggactactctcgtacggagacgccattgctatcgaggcgccgtcttacttttatcagctgtcactcttccaagcagccggtattcgggtttttggggtaccacttaatgatgatggaagcttggaccttgaggttttacaaaaattatactatcagcaccatttacgattcttattcgtcaatcctacggggcaaaatccaaccagtcgtacgatgccccttgcggcccgtcaggcactgattacatgctgtcatcgtcttcaacttcccatcgtggaagatgatccgcatgggctcacaaacaccgtgacccagcaccccattcaaccgctcaaagcactagacttcgataacgtactctacgtaggctcactatcaacgcttacgggggcccatacgcgcattggctggttaattgcaccaagtgccatcacggtgcgtctcgccgaaattcgacagcaaatggaagctgggatcagtatctttccacaaattgttgccacccaactactcaaccaatccattcttgttgatcaaatcaacgcccagcagcagcaactttaccaacaacaggcccttttagccgcctgtctggcaccgtttgttcaatcaaaccagcttagttatcaactgccgcaaaatggcaatagtttctgggttcatttacacacgagacactcattgacgttaagcgactaccatcaattcctacatcacaaagtccttgttcgaccagatttcttgtttggcgttcaccaaaactgcgtccgaatgagttatccgagactgcagcctgcacaaatcaatgatcttcagcggcgactagccacgcttctggacgagttatccgattaaaaagcacaacaaaaggcctcgactaacgtcaatgttaatcgaggcctttattttttatcgaacgagtttatcccaaatcacaacttcatcttgtgccagtgacttaggaacatcgatgattcgttgattagaacttccccggaattgaagggttaaatcttttttatcaagcataaaccgatcatcaacaaggatatcgagaagcgataaaagttctaatttatcgtctgattctttcatcaattcatcccacttatacccagtccacgaccaaatatccttatcgtgaccaaactcttttcgaactcgcttgcacaactggatgcaaacttgagtattgaggaagggttctccccctagcagggttaatccttgaacgtaagattcactcatatccttaataatttggtcctctagctcctgcgtgtagggatgaccaaagtgaaagttttgcgcaattttattgtagcaaccggggcagttaaacaggcatccactaacgtagagactgcaacgaaccccttcaccatcaacaaaattgaagggcttatagctcgcaatatagcctagactatgatccttagccaaccactctttcggcatcggattgtttggctttttcgtgttctgcggcatgtttaatcatatctcctgacatatgctttactcgtgctgaaatttcaagatgccggccatgcaccattggccgttgttgtggattacctaagtaaccacaagtccgcttcacaacatcacaatattgcggatcgtgattaccacattgtgggcattggaagcctttagcagtggccttaaagtcaccatggaaaccacacttgaaacattgatcaattgcagtatttgtccccaaataaccaacatgatcgtaggcccaatcccagacagcttcaagtgccttaggattttgacgtagatttggatactcgcagtagtggataaaaccacccgcagcgtacttcggaaagacctcttcaaatgatagcttctggaatggtgttgggtgtttgcgaacatcgtagtggaaactgtttgtgtagtattccttgtcggtcacgtcttcaactttcccgaacttcttcaaatcagcctggcagaatgtgtcagtcaatgattcagccggcgttgaatataagctgaagtggtagccttcttctttttcccatgctttacagtcgtcagacatatacttcacaattgcttccgcaaaatcatgggcttcaggatcgtcttcccattggggaccgaagaacgtggtgcagacttcataaagtccgatatagccaagagaaaccgttgcacgactattcttgaagacttcatcaacactatcatctttatctagtcgctttccaaatgcaccatacatatagagtaacggggcgttttctggtttcgcttccttagtccgttcaatacgatagtccagagcttgcttacacaaagtcatcttttctttcataatatcccagaacaagtctttgtcaccctgtgcttctagtgccacccgtggaaggttgaccgtcaccacacccaaattcattcgtccagaattcacttctaccccattatcatccttccagccttggagaaatgaccgacatcccatcggagttttgaaacttccagtaatttctttgatcttgtcatacattaatagatcagggtacatccgcttggttgaacattcgagtgcgagttgcttgatatcatagttgggatccgttacatctaggttcaatccacgtttaacggtgaacaccagcttagggaaaatggcggttctgtgttccttccccaaccctttgatccggatctctaggatcgccttttgaatttcacgttcaatccaattagttcctaaaccgaaattaacggtcgtaaatggcgtctgaccttgtgatgagtacaaggtattaatttcgtattcgagggcctgcatggcgtcgtaaatgtccttcttggtcttcttttgggcgaaggcctcccgtttttcaggcgcaatccattcctcggcatctttcatgtgcttgtcgtagttcaattgggcatatggtgccagcagttgatcgacacggtttgcggaacatcccccgtactgtaacgatgccacattagcaatgatctgtgccatttgcgcggtagccgtttgaattgacttcggtgaagccacccacgcatttccgatcttaaatccatttttgagcatttcatcaaaatcaatcaagcaacaattggtctcgggcgttactggtgaatagtccaaatcgtgccaatgaatatcaccacgcaggtgggccttagccactacttctggcatcatttgtaaccccaaggcacggctcacagaaccagcttccagatcacgttgggtattaaatactttactatccttattcgcattttcatgaacaactgtatctgactggttaaacaacttatttaagcggtaggttggatcagtggcctgcttaaagttggcttctgattgctcgtaataggcttggtaactttgtgccaaatcatcatgattagcttcgatcaacgcttccttaatggcaccagcaatctctgctgtttcaacttcctgacgatcattaaattgatcgtagagtgattggaaaacaaagtcgctcaccgcttgatctgcgcctaattgttggaggactaatttaattttatatgggtaaaaattagtaggtgttccgtcacgtttaattactttcaaagcctttaagacggccgtttgagtctcaattgcaatttgtaaattcatcatcaattcccccgaacatcagcatttcttttgctgtaaatttcttagtttctacactcgttatgttagcccataaatagcaaaaacacaacatatagtatcggcttttttgagctaatacaatatgttgtgctttatgcaggagcaacttttggtgcatttttacaccttatttgagattcgattaatcgttcgattatgatgcgaaacaatcgataggttacggatcttcgaatagacaatgtttaaattctacatcatttttaagcaaatgaaaagccaaatttagtattcgataaatgaaaatatgcagaaacttttttgatcttttttgtcactttcctaacaagagacattctaatctagcctacccaacctgaacagattccccgcggatcgtaatcatattacggccattttccttagaatgatacaaatctttatccgcccgtcggtacacttcaaggtagctatcgtcgtcttgtattacgtcatcacagccaatcgacaccgtccattggaccgcctgctgattaacaatcatctgctgctgccgaatcgtttgctgaattcgttggcaaaagtcctttagccaagcttcatcccgattttcaactggcatcagtaggctaaactcctcgccaccggtccggtaggcttgattaggggctccttcttgatcaatcaagcgtgtcaacacccgtgccgtttgttggagcacatcattaccaaccaaatgaccaaacgtatcattgatgtgcttaaaatgatcaatgtccattgtaatgagcacaaaagaccgagactgttcctgaaacgccgtataaaacgtattaagctccgtactaaatgcgcgaaagttctttaatcccgtaagttcatcgtgactgacctgattggccagcatcatttcacgattataatcgcgtcttagtcgaatattaaaagcgttcacaattaagaattgaatgttgaacatcaaaaaattaattgcccagtcagcaaaagtatcgttgaccattgtcgtagcaaccgtgtaccacacagccgcactcacaattagcgttgctaaccaaattcgccaaaactgccgcaacagccattcggcatagcggcaaatcaatagtgagcctaccaaaacaaagataaacgtcagccatgctcgccaatcagaaaagaatccccgctcccaataaaacagaattaaggtaccggtcaaaaaagccatcccaattcgtgacgataccgtcacggccaaatagacgtatagaataatttggatgtttaaaaagacccagtcaaacgaaactgccccggcactataatttttaaacgtcacaacttccgtatgcaaaaagacgagcattccaaacaggatagtcgcaatcgtcgtatcgaccatcacagacgtcaatcggatcgtatttaatcgatcttctaaccacttacacacggcaataacgcccatgattaaaaacaagttcccaatttcaaattcgtaatacatgctgactccccactgtccgatactgtgtcattggctggttgtccaatccggtaaatcagccgcttctaaaaagaatatgcgacctcacaaccaaattcaagtagttgcgactaacttgttaaggggataatcattttcaatcaaaaaaagagccgccaaagataattggcagactctcatcgttccatataattatttagtgggcgtacttactacccatccgtttctcaaataccttcatcacttgtgcaagaacttgtgtcaagacgaagtagatcaccgcagccacgagcagaggtggcacgaagtcgtacaaggttccaccgacccccagtgcttgggcagttacttcttgaaccccaatatagaacaatactgaagattccttaatcagagtaatgaattcatttcctaaagccggcaagatattccgcactgcttgtggcaggacaattgaaaacatagtttgacggccactaagtcccaaagacatccctgcttcagtttgtcccttagcaattgaaataattcctgaacggaagatttcagccgtataagcgcctgaattaatccccaacgcgatcgcacctggaatcatccggtccaacccagatccaaggaactgaattgaaggaatcggcaaaacttttgataaggtgtaatagatcaacatcacttggatcatcgatggtgttccacggacaattgaaatataaagtcgtgaaatccactgtaatactttgagatgtgacaaacgcatcagcaccatgatgagtccaaggacgatccccagagcaaccccaataattgaaataataattgttaatgcagttccgtctaagaacaacggataatactggcctaggaaactaaacatttacatactcctttttattttccgtacttcgattgaagatcttgtgacttttgcaataatttatccatgtcaccgttcttctgaagcttagtgataactttgttaactttcttcatcagcttcttgtcacccttccgagcagcaacgttgatataacgttgtgacttaggtgtcgtcaagttaaccttggcaaccgcatacttatcagggtaattcttcaagtagttatcagcaatttcattttcaacgacaactccgtcaagtttaccgtttagcaattctgtcgtcaagctcgtaaccaagccttctgaaacgaccgttgccttcgtttgctccttggcgatgctttcttgtgtggtcgtttgttgtgccccaatttgagcacccttcgtatcagcaatcgtgttgaacttgtttgcatcctgcttcttaactaacaaaacgttgcgaacagtgtagtaactctttgagaaagcgacctgtttcttacgagcattagttgaaaccatcccggccatgaccagatcaactttgttacccttcaaatcagaaatcaatgacgtaaattcagtattttgaaccttcagcttaacgcctagttcatccgcaatcttttgggcgattaaaatatcataaccagtaatttgcttcttaccattcttaacgatcggaaattcaaatggcgcgtaatcggcagaagtcccgacaaccaaagttcctttatcctgaatctttttaacactattatctgagctcttgctgccacaaccggcaagtccgacggatagcaccatcaccacactaagtgcgactaaccaactttttttcatccactttttcatctcaatttcctcctcaacagttccatcctaatgacattgaatatttattcaggcattcttttaatgtgtcccttgtttatcccgaagcaagggcaataacaccctttcattaaaatatagaatgcataaatctgtttttttatactacaaacatcataaattaaaccttgattaaaagcaagtgaaaatatcaaaaaagttgcataataatccttttttcttcattttttcactttattatgcataaaaataacgtttacatcaataagggccctcatattggctttcatttaagacaacaaatccggcttttatgagcttagactactgcattccgttaattgacgtggtatggttagttataattaagttaaggaggcggttatattggcaaaatacgtggctcatgcccattcaaaaattattttatcctctcataaggtcagaaaagacattgtgtcgattgctagtaaactaggctatttaagttttgaatcggatgaacaaaataattttgatcagaatatcgaacaaatgcggcgcgatgatgtcctcctctttccttttccatcaggtaaaggacgggaacaagatgatttggcctttctaaccaagatcaaagaaaaacaggttaaattgattctaatcacgcttaatattgattacctacgctatgacaccgcagataaagcagctacggtcagcgcactgcaacaagcagacgtgttaattaccctctctcaagcgatgaatcaacagcttcttttggatggggttaatgtcccgatggtcgtgcttgatcttcacgactacctttcagagggagaaattctaccagcaacatacatgaagaaactcatttttgctggttctccctacaaagccacctatatgcaaggatggcaatcacatattcccattgatatttttgctcgcgaagaggctatcgatcatatcgatcagcttcacgactcaatttcgtacaccgggtacctaacccctgataaaatgccaaacttaattaactacggctttggactcgcttttgatgttgattcggatgctggccactttgcaaactatcaaacgctgaatctctcacataaggtatccctgtttcttgcagctggactgccaatcattgtcaatgctcgagcagcatccgcaccaattctacgagccgccaatgctgcacttgtcattgacagtattggcgatattgaagatattttctacgcaatggatgacgttcaatatcataaactggctcatgggtctgcacagctggggcgtcttgtgcgtgacggattcttctacacaaaggcggttcggcaagctgaacagttaattgatgtcgaataagagtctgattaaaaaacataagattgttgtttcaatctgaatattttatcccattcattgatctaatcaggtaccaaattgctatgctaacttgccagtcgtatgattttatactttaaatcatacgactgttttaattaaacccacaaatcaggactccgaatcgcataaaggtttcactgacaatataacgtaattaaagtttccggaaaacgcataaaaaagagctgtgcgtagatcacagctcttgagctaaacacgattgggatggtacgtgtcagcttgcacaaagtgtatgagggtccttaacaactaggacttcgctagtttaccataaaccatttacctaaactggctccttatttcactgaattccgaatctttgatgattaaatgataataaaaaagacatcctgtaagctcaaacacttacaagacatcttttgacctatgaccatcaattatgccgccggtgggggtcgaacccacactcccttgcgggaactggattttgagtccagcgcgtctgccaattccgccacagcggcatcaaatgtcgctaagcaaactgacaatcataaggtggtaaccggatttgaaccggtgatgaaggttttgcagacctctgccttaccacttggctataccaccatgttactagcgatcaggaaatcaatcaattaacatgatggagtcaaagtccacaacatcatcacttggccaaaacccaatcaaagggcggtatgtggggatcgaacccacgcgtgccggatccacaaaccggtgtgttaaccacttcaccaataccgccaagatattcagttaagcagggatagtaggagttgaacccacactgacggttttggagaccgtagttctaccattaaactatatccctataaaaatggaggggagtggattcgaaccaccgaacccgaaggagcggatttacagtccgccgcgtttagccagacttcgctacccctccataaatggcgcgggacggaatcgaaccgccgacacacggagcttcaatccgttgctctaccgactgagctaccgagccattgaggtaactaataaaattaacaataactatgatacgctttcttgggtaaaaaagcaaattattgttgatggaggatacagggctcgaacctgtgaccctctgcttgtaaggcagacgctctcccaactgagctaatcctccaaaaagtgacccgtacgggatttgaacccatgttaccgccgtgaaagggcggtgtcttaaccacttgaccaacgggtcatacaacggagagtaagggattcgaacccttgaaacaggctttaacccgtttacatcatttccaatgatgctccttcggccagctcggacaactctccagtatccaaggcccctaagacataaggtgccaaagttcaattgtgcatggcgacgtcctaccctcgcagggagcgatcccccaactactctcggcgcttagaagcttgacttctgtgttcggcatgggaacaggtatatccttctagccatcatcaccacactatgcactgtatgctacgatgtcgatggaactaccgcgaaaatcgcgagttccaatcgcactagcacttacgtgctgagaacttgcgctctcaaaactaaataatatctactctttttcttaacagccttcaccgctacttggttaagtcctcgaccgattagtattggtccgctccatgcatcacatcactgcacttccacttccaacctatctacctcatctctgaggggtcttactcttcccgaaggaagatgggaaatctcatctcgaggcgagtttcacacttagatgctttcagcgtttatctcatccatacgtagctacccagctatgctcctggcgaacaactggtacaccagcggtatgtccatcccggtcctctctactaaggacagctcctctcaaatttcctgcgccgcgacggaatag

SEQ ID NO: 422 - DNA, 11798 bp, Unknown
  Metagenome-assembled genome
ctggttaggacgcctgcctgtcacgcaggagatcacgagttcgagtctcgtacggaccgtaacaaacaacaaaagaggaagttatgatagtgcttttatcataacttcctctttttattagaattaaaatgaaaatcgtcctttacctacgtattttatctatgtaaggggggacaacttatcaatatgcagaatttttcagcaacgatcaatgagtgcattgctaatcgaatttctgatctatacgttttaccacttaatgagcagtacagaatgttataccacaatgttcagggcgtgatgaccacaaagaagataagtttggatgcgggtaatcagcttatctcgtatttaaagtatcgggcaaatatggcagttagcgaacatagacgtccgcaggttggtgctttggttatggaggaaaagggcgaaattattaatttaagattatcgtccgtcggtgattatagcggaaaagagtctttagttattcgcttcatttattcatttgagagtatcagtcatcaacaattaattccaaatcaattgggaatgctgcaacaattagtacggcatagggggttgattctattttccggtccgatgggatctggaaagacaaccacgatgtaccaacttgctcgaaaagctatgaaaaatcgggtagtgatgacgattgaggaccctgtggaaatcgaggaaaagaattttatccaactgcaggttaacaatcaggctaacatgtcatacgatcagctattaaaggttggactcaggcatcggccggaagcttttataatcggtgaaataagagacacgttgaccgctaagatggcgattagagctgcgctgagtggccatttagtattatcaacagtgcatgcaaaaaatgtatttggtgtaatttcacgaatggagcaattaggggtggaacaatcgtatttagcccaggttttgacaggagtgtgttatcaaagattattaccaacgactcaagatagtattgctgttttatatgatttactggctggagatcaattaaatttagcagttatggataaaaataatagacctaatcgaatgactgcacaatggagcaactatttagaagaaggagttaaaaagtgtgaaattacgcgtacgacagccaaaacatatcaagaaggatagtttaagtattagacagcaagcacggtggttttccttaatgggagatttgttacgagtgggcttttcattgaagcaggcattaactttttcaacaacgctaatgccagagagtacaaaaatttttgaagagatcgatatgagtatggccagtgggggttccttttctaaaagtacgcgattatttataggtcaagatatctactatcaattattactcgctgaacggcatggagatcttggccaaagtattacacagattggccaatttttaacgattagcgttaaacaaaagactaaattgaaaggactactacagtaccccgctattttactgtcgttgttgggcgtcctgttggcagtgctgaaaatatttattttcccggaactatcaacgtggcaaaacgaacaagagacgcaatataatttattcgcgttttggccttggatgctgttaggaattttgataggtgttatcggaatcagtagttcgattatatatcgatggctcaagtcttcagcggtcaatcgagcaacgttactttgccaattacctttaattgggaaaatctatcgtgaatactacgcttattatttaattactaattttgcactattacttcaaaatggaatgggggtccgagaaatttgtgaattatttgctagttttgataagaagtcactattgaatcagttaggatcacaactagatcaagttttgatgaacggaaaaccgccaattaaaataattcatgactacccctatttaccgcaagaactaattgtatttatgaataagggagaaactgttgaagaattggggaagcagttaactattttttctagtttaattttcagccggttaattaaaaaaattgagcagttgctggtactcgttcagccaattttatttggtatcattgcggttgtaattgtaatgatgtatctgagtatcatgttaccaatttatcaatcaatgaaaggaatttattaatatgattagtaaaataaaatatatagtaggccaaaaacgcaaaggttttacgctaattgaaatgagtattgttttatttatcattagtttactagttttaattattttgcctaatttagcatctcaacgtaagcatgccaacagtgtgcataaaagtgcgatggtgtcagtagttcaaacacaaattgatctatatgaaaacgagcatggtgacgggagtgttagtttttcagatttagaaaagggtgactatttgacaaatgcacagattgaaaaagcacaaaatgaaaatatttcgattactggcgataaggctacacaaggaaagggataattttttaggttttacattgatcgagtcggtgctagttcttggattagtggccttaatgatgtcatttgggacgatatatggacatcatgtcactcaagtgaatgcagaacgtcagttttggcaagaactagaacaaaattggcatgccagtcaagtgcgagcccgcgaaggaagtagtgccattaatattcgatatgttaatggtgcgattcgatttcagtggtgtgatattagtaatcaaaggttatatcgagaggatgttaccattccagcaacaattagtgttggaaactttaaaaaattacagatgatgcccaacggatatgtacaagctgggacacaaagatttacctcgtcgcttacgcataaaacgtatcttatgaaagttcagttaggatggggagggtaccgaattgtcacacagtaggagcgggtttgtgatggcggatgccacggtcgcgttgatgattctgacagtgtgtgtggcctggttttgtatatgcgaacagcaattacaaaaacaaatgcaacgagctagtcaagaaatatatatatcccgaattggtaaagaagtggcagatcgttattatgatagccaccaaccagtaacagagcaacgaggaaaatatacagttcgggctatggcggataaggttgtggtaatggaaggagctaaaacgagattgttaatcaccaaacaataaagcatggcggttttacattaatagaatgtatgctgacctttttaattgtcgcactgattgcgatgctagcaaatttaatagtccaagtatcacgaaccagtcaaaaaacaacctttaatgatgatttacagtggtatttattcgtacgtgaactggaatcggatacgcatcaatttgaattgacgcatgttggtcgatatgaactgatgttacgaagtcgcgttagtgcgaagtcgtatcagttggagtgtaaagatgatcatatgtacctgacgttaagccataatggtggcggttatctaccactgatgacacatgtcaaaatgtatcatccagaacagctttcaagatctcaagtacagattgcagtcgtcatggatgatggaagtcagcgaattgcgagggtccatttttatccaatgttatccgcgggagatgccaagtgaaatcacgatcaggatatgttttagtaaatgtacttattttgattgcaatactaactagtattcaattgatgttatatcggcattatgcgcagcagaagcaatctttgacaatgctaaaaaatgaatttatttcacaagcgatgatcgatttacaggcgggtgctgatgatccggttgttagcttcaataccggaaaagtgattgtgaatgataaaggattacaagttcagcttaataatggttataagtatataagtagaggtaatctcgtaccttgaatttattccctaaaatctgtaaactggtgtggtagcaaagttttagagatgggagtggaagaaaagctggcacaagaaaatactgaaaaattgtttaagctcattgatgaatcagtcatgttacttaagcaatcactttcaagctcatacctcgatgcgttcatcgaaagtgcggataatattattgctggtgaagttcaagtagaagatggtaagccaactcaagagattatcaagcaactcaaccaaatttatgcgcaaattgatttggacaacatagatgcggaaaccatacgaacggtgatccaactgagtatgctaaaagcggtcaagcaagatgctattcagcctaatcatcaaatgacaccagatacgttggggttcctgattgcttatataatcgaaaaaattggtatcaaacaagatgatgcttctattttcgatttgagtgtcggaacagggaatcttttaactacggtaatgaaccatttaaagcagacgactggcaagaagattcatggatacggtattgataatgatgattcaatgcttgcagttgcgagcgtgagtgtggagatgcaacagcaagatattgagttgtatcatcaggatgcaatcgattctttggatatcccacaatgcgattacgttgtatcggatttaccagttgggtactatcctttggataataatacggatcattatgaaactcgagctgaaaagggtcattcctatgttcatcatttactgattgaacaagcaatgaactatttaaagcccggtggatttggtgtattcttaataccaagtgatttgtttaaaacagatgaatctaagcaatttgttgaatggattcagcgtcgagctcatttacaaggacttgtcaatttaccaagtgagctatttcaaacaaaacaggcagaaaaatcaattttattacttcaacgacgaggaactaatagtcatcaagcaccaaaagtattacttggacagttcccatcctttaagaaaaaaacagagtttgccaactttatggttgaaatagataactgggtaaagactaatttgaagggttaaaggagatataatagtatgtcaaagacaattgccattaatgcagggagttctactttaaaatttaaactttttgaaatgccaagcgaagaagttattgctgaaggcgttattgaaagaattggattgaaggactcacttgttagcatcaagtatggtgatggtaaaaagctaaaggataccattcaagcaactaaccatgaagtagcaatcaactacttactgaaacaattgattcaacttgatattatcaaggacttcaatgaaattactggtgttggtcatcggatcgttgcagggggagaattcttcaaggattctgttttaattgacgatgatgtgatgcaaaaaattgatgaattagctgactacgcaccactacacaacccagctaacttaattggaattaaagcatttaagaagattttacctgatattacttcagtcgctgtatttgatacgtcattccacacggatatgccagaagaaaactatctctacagcattccttacgaatggtatgaaaaatatggtgctcgtaaatacggtgcacatggaactagtcatcgttacgtatccgctcgtgctgctgagattttgggtaaagatgttaaagatctgaagatgatcacgttacatttaggtgccggtgcatcgattacagccgtcaaagatggtaaatcattcgatacgtcaatgggcttcaccccattagctggtataaccatggctactcgttcgggagatgttgatccttcgctgattgcatggctggaagagaaacttaacatttcttcagaagaaatgattgatattttaaaccataaatctgggttggttggtgtttcaggtgtttcagctgacatgcgtgaccttgaacaagtaatggacgagaaccacagagctaaattggctcgtgatatctggattaatcgtgtcattcgttatattgggcagtacgctgccgagatgaatgggttagacgttttggtatttacggccggcgttggcgaaaatgatattgaaattcgtcaaagtgttgcggatggtctgtcattctttggcgttggcattgatcctgaaaagaaccatattcgtggtgttgaacgtgatttgactgctgatggtgcgactgtcaagacattactcatcccaacagatgaagaattaatgattgctcgtgatgttgaacgcttaaaaaaatagttatttgagatataatggaaggatcagggagacctggtcctttttattatatagaaaatcaagggagcttaattgaatgcgttatgtaacttcggatactcatttttttcatgaaggtttactgggaatgagtgattttgcacccagaccattttcaacagttgcagagatgaatcaggtgattattgatcactggaaccaacgagttcagtcaactgatacggtctatcatctcggcgatattgcgttatactttacgaaaccagcagttaagtcaaatgaagcagtttttgaattattgagtcgattaaatggtaatttagtccttatcaagggaaatcatgatagtcgtgatttatttaaatatcttgctaaacataattttcaggttaacggaaaaccaaagttcgagtttcacgatgttggcgtattaattaagtttgatcatcgtcagtactatatgacccattatccaatgatgttggggattgcaccgcagattattaatctacatggacatattcatcactattcagtctccgcgaaggaaaatatcaatgttggtgttgacacaccagaggccggctatttgaattataaaataccgtttggcacaccattttcattgggtgatattgagatgatggtacaacaaaaagcaattgattttgccaaacgacattgatcgattgccgtaaaagtagcacaatcgcagtagagattaatgggggataaaaatggttgagaagattacaattttacacacaaatgatatgcattcacactttgaaaattggcccaagattagacgttacctgttgacacaaaaagaagcattgactagcgccaatagcagtgttttaacatttgatatcggggatgcaatggatcgggtacacccactttcagaagcaacggatggtcaggcaaacgttgcgttactcaacgagattcactatgatggggtgacgattgggaataacgaaggactgggaaataataaggaacaacttagccatttgtatgatcaagctaattttgatgtaattttgggaaatttattggataagaccaatcaacaacttccgaattttgctgaagatttcaagattatcaaaactaaaaataatacacgtgtcgcagtattaggactaacagcaccgtttattttaacttatccgcttgaagggtggcagccaattgatgtgtttaaggcaattccctatctccttaaacgtattgaagggcaatatgatgtactggttttgctatcacaccttggattgtcggtcgatgagcagattgcaacccgtttttcggattttgatgtgattattggtagtcatacgcatcatttattagaacatggtaagcgagtcaaaggaaccttactagctgctgcaggcaagtatggtcaatatattggaaaaatcgatctcgaactggcagatcatcaggtcatcaattctcaggcgagagttgctgtgacagagcatttaccagaagaaccaacggatcatgtagaaattgaatcgtatcgaacaagaggcgagcaattgcttaaacaacagcaaattgctcgtatcccagaggatttatctgttgattttgaaaatagtactaaactaattaatgttggtttaaaagctattcaagaagcaacgggagcagaagcagcgctattaaatacggggctgtttttaacgggaattaatgcgggaattgtgaatcgtaatcaaatgcatgagatgctacctcatgcaatgcacgtgatgaaagtgacattatccggggccaatttaatccgtttaatccgagaagttgagaagaaccgtaactttttacggcgatttccactgaaaggaatgggatttcgtggtaaaatttttggagaagttcattacgatggaatcgaattcgatccaattcagcaacaagttttttatcgtggtgaacctgtgaatatttttgagcaatatacgattgccagcttggaccattatttatttattccgttttttccaacgattgaaattgcaggaaaaaatgaactaatgtacaataaattttttcgagacgtggtctcagattatttaacgaaacattttccgattgattaatgtaggagggagggataccttgaataagcaaaaaatacgggaactgatagaacagcgtgaacaacaacgtgctgatatttatcatgttgaaagaacagataccgatgcttttacagttaatgggcatccgtacaagttacttaaagattataaagaggcatttgatccagataaattagctgatcgttttagtacaattttgagtaaatacgattatattgtcggcgattggggatttgaacagctcagactgaagggcttttatgctgttaaacagcctggcactcaaccggctgagctagcggatgcaattcaagattacttatatgaatactgtaattttggctgtgcttactttattattcaaaatttagatgttcaggttgtccatccggagcatactaagcgtcgtcgtactaagaaaaacggtacaggtaatcatggagatgctcgtaacaacaagaaggtaaacgagcaccacgattatcggaagaaaaagcagcataagcaaaatacaaccagtaagcataaaaaaggaccgcagatccgagaacggacaacgagtgttaacccagtaccagtttctaaaagaaaaaatcaagaagtggtccgagaaagtggcaccaaaaagaagcaaaaatttgtaatacgacataagtaggcagggagaatttatgcagtatcagggatattttattgatttagacgggacaacgtataaggggaaaaaacaaattcctgctgcggcacgtttcattaaacggttacaggataaaaatttaacggtgatgtttgtgactaacaacagtacgcgttcaccggaatttgttgccaacaatttaaaggataatcacaatattaatgtgacatccgccaatgtttatacaacggcgttggcaacagccgattatatggaccatattgcaactaattcgaagagaacggtttatgttgtcggggaaagtggccttaaacaggccttattggataagggatttcgatttgatgaaacatcaccggattttgtggtcgttggtttggattctgatgtgacttatcataaactcgaacgtgccgtacttttaattcgcgctggggctaaatttattggcaccaatgcagacagcaatttacctaatgagcggggaatggtgcctggagccggatcacttgttaagctagtagaatacgcaacgcagactaaaccaattatgattggtaaacccgagaagattatcatggaaatggcgttagaaaaaagtggcctttctaaagatgaagtgattatggtgggtgacaattaccatactgatatcagcgccggaattaatgttggtatggatacattaatggtttataccggtctttcaaaaccggaagaggtggctcaacagcctgttcaaccgtcatatcaggtggattcgttagatgaatggaatttggatgaacattaagaacaacataatggttgtactaaaatggtgcagtttaattctgtgcctagttagtatggctatttttttaacattgaattttagtatcatattcgtattttttagtcatcaggagattagtggcgtgacacacggtgaaattctgcaagattacggtcatttattactatttttgcaggtgccggggatgcatacgatcaattttcaatttattccaatatctgtaagcggtaaaattcattttagcgacgtgaagcaactgattttgctgaatgagttaattttgataattacgggctgcttaacgtattacgagataagtcgacaaaaaaagaagcatcaactttggcggttgatgcttccaattaagggattagttgtttttattccaacgatgatgttaattttactgattaactttaatagttggtttattaaatttcatgagttggtttttagcaatcaagattggatttttaatcccactactgatccgattattaatgtgttaacggagaacttttttggactgtgtgtaatcgcgtttacaattttgatagagctgatgttgggggttctttactatgctgggaacaggcagctttattagtcactaacactaagcttggaacggaagaaaccaacgactgctgggataagtgttacaacgatgatgccgataataatagccgagaagtgttcttgaacaaaaggaaggttaccgaagaagtagccacacagtgagcaaattgagacccaagaaatacagccaattaaactaaaacgaataaaacgtttgtaagggaaaccagatccggcagaagcaaatggtgcaaaagtacgaataataggcatgtagcgtgcgaggattattgccggtgcaccatgcttttcgaagaattgctctgttttagcaagactttttttatcaattaacttaccaaagagtgagtgatcggataaagtttttccaattttatgcccgatgtaaaagttaagcgagtcaccagcaatacaagcaatcagaaataaaataaagaatatcgtaatgcttagattgtaattttggttggcagcaagtgcactggccgcaaatagaagggaatcgccgggtaagaaaggcataatgacgattccggtttcaataaatacgattgcaaataagattagataagaccaatcaccaaagttatttacgagtgaaataatgtgtgaatcaatgtgtagtataaaatcaattaaggttgacaccagatagttctccttttatttagttttccatgtattaaattaatcgggagtaagtatatcatgtttttaaccgaaattataagttcttagcgaatttcacatttatttaagatactggacttaatgttgcattgacgattataataggcagcagttaattacaaggtgcctcgctcaacaaaggagagattaatttgacaaaggttgcaagtacaattgtgttaagcaatgaagtaaagacgacgtttttggttgatggtagcgaaccgttccatttcctctcggtagacaaaatggataataagactgcattggcaacgacactagcttatttaagagaaacggttggtatcaatgtagaatgcctacgattagaagaactatccatcacactcgatagtgagaaacaatcattatttgttttttcaatacatgatcgtgccgatgaaatcatcaagcagtgtcagaactttaaccatctaaagtttattgatgttagccaacttcaccacttatttgaaaccgttgaaatggatactgcacctttttttgaataaatttaaaattttgcttgaccacagaatgaattcttgatatgatatttactgttgtcaaggcgattagttaagcgcttcgataatggtggtagacctttgaaaactgaacaaagtttcgacaaatcaaatgtgtagggtcctttagcccgtagggttaaaggcaaaacatttgcgaagtcaattcgcttaaagtaacaaatcaaaaagagctaa

SEQ ID NO: 423 - DNA, 6279 bp, Unknown
  Metagenome-assembled genome
caggtagtcaggagagaatcctaaggtgaggcgatgaactctcgttaaggaactcggcaaaaatgaaccccgtaacttcgggagaaggggtgctgcacgtcagtgcagccgcagtgaataggcccaggcgactgtttatcaaaaacacaggtttctgcaaaatcgtaagatgaagtatggggctgacgcctgaccggtgctggaaggttaaaaggatggttagctcggcgaagctcagaattgaagccccagtaaacggcggccgtaactataacggtcctaaggtagcgcaatccttgtcgggtaagttccgacccgcacgaaaggcgtaacgatctgggcactgtctcacacgaagactcggtgaaattgatatacctgtgaagaagcaggttacccgcgacaggacggaaagaccccatggagctttactgtagcttgaattgagtgtttgtaccgcttgtacagaataggtaggagcgtagaggccgggacgctagtttcggcggaggcattagtgggatactaccctcgcgtatgaccactataacccgcaccactcatcgtggtgggagacagtgtcaggtaggcgtttgatggggcggtcgcctcctaaaaagtaaaggaggcgcccaaaggttccctcaagaatggttggaaatcttcgcagagtgtaaaggcacaagggagttgactgcgagacagacaggtcgagcgggacgaaagtcgggcttagtgatccggtggtaccgtatggaagggccatcgctcaaaggataaaaagctaccctggggataaacaggcttatctcccccaagagtccacatcggggaggtttggcacctcgatgtcggctcatcgcatcctgggggctgtagtcggtcccaagggtgggctgttcgcccattaaagcggtacgcgagtgggttcagaacgtcgtgagacagttcggtccctatccgtcgcggggcaggaaatttgagaggagctgtccttagtacgagaggaccgggatggacataccgctggtgtaccagttgttccgccaggagcatagctgggtagctacgtatggatgagataacgctgaaagcatcagtgtgaaactcgcctcgagatgagatttcccattccttcgggaagagtaagacccctcagagatgatgaggtagataggttggaagtggaagtgcagtgatgcatggagcggaccaatactatcggttcgaggacttaaccaagcgcgggtgaaggctgttaagaaaaaggtagatatatttagttttgagagcgcaagttctcagcacgtaagtgctgtgtggtgatgatggcttagaaggatatacctgttccccatgccgaacacagaagtcaagcttctaagcgccgagagtagttgggggatcgctccctgcgagggtaggacgtcgccatgcacgataaccgttagtcggaagactagcggtttttttattgtgttccattaacgcgtaaatgacacggagttgtcatattaaattgggtttaataaagataccgataaatacaacccgcaaaagcatgtttatttggactaaaaaatgcaaaaatagttgcaatacattgagcaatagttgctgaaggtcatgtaatttaaattgaaacatgctagactagcactataacgaaaatttgggagtgacgatagtgatgatgaatgggagtaaacggtttaaactatataagtcaggcaaaaagtggttaatcgctgcaatttctgcaacaactatgatgacttttggcggtatggtggcgcatgcggcgacggatgcctccagtaccgcacaaacagaggttgcttctgcagccactagttctagtagtgctagtacaacactggataatactgattcagcaacatctgctagttcagcgcagactacagccacgccagctactgttgctagtacagctacagcaactgtgcaagcagcagtggctgcaactgaggaaacttcgactgcgacatcggccgcttcttctgccagtgatggtagcataacaacgacgtcagaagatacacaacaagcagcattaagtcaggttaatgcagtacgaagtagtgctgcaagcagtgatagtgccattagtgcagttgctttaaatgatgatttaaatgcgtgggcgcagactcgtgctaatgaaatggcggctaacaacggccagctagatagtacaacgcagtatagtagcgcaccgacatgggtgtcttctgatggggtaacatcaacagatttacagcaatcacctaattatgaggagggtgatgcggtttatggcagtgaactgacgagtagcatgcagtattggtatacaagtgtgcaaacgagtgaatttctaggttatttcgcgggagatccaacagattttacaacgctttcggttaataactggactaatagtattaactatgatgcatataaatatcagtatttgacgatgacttcaccgtatgcaaacgtgatgggatatgcgtacgcctataatgcgacgactggatatacggcggtcgtcttggaagtggcctatttaccagatattaccgaaacggaaactaaaacagttacccgaactatcaattatctcagcaaaaatacgtctgaaacagtggcagattcaatcacacaaaccgtaacttatacccggattaaatcaaccagtcaagttgatggtaccgtaacgtattccgattggaccagtacggatcccacttttgcggcggttgagtctcctgatttaagtgcacaaggatataccacaggagatccagctaccgtggcggcagcaaatacgactgcagagacaccgtcagaaacggttactgtgtactacgacgatgctgaaactactgcaactgaaactaagacagttactcgaacaattaactatctggatcaagcgacaaatgcggttgtgagtccagctaaagtgcaaaccgtgacttatacacggacagcaacaacggatgctgtgacgggagatacgacctatacagactgggccagtgcggatacgacctttgaagctattgattcgcccgatttaagtgccgatgggtataccgctgcgagtgaaacgacggtagctgcattatcgacaactgccgatctggctaatcagacggtcgatgtatactataatgccgcgcaagagacggcaaccgagaccgaaaccattacccgaacagttaattatttagatcaagcgacaaatgcagtggtgagtcccgctaaagtgcaaaccgtgacttatacacggacagcgacaacggatgccgtgactgggaacacaacgtatacggactggaccagcacagagcctacttttgcagctattgaatcaccagatttgagtgcggatggatacgcagtggcaagtgagccgactgtggccgcagcactgacaaccgcggaatccacggacatagatgttaacgtgttctacgatcatgccgtcaccgtaacgccagaatcaaaaacgattacccgaacaattaattatttagatcgagtaacggggacagtggttagcccagcacggcagcaggaggcaacatacacgcgcacggctactactgatcaggtaacgggggcaattacctatacaaactggacaagtacaaatgcaacctttgcagccgtagcttcaccagatcttagtgcagacgggtacacaactgcaagtgaggcaaccgttgccgcccaaactgtagcggctgatgacgctgatagtgccgttaatgtgtattatgaccatgccgttactgtcactccagaaactaagaccgttacccgaacgattaactatctggatcggacaacgggaacggtggttagcccagcaaaagtgcaaacggtcacctttaaccggacagccactaccgatcaagtaacgggaacaactacggacactgattggataaccacagacgcaatttttgcggctattgaatcaccagacttaagtgcagacggatacgcgcctgcaagtgaggcaaccattgccgcccaaactgtagcggttgatgacgctgatagcactgttaatgtgtattatgaccatgccgtcactgtcacgccagaaactgagaccgttacccgaacgattaattatctagatcgagcaacgggggcggtggtcagtccagcaaaagtgcaaactgtcatctttaaccggacagctactactgatcaggtaacggatgtcaccacatatactgattggacaggaacagatacgacctttgcggcagtgacctcaccagacctgagtgccgatgggtatacaactgctagtgatgtgataacgttggctcagactgtgacagcaggagagccggacacgactttgactgtctattatgggcatgcaacaacgacaacaactgagtcaaaggcgattactcgaactataaagtatgtagatgcagcaactggtacagaaatcagcgatccaaacgtccaaacagtcacctttacacgtaatacaacacttgataatgcaacaacgacaacgacgtatacggactggacaagtgaccatgcagggtttgatgccactacatcaccgaaaattacgggctacactacgaatacagccacgactccggctcaagccgttacaattgatatgccaaatagcactgtcattgttgactatgatgctacggttccggataccgataataatagtttgccagagtcaacggcaccagttgcttcagcgtcggctgaaccagagagtactgcagtctcagctcaaccgatcgcacaacctgttgcaacaccagcagcacagtcaacggctgttagcgaacccgtgattgctgagggtacaccggaaattcaagttgcacctgcagcggttgcgaagccagcagcaaaggcagcgactacgaagctaccacagacagataatgccaaagatggcgaactagttagtctaggagtagtgacgctgatgtcactctttggcttggcgggtgttttgaaacgtcggcagacgaaataaatagaatatttgttttgatatatagataataaattaaagagattgatttttccaaagcgtggaaaatcaatctctttttgtaaacgaaagtaaatttttagccgacgatgataaacatgttgataaaacacgtattgaaatttacgataatggaagctaaattagcggacaaaagtgatttatttgcattataaaaccagagttgtaatgataaaacgaaaaaaagtctaaaattagttgacgagatacgaaaagccgtgtatagtaattaatcgttgtcaccgacgttaacaacaccgtgatcaaaatgatcaagaaaaaagttgttgacattgaattatcaatctgttattattaataacgcctcttctgcactcaagtatccagtttccgatgccactcttcgggttaacgaaggcttatcacatcagacttaaaaaaaccgcctgcgctcgctttacgcccaaacaatccggatacggcttgccacctacgtataccgcgctgctgccacgtagtagccgtggctttctggttaaataccgtcactaccataagcagttacttcgttaagatacgtttcttctttaacacagattttacgagtccgaaaccttgtcactcacgcggtgtttactccatcagctttgcgacccattgtggaaaggatcttcctctgacctgcctccgttaggagttgggccgttgtctcaggccattgtggccgatcaactcgccagttcgtgctatgtacattgacttggtaagccgttactttaccaactagctaatacaccgcggggtccatccagaagtgttagcacaaaggccatctttcaaaatagaaccatgtgtttctattattattaagcggtattagcatctgtttccaaatgtatcccccttctgggcagggtacccacgtgttactaacccgtccgccactcattcgatggtttaatcaatccggtgcaagcacctttcaacaaaaacgggaatgcgtacgactttgctgtattaggcacccgccagctgtatcctgagccaggatcaaaccttcatataaaataagaagctgttagtctttttttcgatttgtctttaagcgaaatgacttcgcaatggtttttgcctttaaccctacgggctaaaggccctacacatttgatttgtcgaaaactttgttcagttttcaaaggtctaccatgttgcgtccttttgaatcagca

SEQ ID NO: 424 - DNA, 977724 bp, Unknown
  Metagenome-assembled genome
ctcatccatacttagctacccagcatgccctggcgaacaactggtacaccgcggtagtccatcccgtcctctcgtactaaggacagctcctctcaaatttcctgcgcccgcgacggatagggccgaactgtctcacgacgttctgacccagctcgcgtacgctttaatggcgaacagcccaaccctgggaccgactacagccccaggatgcgatagccgacatcgaggtgccaaacctccccgtcgatgtgactcttgggggagataagcctgttatccccagggtagcttttatacgttgagcatggcccttccatacggtaccaccggatcactaagcccgactttcgtcctgctcgacctgctgtctcgcagtcaagccccggtgccttacactctcgaatgatttccaaccattctgagggaaccttttggcgctccgttactttttaggaggcgaccgccccagtcaaactgcctacctgaccctgtctcccccacgatgagtggtgcgggttagagtggtcatacagcgagggtagtatcccactaatgcctccgccgaaactagcgtcccgcctctacggctcctacctattctgtacaagcggtacaaacactcaatatcaagctacagtaaagctccatggggtctttccgtcctgtcgcgggtaacctgcttcttcacaggtatatcaatttcaccgagtccctcgttgagacagtgccagatcgttacgcctttcgtgcgggtcggaacttacccgacaaggaatttcgctacctaggaccgttatagttacggcccgccgtttactggggcttcaatctgagcttcgccgaactaacccatccttttaaccttccagcaccgggcaggcgtcagcccctatacttcatcttacgattttgcagaaacctttgtttttgataaacagtcgcctgggcctattcactgcggctgcactgacgtgcagcaccccttctccgaagttacggtcattttgccgagttccttaacgagagttcctcgctcaccttaggattctctcctcgactacctgtgtcggtttgcggtacgggcagttaactatcactagaagcttttctcggcagtgtgacatcggcaacttcgctacttaattcgctccccatcacaacttgtcgtatagattaagcatttcactctaatcaagacttgctgcttggccagacatatcaacagtcggtttgcttagcctcctgcgtccctccatcgttcaacacagttaactggtacaggaatatcacctgttaccatcgtctacgccctttcggcctcaacttaggtcccgactaccctgggaggacagccttccccaaaccttgtcattcggtggacagattctcacttgtctttcgctactcataccggcattctcacttctaagcgctccaccagtctcacggtctgacttcattgccttagaacgctctcctatcagcatccttacggatgcatccacagttttcggtaatatgcttagccccggtacattttcggcgcaggatcactcgactagtgagctattacgcactctttatgatggctgcttctgagccaacatcctagttgtctaagcaactccacatcctttccacttagcatatttttgggaccttaactggggatctgggctgttccccttttgccgatggatcttatccactcaccgtctgactcccggacataaatcaatggcattcggagtttatctgaattcagtaaccagacgggccctagtcaaacagtgctctacccatgattcttattccgaggctagccctaaagctattcggagagaaccagctatctccaagttcgttggaatttcaccgctacccacacctcatccagcctttttcaactgacacgggttcggtcctccagtgcgttttacgcaccttcacctggacatgggtaggtcacctggtttcgggtctacaacaacatactcatacgcccatttcagactcgctttcgctacggctccggttttgccaccttaacctggcatgcaatcgaactcgccggttcattctaaataggacgcggtcacccattacgggctcccactgtttgtaggcacatggtttcagaactatttcactccccttcgggtgcgtttcacctttccctcacggtactggttcactatcggtcactagggagttttagccttgggagatggtcctcccggattccgacgattcacgtgttccgccgtactcaggatcctgaactgagagtaaccgttttcgtctacgggattatcaccctctctgatatagcttcccagctatttcgactacgtctcactttggtaactcaaagttcagtcctacaaccccaacaagcaagctcgttggtttgggcttttcccgtttcgctcgccgctaccagggaatcgatttttctttctcttcctgcagctacttaatgtttcatttcactgcgtcacctctacttagctatgttcactaagtagtaactaacgaactaagttagttgggtttccccattcggaaatctccggacaaagtgtacttaccactcccgaagcaatcggtgttagtcccgtccttcatcgccctagtaccaaggcattcaccatgcgccctttataacttaacctggctttgaccacgtctgtggtcgccacagattaattgagtatacgcgatgaatgtaattcattaaaaaactcaataacgcggtgttctcggttgttttaaaaaatatttcgatattatttagttttcaagtacatttatgagggtaaacccctcaaaactaaacaaagtttcatgtgacaagtcaaacgtgcaaggttccgtttattccttagaagggaggtgatccagccgcaggttccctacggctaccttgttacgacttcaccctaatcactctgtccacttaggcggctggctccccgaagggttaccccaccgactttgggtgttacaaactcctcatggtgtgacgggcggtggtgtacaaggcccgggaacgtattcaccgcggcactgctgatccgcgattactagcgattccgacttcgtgtaggcgagttgcagcctacagtccgaactgagaacggctttagagattagcttaccctcgcgagttcgcaactcgttgtaccgtccattgtagcacgtgtgtagcccaggtcataaggggcatgatgatttgacgtcgtccccaccttcctccggttttgtcaccggcagttcaccagagtgcccaactaaatgctggcaactgataataagttgcgctcgttgcgggacttaaccacatctcacgacacgagctgacgacaaccatgcaccacctgtcttagcgtccccgaagggaacgtctcatctctgagattgcgctagatgtcaagacctggaaggttcttcgcgttgcttcgaattaaaccacatgctccaccgcttgtgcgggccccctcaattcctttgatgttcaaccttgcggtcgtactccccaggcggaatgctaatgcgttagctcagcactgaaggcggaaacctccaaccttagcattcatcgtttacggcatggactaccagggtatctaatcctgttcgctacccatgctttcgagcctcgcgtcagttacagaccagacagccgccttcgccactggtgttcttcatcatatatctacgcatttcaccgctacacatggagttccactgtcctctctgcactcaagtttcccagtttccgatgcacttcttcgttagccgaaggctttcacatcagaactaaaaaaccgcctgcctcgctttacgcccaataaatccggataacgcttgccacctacgtattaccgcggctgctggcacgtagttagccgtggctttctggttaaataccgtcactacctaagcagttactcttagatacgttctctttaacaacagagttttacgagccgaaacccttcttcactcacgcggtgttgctccatcaggcttgcgcccattgtggaagattccctactgctgcctcccgtaggagtatgggcctgtctcagtcccattgtggccgatcaacctctcagttcggctatgtatcattgcctggtaagccgttaccttaccaactagctaatacaccgcgggtccatccagaagtgatagcacaaaggccatctttcaaaatagaaccatgtggttctatctattatgcggtattagcatctgtttccaaatgttatccccacttctgggcaggttacccacgtgttactcacccgtccgccactcattccgatgttttatcaatcaggtgcaagcaccttcaatcaaaaacgggaatgcgtacgacttgcatgtattaggcacaccgccagcgttcatcctgagccaggatcaaactctcatataaaataagaagcttgttagctctttttgattgttactttaagcgaattgacttcgcaaatgttttgcctttaccctacgggctaaaggaccctacacatttgatttgtcgaaactttgttcagttttcaaaggtctaccatgttgcttccttttgaatcagcaacgttattataataacagattgataattcaatgtcaacaactttttcttgatcattttgatcacggtgttgttaacgtcggtgacaacgattaattactatacacggcttttcgtatctcgtcaacactatttttaaactattttgtaaattccattaaaaaagcatccccatcatcggacgagaatgcttttaccgcataatatctagaaaatatttaacttaccaatccgttccacggcctcgactaatcgttctggcggtaccagtagtccaattcgcacgtagccttcaccatggcggccaaacccgttggcgggtgccacagctacgcctgccttatcaagtagtaaatcggcaaacgattcactcgtatatccagcaggaactggcattagtgtatagaaagttccccccggtttaattgcctgccacccaatctttgcgctggcagccacaaaggcatcgcgtcgttgctcataacgcgccacgattttagcaatttcttcatctcgctgtggatcacgcagagcatccacgcccgcctcttgaatcgcaggaaatacgctcacaaacagatgatcctgaattaaattgattgcttcaataatatccggatttcccaccgcaaaggccaaccgccagccggccatgttaaaggtcttcgaatatgtatagaattcaatccccacttctttagcacctggaacttccataaaactaattggtgcctgcccgtcaaagcccaacgccccatacgcaaaatcactaataatgcccacatggtacttcttcgcccattccacaacgtgctcgtaaaattcacgggttgccacagctcccgtcggattattaggatagttcaaatagagtagcttcgctttcttggcaacggcctcgtcaatctgatcgacatcaggtaaaaagttgttttcttctaataatggtaccgtctgaaattcaacccgccccagtgcggcccctgaaagataatccgggtatccagggtctgggagtaaaaagagatcgcccgggttcatcagggcccacggtaactcaacaagtccaatcttggaaccacccaaaattgcgacttcactttctggttcaaacgttgccccatacttttcctgataaaaatcggctgcagccacttttaactcgtgtagccccctaaattgagagtacttatgattaatcggtttcgtaaccttttcctgggtactttttacaatataatctggggtgggcttatcaggattcccctgcccaaggttaatcacatccacgcccgaagccaccttttgattgaccttggcgactaagctagcaaaaaactgttttggtaatccctgcaataattgcgattcttcaaatttcattttcaatatccttcatttctacagctatatttttaacgatataattccgggcgtcgatccttgaaaactgggatttggccccgaaccgcctcaatttggctaaagtcgatggtggctagcttcaccttttccgtttcaccagcattagcgataatatttcccagtgggtcgatcacaagtgaatgcccgttaaagtgattgtccggatcatcccccacccgattgaccgccaccacaaacgcttggttttcaatcgcccgagcacgcagcaaaacttcccactgggcaattcgtggttgaggccattcagcgctgacatataatacctttgccccgtgtcgcgcatttgtccgcagccattccggaaagcgaatgtcgtagcaaatcacgcccacacttgcggcaccagccaattgaaaataattttctgttttaccagctgtaatgtactgttcctcattcatcaatccgaataaatgcactttatcgtacgaactaactaatcgcccctgatcatcaacgatataactagtgttatagaagtgatcatcgcgggccgtggcaaccgatccaccaacgatgttgatatggtgatttctagccagttcctgtaataactcctgcgtattctgaccattcgggtcggcaagaccgttcagctgatccagtgcgtacccggtattccacatctctggtaataccacaatatctgcatgttccttggctgcttcggcaatcacttgactaacgcgctcaaaattagcgcctggattggcaaaatcgacatccatttgtgctagtgctactgttaatcccattttttcataacctcccgtcaaaaaaagcactcgtccttacaatatgtaaaggacgagcgctaacccgtggtaccaccttggttcactacttatttatgagtagtctcaattagtttcattaaaaaaatttaatgtcaccaaacgcttcataacggtagcgaccggtaccagctcgggcttcctcactcatacaatgctccgagaccatcttcgactagcaatccagcctggatttcaccgaccccaggtctctgtactgcactaactaggctactcatctcttcatgattttctaattatttactcatttattgatttcaagtgtagttgttttagtgactgccgtcaagaaccgaatttgaagttagctcggggcaactactttagccatactgcggccctgcccttgggcagtcacttgaatttgaaatggaatccgttccttcaacatatcgacatgactgatgatcccaatcattcggtcaccgctctcaatgttttctaaggcagccatggcggttgttagagaatcatggtccagtgacccaaatccttcatcgataaatagcgtatccacgctaattccaccggactcgttttgaatcacctcacctaacgccaacgccaaactaagggctgcaataaaactttcaccacccgacatcgtgtgaacactccgcacctttccaacattatcgtcatacacatcaatttcaagaccggtatttttctggtaggttcccgtttccatgtgcaacttcaataagtaacgtcctgagctgagttgttgtaaccgctgattagcgacctcaagaatttcaactaactgggcccgcaggacgtaacgttccagactaagcttagcatccccgttgccgttcaccgtttcaactaagagctgtaactccgaaacaagttgcgcttgttgttgaatattttgctgggcctgatcaatctgggtcaaaatctggtcattaagcaccaagcgatcatgggcctgattaaactgctgttttaatcgtagccgctcattactctgttgctcaattttcgcctgagcgaccgctaaatcaaccgtctgatgatcacccactaccttttgataggtcgcaactcgcgcttgactatcttggacctgatgttcatacgtggcaacctgctcctgtcgcgccttcagttgtgtgagttgcggtaaaagcacttgatactgggccacattatcaagttgcagcgtgctggctaacacatcttcaaacgccgtccgggccgttgccagctgtgcttgggtcgtcgctattgtctgctgcagctcggctaaagtacccgtcgttgtggcaatggtggcttggttactctgtacttgtgtttcagtctgagcaaccgcgtgttcatgctgctcaattacctgttgtaacgacgtcacatgctgatctagctgggccaagctcgtaaattcagctggcaagttcgtccggatatcctccaactgagtttgatacttttgttgctgttcacgtgcgtcttgcgctaccgcttgctggtgggtcaccgtgtcggtgagcgtcgttagctgcgcttcggctgcagcttgctcgtgttgtacctgttgcaaagctgtaatttgttgcgtaaccgtctctaactcatcttgatcagccactaacttctgttgattttgctgttgagcatcctccaactgggccggatccgatgcgataggagtcgaataagcggtcaaatgagcctgaaaagcggccaaatcctgcattaattgcgtttgttgctgggttaatcgtgttttttgttccattaactgtgttttttgctgaacaacctgcgattttgctaattgtagagccgtatctgcctgtttcatgtcatcgtcggtaaccacagtcacgccagcatggcgtgtcgctggggcgggatgttccgtgctcccgcaaaccggacagggggtgcccggtttgagttgactgactaaattcgcaatctgtccctgaagccagttgttgcgaatcgtctcatggtgcgcctgttcctgttgggcggtctgctctaattgatctaaccgtgtttgttcagtcgccaactggcgggctagtttctgatttgcacgatattggtcgctaaactgagtcaagcgtcgtccatcacttgtcaattgttgaacggcctgccgcagcgttcctagtcgttccgttaggttgggcaactgctgtaattgtgccgttcgctgttgttgctgcgccctgagtgttgtcatctgatcctcactcatcttgagctgctgctgtgcagcttgccactcgttcgtggccgtggtcaattgctgagtcaccaccgccagccgttcaaactggggccgctggtgcttaagaatcgaaacgcgctcgcggtgctgggcaatttgttcatcagccgcatgtaacgtttgttgctgctgttgcaaagtcgcgcgggtcgcatgtaagtcagtcaccttggtctgggtttcttgtacccgctgttgcagcgtcgcgattcgttgctcctgttgctggagcatttcgtattgtggctgaacatgttgtacctgttgcaactgctcaatttgttggcgattttcatcgattgtcgctttttgcgccagtagttcatgaagctgggcccgccatttttctagctgcacgatttgttcgttcatgttttgatctgcagtgagttgactcttggcccgttcaagttgctcttgtaccagttgctgttgtcgttcaatttcttgcaacgcttgatgcgcccgttgttgctgactagtcagtaacgtcattacctcttggtcttcgtgcgttgctggatcgaagtccgccgcccactgcaccttcgctatctcggtttcaatactactctgccagtcgcgtttttgatccgtttgctttttgagcttgtttttcaacgcctcgccccaacgctgaaaaagatccgttttaaaaatttttcgcagaactgcttccttgtcggcactcggtgcaaccagaaaacgctgaaagtcaccttgtgggagcaatacaatttggacgaactgttggcgggtaatttgcaaaataccggcgagatgccggttaatatcctgcattttagttatttcctcaacttttttatcgtgttcatacacgtctaagacgcccgagctgggaaattcacgttggccgccgcctcgttttttatcgagagtttgcttaggctgacgcaacacacgatattgcttgccctgatgcacaaaccataattcgacggccgttgcatccgcagaatcagcaaagtcggagcgcatttcctccggtcggcgatcatcactcgccccttctccgtagagtgcaaacgtaatcgcgtcaaaaatcgtggttttaccgctgccggtattccccgaaatcaggaaaatgggcgccgctgctaatttagtgaagtcaattacctgatgcgcgtacgggccaaaattggtcaatgttagttttaaaggtttcacgattttgtccctccatcattcgcaattttcaacgtttccttcgcccaactcatttgttgcgccgtgagggcctctttggccaccgattcgtagaaatcaccgagtaacgcgaccggatctttctggcgaatttgctttcccgacatcccctgactttccaccgcagtcgaatagccttcttcgcggctcagcgataccacgtttggataaatctcgcgtaaccgcggtaatgcgttgagaattggttttcgatcctgcaggataaagccaaagtagttctcccgatcaaattgcgcgtaaaacgtcggatcaatgaggtcatcaaagtgggccgtaatctgttgaacatcccgtaatggtttgaggggcttgaaggtgagctgaaacggatccgtgtcaatgatccacaccccttttgattgttgcgcttcggatagcgaaaacttaattggcgatcccgaatagcgcatgtggggttcgtgcagggcatccttcccgtgcaagtgtcccaaagcaacgtaatcaaagtcttttagtaacgccgcaggaacggaagctagtccaccaaccgttagttgcgtttccgaatccgttttagcactccccgccacaaagaaatgggcgactaaaatctgcttcttttgtggattaaattgggccttcatctgttcaactaccgataccatagcctggtctaggtggacgagcgtttcatcattaaagtactgttgcgcagcaaacggttcgaaatagggcaacaaaaaaatttgagtatccggtaactctactggtgtaaaggcttcttccagcttcgtcgccaggtaaaaattagtgctttggtaccacggattccccgttgccaaccgcgtcgcactatcatggttaccggaaaccgcatagagtggcagatggtccgttaagttgagtcgctgtagcatgcgatccagttgggcaactgacgtttctgctggcagactgcggtcatacaaatcacccgcaataatcatgccgtccacctgttcatccaatgcgatctgttcaatctgttgaaacgcatcctcctgctccgcggacaaatcaaatccatgcagccgtcgaccaatatgccaatctgcagtatgtaaaaaacgcatgcgtgataactcccttcgttgagtcgtattttttgtttactatcgatatttctaatttaatttgtactataacacgccaacatcatcttgcgctaattcagccctatcattagttgcccttcgcctacggtttgaagggccgtcttcttcatactcatgaaaaaccgcgacgattcggctactactccctgccaatttttcgaacgtctgttcgttttaattttatcatgccccacttcaaatgaacatcgtcttttcagtggaccgctaaaaagccgctgacaactgtcagcggccttcacctaattcttttttaatgtaccatcgttaagcgctctgttgcacacccgcggtaatggtttcgagcttcatcatggcatccttaaccgtctgcgcggtaattggtagtggaatgagattcatcgttttttcttcggtggttgcttcgtaggcaatcttctcaatatcttcatcgctaataccatccagattcaactcgtggaaattggttggtactcccagtgtccgataaaggggcaatagctccttaatatgatcgtaatggttttcgatcaccaactgaaccaaaataccataccccactttagccccgtgcaagagatgactcgtttgtgggaaaagggtcaaggcatcgtggactgaatgggcccccgttgaccgtgcgtatgaatcaccccagccaccaaccgtcccggccatgacgataatcgtttcggcaacgttgcgccaagtgtgggtcattcgtccggccttcatgtcttcaacggcttggatcgaatcacgcaacagcacgtcgcgacaattattggccatttgccgtgagatggtgagcgcaatggtaaattgttcttcgggcaagtcttcaaaaataagctccgactcgtagaacttggccaaggtatccgcaattccggcaacgaagtaatcgattggtgaatttaaaatcacttctggattcagcaacattaggttagccgtctccttgtaaatttcatggttaatgtgttcgccgttttccttgtaatgaacgctcaaggctgaccatggggcacagttactggccaacgtgggcatcagtaccaaatacatatgtgtgccggtcgtcacactcttcgcggtgtccaatactttcccaccaccaagcgcaatcaccatttctgtccccttttgggcggcaatattagcgacgcgatcgatttcttcataggaacactcgccgttaaataacacgtcttccaccgccacgttagtaccaaaatttggcagataaggcttggcggctgccaaagatttcgttccatgcaagaataagacttttgttaccccgagttctgaaataaagttgggtaactgatcatacgccttcgcatctgaaatataacgttgaggtccactttgtgaaatcatatcgcattctccttttctatgtttggtcggtaggcggtcgcccgtcgttggtcccatttaattaaattttttatgtaagttttgatctgctcgatcggaatacgattattagaatagcattaaaaaattaaaaatacaaacttttttctcattttattttaactttatttattggtgtgctagtttcaattaagattataacgtttcgttttaatcgggccggtgatccgtcttaagctaatcttcgttttttcttcatcccctaaatcacgaaaaaaatggaatcgtcttcttagatgaaagacgattccattttattttttagtccacttgatcccattttgcctcatcaatgccaaacggcacaactcggtcaaacgacgtcacaggcgcttcactaacctgatagaaatgctgcttgatcgctgtgaaatccgtggtttccttaaaggctggaatctggtaaaggcgtttggcgtacgcccacagattaggataatcaactaaccgatgcgcactcagcttgttttggtagtagtatacgatgtcaaatcgtaccaagcttacaaacagccgaatatccggtaccgttaacgtctctcccactaggtacggttgagttgccagcaagtgatcggcccactctaaccggttaaagaaccgttgtgccaactcatcgtactccgcctgagactgggctgccagaatttgaccgggcacttccgtcacatcagtcaaaataatctgattgatggcggctacctcgttagctcgctcctcgggatacaaatccagttcggtcgtttggtactgacgccagtaacgagcgaactcatcgagtagatcgttagattgattattgaccgctttaccggtggttacatcgaccagtgtgggaactgaggcgcggccgttaaattctggcgcggcctgttggtagctttccgataggcgggcggtgcccaagactggatccttcacactatcatcagccccataaacccaatcggccggcagtccggtccgccgtagcgcttgaaccgttccatcagaaacggcctgttccagccctaataaccgtaagacgatcgcaaccggtgtcgcccacgggcaaaacttgccccaaattaaccgataccggttcggttcaaccggtaactctccggtcgcaaacgaggccgttaaatcaagtgtcgccggtgtcgtctccttttgtgactgctcgggatgccactcacaagctgcattattttctgtcatctaactcaccctttcccttaaatgagcaacagggcccggtcgttgtgacctgaccctgttgtgatctcattttaaactacttgttatttgtaatgatgatgtcgctagctttgatgtctgaaccaaagtacggcttcaagttcttgttgtaatcagtcttgaagaagcccttcttgttcaacttggtgatttccttgtttgtccagttcaacaggcttgtattccccttcttaaccgctggcgaaatggtttggctaggtccaattgtcttgattcccaccgtgtaagttgggtgtttcttcacccaagcaaagaggtatgagttatcgtcagccaaagctttcgcacggccgttcttcaacgcattaaattgttgggtcttggaatcgtacttttgcagggtcacaccattagaatgcttcgtgaagtattcttcggcagttgtccccttcgtcacgatcaccttcttgcccttcaactgactagccttggtaactggactgctcttcttggaaaccacacccacggaaaccttcatgtaaggtttggcaaaactgacctgttgtttccgttccttagtaacagtgaagttcgcgaggacgagatcaaccttatttgacttcaaggcatctacccgactatctgcgttaacctgaacaaatttgaccttaacgcctaagtcctttccaatttgacgagcaagataaacatcgtacccggtccgcttaccactcttagtcacccagccgtaaggttgtaaatcaccgaaaacggcaattttgattgtcccgcgcttcttaatagcactcacgctggaattattggttgccgcatgggccttggttggcactgcagtcgctgcgactgacaccaccagtaaagtcgctaaggtagcgacaactgctctaaaaatttgctttaatttcatccctaatacctccaaattttggcttatgaaacctgttctactcctgataccctattctaacttcgcaaaaactctagaaatccatactactcaaaaagtcttgcgcccgttgcgtctgcggttgctcaaagaattgatgtcctgatgactcttccacgatcttcccgttctcgagaaagagaaccttatccgcaatttgcttggcaaagttcatctcatgcgttaccacgagcatcgtcatcttccgcgccgcgagtccttcaatgacctctagaaccccacgcaccatttctggatccagtgacgccgtgacttcatcaaatagcatgaagtctggattcagagtgagcgcacgcacgatcgcgattcgctgtttctgaccacccgagagttgacgcggataggcattctcgtattccgataactgcacttccttcagtaactgtcgggcctgtgcgagtgcctcattcttgtcacgtttttggaccttcagtgggcccaacaaaatattgtcgatcaccgtccgattaggaaaaaggtcatagctttgaaagaccattccgatatgttgccgaagcggctgccacttcttaaatccaggcgtaatcgtttggtcctcaaagttaatttgaccaccgtgaaattcttccagtccgtttaagcatcggattagcgtacttttcccggagccagaggggcccagtaagacggtcacgcttcctttttcaactgtaaaattgatatcgtgtaagacttcttttttaccgtaattttttactaaatgtgtcacggttaataactcattagccattggcagtgaccacctcctttcgttctagatgccgtgcccaaagggacagcgggtaacataaaataaagtacaggataaagatgaacccgtacacccaaaacgcgccattttcgtatcgttgaccgttagcctcaataatctgctgaccaatattgattacgtccatcacgctgatcagtaacagtaatgaggtcgttttgataatccgactaactaagttaatcgtcgccggaatcatcaactgaatcgactgcgggatcaatacatagtagtacagctgcaaccggttcaggccgattgccttccctgcgtccacctgatgcggggatactgaaataatgcctccccgcacaatatcgctcatttctgcggcaaaccagagggcaaataccagcatcgccatcgattctgcgcccatattgatgttaaaattctggggcaaaatataataaaataaaaatagcaagacgaccgttggaatcacccggaaaaattccaggtagagacgtaaaatcacgcgcaagatcggattatggagggttctcagggcccctaggatcagtcctagaatcaatccgaccacaattgccacaatggcaatcttagccgaaatccacaaaccgccgagtaggcgaaccatgttacggccctcaaataaaatattaattcccgaatgagccacgacgcgccctcctttctagccacgttagtagaattgaaagtgggatcaaaataatcgcgtacccaactaccaagctaaataatgcttcgttggtgtcgtacagcattccaatctgatccaacgccgtattcgtgagttctggaatggcgaccaccgtaaaaatagacgtttccttaatcagaaagatcacgttggccgcaatggctggaatactgagagacagtccctgtggcaaaaccacgtactgtgctaactgccagtcggtcagtccgattgcccgcccagactcaacttgaattttgggaaccccttcaagtccgccggcaaacgcggcggccatatagctgccacccaaaaagatgaggccactcacaccactggcttccgccgaaattttaaatcccaattctgggaatgcgtaatagatgaaaaatagctgaatcagtagtggtgtatttcgtgatagttcaacgtatgcccctaaaacccgctggagcaccggcaccttaaagtatcggacgaagcttacaatcaacccgacgataatggcacctaaaatcccccaaaatgaaagctttaaggtgatcataaaggctttttcatacgtcggaatcccctgttgaacgattgaccagttcattgggtcgaccacctcctaatatagttgctgtgaaaaattgtatttcaccttttatagttataccctattcaaacgcctttgcaagcgcctgatcgagatcaccaatcaaatcatcaatgtcttctaatccaattgataggcgaataatttggttattcatcgcgtgtttttgccgaatttcggcggggatttcacggtgggtcgtccgcgttggattaacaatcaatgattttgcatccccaatgttcggaatataactaaaaattttaacattgccaattaattttgcgatatttttttcgttccccttcagttcaaaggacaatactgacccgacgcctttaggaaagtacttaggaacgagtggattatcagcttcaataccagaatagtacacccgttcgacgtgctcgttagcagctaaaaacttcgcaatcgccgttgtgctggcgacctgtttcgtcaaccgttcggaaatggtctccaaacctaacatcacgaagtaagcatcaatcggtcctaaaacagaccctaataatcgaacatatttcatccgaattcgtttgataaaggccgctgcaccaaatttactataaaaactttcgtggattccctgttcttcatcccccaggttaaattcttcctcggtgaactgcggaaacttgccactcgaccagtcaaactgaccgtgatccactaccaatcctgacagcgtgttgccgtgaccgttaatccccttagtcgatgagtaaacgacgatatcggccccgtattcaaacgggcgcagtaggtacggcgtcggaaacgtgttgtccacaatcaacggaatgcctgcttcatgggcaatggtcgctaaggtttcgatgtcagcaatctccgtgctcgggttagcgacactttcgacgtagatggccttggtatcgtcttgaatcaatgacttgatccggtcaaagtcgttcacttcatcaacaaaatcgaagttaatcccatacttagggaaaaagtttcggaattcgtccaacgttgatccgtaaatattagttggcgcaataatgcggccaccaccctccgcaacgttaaaaattgcaaacgagatggctgacatccctgatcctacagccacggcgtcaatgccaccttccaaggccgcaattcgctgttcatacacgtgaaccgtgggattgccatcacgcgagtagtcaaaccgaccgggctgttgccccgccacaatttgattggcgacttcggtattactcagcccaaatgcggccgtctgataaatgggaacggaagaagcaaattgattttcctctggtttatagccggcatgaatgcgtagtgtatcaaatttatcctgtgtcaaaatattcactccattttagtgttatataatagtagaaacttatttattatccaatgctccgttttaaaatatgaacgttctgacgccgggtagcggttgccaaagcttggtttaaatcgctaattaagtccgctgcatcttcaatgcccaccgaaatccgaattagttggggcgtaatgccagccgccaagcgttcttctggtggtaactccgcatggctcatttcataaggcagttcggctaggctttcgacggctcccaaactgacagctagccgaatcaattgcagactatttacaaaggctggtgcatccacgtcatcttgtaattcaaaggagaagacgccgccaaacccatcgcactcttctgcagcaatttcatgatcccgtgaccctgcaataccagggtagtgaatggtcgctacctcatcgcgactcgcaaggtagtcaatcaactgacgcgcattttcctgttgccgatccatccgaactgacaaggtttgaatgccccgtcgtaccaggttggcattttctggtgataaaacaccaccaagtgcattttgaatgaagtagatccgttttcccaatgcttccgtcttcgtgaccaccaagccggcaatcacatcggagtgcccacccaggtactttgtagccgaatgaaccacgatgtcagcacctaaatcaaggggctgttgcaggtatggtgtcagaaaagtattgtcgacaatcgtcaaaaagtcatgtgccttcgccactgccgcaatcgcccgtacactggtaacttgcaaaagggggtttgtgacaggttcaaagtagatggccttcgtgtttggttgaatggctgctttcaccgcgtccaaatcctgggtattgactgacgtaaacgtaatgcctcgtgcttggaagtagtcattaatcagtcggtatgtgccaccatagatttgatcaccaattaagatgtgatccccttctttgaaaatggcgagcgccgcgtgaatggcggccatcccagaagcaaacgcaaatccattagcaccatgttcaagtgtcgcaatttgtttttctaagtactcgcgggtcggattaccagaccgggaatagtcccaacgaaccttgccattaatatccgggtaggcatacgttgatgattggtagacggggacgttaaccgccccggtctggttgtcattgatattttgtccgtgaataagtcgtgtattaaatcctgtcatgttaagcccctccattatctcgttaactcgtgcaaataaaaaacacttctgtcctaatctatttcatcaatagataaaggacggaagtgttttttccgtgttaccaccttagtttaagcaaccctcacgaattgctcctcttcgggtacttaacatcagttcaagtacggtcataccctaactctgtaacgggagtccccgccatcacttaacttacgctcggtgatgagaactgcatttaagaccatcttcaatcagttgccgatatcgccttccaccaccgtgacgactctctggaatcagctcgtaacctactcatctttgcattcgctaactatattcaatgtaagttattattgcccattcatgagagaatgtcaatggttttttagaatttgatgagaatatggctcacgagatcttcataagtccacgtttagttgattgtttttagtacttattcaggccgtaaaagccgtaaaactattaaaaatgcatcctcattcaataatgaggatgcgctaacagtttatttaatgccctgttcaagactaattcgctggctctattgctgttaatattttctactgatcaactaccgatccatcaatgctcaaccgcgtcttcactggtcgaatatgatagggatacttttctgcgacgttttcaactagttcaataccaattccattgcgtgttggaatttccataaagccatcgtgacattcaaacgtcttcttcaccatatcctgcttcaggacaccccgttcaacacccgtttgcccaaatttctctgataatgctggttgactatcacccggatattccagcaaagcaaagttgggaatgctaaccgcgatttgcaagcacgcagccgttgaaactggactaagtggattatgtggtacaacgtctacatcgttagcttccgcaattaccgcaatcttcttggctccagtaataccgccacatgcgcatacatccggacgcacatactgtactgcattgcgtttaatcaacatcgcaaattcttggggtgtgttcagtcgctcaccagtcgcaatagggaccgtcgttttatctgccacaaaagccatcgtatcaaagttatctggcttaataggatcttcaacgaagtagggcaaatactgctcaattccccgacaaaaggctactgcatcggctggctttagccggcgatgtaattcaatgcaaagatctacatcatttcccaccgcatttcgaaatgccgcaacacgttcgatggcctctccaatttcacgggcctgggttgtgtgatacggatcatctcgtgattgatctaaaaacggtgataggtgcccgactgcattaaatccctttgcctttgcatctttcaaattggcaacgacttcttcagttgttttaccgccaacatgatagtaaacgcgcgccttattgcgcgttttgccgccaattaaatcgtatactggtgcaccgtaatatttacctgcaatatcccataatgcaatatcaatggcgctaatggcccccatgatggccgcaccacgaaaatgccagcaacgatacatatactgccaatgatgttcaattcggagaggattctgaccaatcaggtacgttttcaaggcttctaccgcacctgccgcagcatctaggaatccccaggtgccacattcgcccacaccgatcagtccttcatcggtttccacctgaacaaataagtatcgattggccaaaattgtttttacgtttgtgattttcacgttataatgctcctctctaatccaaactagctaattttatttttgtgatacatcgacaccatcaaagaatttttttgataatttgctgagggtgccgttcttctgtagctttttaatagccttgttaaactgtttttgctgtttttttccagtactcgtatgtgcaaaggtaaaggcgatattactttctgcaaaagatcctttcaaaattttcaaattaaggtttttctgatgaatatcagaggctaaaatagctttcgcattgccatagccatcggtttgctggttagcagcagcgttcagcgcctgttctcgatcatcgaaggtgcgtgttttaatacttttgttaaaagttttcaactgatcaatttgattagaacccactgttgccgcaattgtcttgccgctcagctgattaaccgacgtcaacgtagatttcttgctgacagcaattcccattttaaaatacccgtacggattcgacagatagtactgtttctgtcgctcaggtgtaatggtaatgttgctagcaatagcatccaccttaccactgcttaattgaccaaacaggccatcaaaactggtggttttaaattccaccttgtaccctaattctttggcagcagctcgagcgactgcgacatcaaagccggtcagtttgccatttttcttataggaccctggaaagctcaccccagtagtcgcaatcttaatcgttttcgttttagcggctttgtttcctgaacttgaacaaccagtcagagtgaccaccaagcccaaacaggccactaacgctaccaaccatttaactgtctttctcatcttgaactcctccaaaataatcaatttaaagcaaaaaagcaccttcgcccctgtttttataaacaaaggacgaaagtgcttttccgcgttaccaccttaatttgaataaccttcacagattactccttatcaggtactcaacttcaataccctgatcatgtaacggtgataaccgtcattacctcacaaacgtttagtaatgagaactaaaattgaaaccatattcgtcaattcattatcactatctcacaccacccgatagttctctgaagataactccccaactactcatttcaacgttcaaaatctatttaattgaaaatgattataactttcagttatttaaaaatcaaccgttttttaaacttttagcacgtgccaagactaaatcaatgcgttctgaaatatttcctaaatcattttcagcattcgtccatgatttcagctcgtcacgactaaagtgatcacttacctcggatcgctgataaatcaactctaaaaagtctacgtgctgttcgatagcggtcatggcactttcgtagaccaactcatgggctgtttgtttgccaattaccgtgcccaattcaaacatgatcttttccgcaaatggtagtccaccctggagctcaatattacgcttcatttgcgcttcatttacattgaagtcattaataatatgggtcgcattcaccaattgtgcatccaaataattcgtgatttgcggcagagcaacccactcactccgccagtgaattgcatcccgttcaccgtcaaataacattgactgatgaatcaaggccacattactaaataccggctgagttaaactagccaatccttccagaagtgctggatttcgtttctgcggcatcgttgatgacccaatttctccctttttgaaaggctcggtaacctcatttacctcagttttcatcaaattgaataattcgtgcccaattttacccagcgtccccgaataaattcccaaaacagaggcaatttcagaaaatcggtcgcgcgatgactgccatgaaatattgggaacgttcaaatctagggcctttagaacccgcttttcaatttcaggaccgtacccgttaaaagcggcatacgtcccaactgcaccactaatactcccgacaaacacttggtgattaatgagttcgtttagacgttcttggcttcgcagagcttcatccagccagaccgccaacttaaatccaaaggtaatcggaatcgcctgaataccatgggttcgaccaatcatcggcgtattacgatacttttcggtttgtttcgtcagtgccgcaatcaatgcctcactatgtttatagagcacatcaaacgcttgcttagtttgcaacataataccggtatccacaatgtcttgagtcgtggcgccaaaatggacgtactcgccggattcttcacctgccaaagtttgcaaagtatgaattagcgcgatcaaagaatgcatcttttccgcactttcttttacaatcgcatccaagtcaaaattcttaatatccgcaatcgatgcaattttatcgccagcttccttgggaatcacacccagttctccctcaacctttgataaagtcccttcaacagctaattgcgccttaattttattttcgtcgctccaaatttcacgaatcgcaggggtactaaaattaccctgcattaattgtgaatcaagtacacttgccattactggaccttctttccatgttcttttaaatagtttccgatctttcgaatcccttttcttaaaacagcctcgtccgcaacaagactcaaacgaaagtatccgtgccccgcttcaccaaacgcgctacccggtacgacatctacgtgctgttcgtttaggattccctgagcaaattggcgatcatccgccaattcactgggtaacttagcccacacgaaaaaggttccctgtgagttttcaacagtaagtcctgccagtttaagctcctcaattgccacattccggcgtgttagatacagctcacgtaactgctgacgttcccctttttggtgttcaaggccgtagacacctgcatcttgaaccacgccaaaagtgccaccaacagaattttgaacatattgtttcaataaattaataatggaacggttaccaacagcaaatgctaaccgccaacccgccatattaaacgttttagatagcgtgtaaatttcaatcccggtttctttagctcttgcgctttgcaaaaagctgggtgctgggtggtcaaatgaaatatctgcatatgcgaaatcatgaataattgcaatttgattatcaagaccaaactggaccacttggtcaaaaaactcatgtgttgctccagcaccggtcggattgtggggataatttaaaaacatcatggttgctttttttcgaacatccgttggaatggccgccaaatctggaaagtaattattttcggccgtcaacggcatgaggtactcatctgcatcggccattgcaattccaatatggtatcccatgaaagctggtgtcggcgtcaataccacatcgtgtgcatttgccagtaccatcggtaacgcggttaaggccgctgccgaaccactaaaaattgttacctcatcatcttcaatcgtgacaccaaattcttcttgataaaactcacgaattgactgtttaagcgttggtttgccgccataaggtggataaccgtgatttttcggttgctttaacgcttcctgagccgcagccacaattttaggaaaagttggttgatcgggattcccccgccccaaattcagcacattagcgccctgcgcgttaagttgattaatcttagcttgttgaacggctagatatttttttccaaccttttgtagtcgctgagttgcctgaaaatccattccgtatcatcccctaaagtaattgatcgccgtcaccatctcatcaagtggcaaccctgggtacaccgtttgaattcgaacattacttttatcgaccatatccgcagcaatggtggtaatttcaggtgtctccgcgactaaatctaagtcacttaactttgttggtaatccaattttttcgtaaaacgaaattaattggcctagctcttcaaattctttttcaaccgctagctgtgttaaaacaccaaatgcgacaacttcaccatgcgtttttgtcggctgatgattaactttgagatatccattgttgaagctatgggccgccacactacgcccgcgggtcgaggcaaatccatctaccgaagcggcaattaaaaaaacagtatctagcaaattagaaaataccgtttcatcatccaacactgccaaatcatcaatcgccaaggttcgttccttactaacttctattaggcgacgagcaatatcgaatgttgccccttcggcttctggtaccaagagccgccgacggatctcataccacttcgccagcgtgtccccaattccagataaaatatagttttgtggtgcctgacgaagtaattttggatctactaatactaacgttactgcttgggggtgccgctcacgaccaaccagctcatgcttatctgccgaatacaccatacttttagttgcaatcgaggcacaatttgacggaaccgtcgggacattaacgatgtccagcttaagccagtcagccacatttttggccgtatccatcaactgcccaccgccgagtgcaattaagacatctgtttctggttcaaccagcttcttaacacggtcggcttcttcataggtacaattacccccaaaaataatcaatgagtaacgatcataaaaatcatccggtacaaacccctgcgtagccttgataacagtctgatccgtcaaaattgttggatgttgatagtttttgctttcaataatttcatgaaaatcttttaaaatcccaggttgattcacatattcaactgggcttaaccgaacaggagtccatttcatctcttacgccttcttatactatttccctaattctgccaacaatcgttttgcattgtagtaataccacttaacacctggaattaacccttcatcgtctaaccgtaagtctgaatggtgccaatccgaattaccatggctccctacaaaagcaaacacacttggaatcttctgactaaaataggcaaaatcttccccggcatttgatggttctggtttaacaaccgtcaaatgcttacttgtttcatcaaccacccatttagtcagttgtggatcattatcgacaacattggggccttcgatccattcaatttcaacatcaacaccgtacgaagctgcctgaccattcacaatttcataaaatcgtttcttggcggttttacgtgcttcaccatcaaaagtccggacggttccttcaaaccaagcttcttcgggtaaaacgttccacgtggaaccaccttcaatatgggtaattgaaacaaccgctgttttttgaggattttcattgcggctcacaatagtttgaatagcatttaacgttcctgacagtgcgataatgggatccttcccaaattgtggcattgccgcgtgagttccaattcccttaaaggtcaccttaaattgatctacggcggccattaatccaccggggagtaagccaatctcaccaacgcctaaatcaggcttattgtgaaacccaataatggcatcaatcccgtcagcgccaccagcggcatctacttcttgggcacccacgtgtgtttcttcggccggctggaaaaccaatcgaatcgttccttttaacgactccttttcctgtgccaacacttcagcggctcctagtagagacgtgatgtgaaaatcgtgaccacaagcatgcatcactccatcattgacggatgcgtatggtaatccagtcgcttctttaattgggagtgcatcgatatccgaccgcaacccaaccactggcttgccctgaccaatttccgcaatcacgccagtatttaatttctcaggtgtaataattcgataccctaacttagtcagatagttcgtaatatacttagtcgtttcaaattcttgatctgatagttctggatgctgatgaatataatgccgaacctcaaccactttatcctttaactgtgtaaatgttgcttcgtctgccacgcttaacgtctcccttatttttcgatttctactttttctagtgaatttacaaatgtactaattcgaccgggttgatcaccggataataactcttttgcaggaccctgatccaaaatttcaccgtcttcaatgaaaacggcctgatccgcaatttgtcgagcaaactccatttcatgtgtgaccagcaccatcgtaatgtgctcccgtgccaatgccgcaatcgtctgcaagacgctctccaccaactctggatcgagcgcggacgttggttcatcaagcaagattaccttcggcctgacggcaatcgctcgggcaattgatacccgttgttgctgcccaccagaaagtgtcactgggtactgatgtgccacttggcccagaccaacctgttccaaaacttcttgtgcgcgttgtctagcggctgcttttggtaattgaccatttaaaattaatggagcagctacgttttccagtgcagttttatttttaaaaagattaaattgttggaataccatcgcagaattctggcgtacctgcgcaataacttgcttactaatgtgccccgcttcagcgaccgatccattgacctcgacagaaccttcactaggttcttgaagtaaatttaacgtccgtaaaagtgtcgtcttccccgaaccactggggcccacaaacgccgttactgtgccctcttcaacttccaaattaatttgtttcaaaactggtttctgtccgatgttcacggacaggtttttcactttgatcaacgacatgtgcaaccctcctatatggtttttgtagcgcattttctaagatactttgaagccatgtataaataataatgatgatccagtaaattaccccgacagctaaatatgtttcaaaatatttaaacgaatcaccggcaagcattttgccgtccgcaaatagttcggttagtcccaaggcaaacgcaagcgacgtctctttgatcaaactgacaaatgtatttcccgtggcaggcagtgcgttcacagttgcctgtggtaatacaacatggaaaaatagcttcgagcgtttaatgtttaatgactgacccgcttcaatctgaccatcatcaacagaaccaatagcggctcgaaaaatttctgcaaggtatgatgactgtttaaatccgagtccgacaatggccgccactagtgcaggaataccacggaaaattggaaaaatttgtggtaatccgtaatagataataaacagttgcactagggttggcataccacgaaaaagtgaaatatagaaccgggcaaaccaacgcaatggggttaccttagtgagctcaaacgatgtcaaaaccatgcctaacacaatcgccaataccattgagacgactgccatcaatagcgtaattggaacgtatggaattaattgtgcaaatagacttaaaaagtatgaaaaatcgaaattcatttattgctccccctttgtcgtatcatagccaaagtatttaatagccaatttcttgatctgaccatcctttttcaatactttcagttccttgttaaatttcttttgtagtgctttaccatgtgcatttttcttaaatggaaaagccacttgtgtatccgaagcttgacccttagccacccgccatggtaattttttctgattaatcgttgcttttagcactggaatcgtgttgacaacgccttcgacatgcccactattaagtgcttgatacatttcgtcacgagtatcataggttttaatattaatttttgaatcataagccttaagtgcggttgtattttcagacgcgactacagctcccaacgttttgccttccaaactctttaatgttttatagtttgatgacttaagcaccgctactgaggtggcatagtgattatatggtgtcgagtacgtaaacttcttcttccgatctgctgtcacagcaaagttctgtgagagcgtatcaaccttgccactatcaagctgacccattaacccactaaagtcacttgtcacaaacttaaccttatatccaagccttttagcaactaatttggtaatctcaacatcgaatccaacaagcttatcgcctttcttaaacgacgttggaaaactttcaccggtggttcctaccttcagtgttttttgagcagcaaatgctggacttgccaatgagataacactggctagtgctgcaacaaatagggttagtttgaaaaatactttggtccatccttgtcttctagtcattcactaattcctccaatactgactgtaggtactgatcttgcacctgcttaacctgtttctcatctagcgttttaaccaagtacaacgtctgatgatctggaaattttctcacaacatctactttttgaaatccgagtttttcatacgctttactcaaccagggatgttcaagtgccgttcccaaactaactgccggtgcctgtaattctttttgaatataattttcaatcacccaattgatcaggtgtttggcccgcccctggtgttgataacgcggattagtggccacccaaccaagatgagggagtgcaaatggaccagggttatcagcccatggcagtcttacggacaccgtcgcaacaaagtcaccattctcttcaattacgaaagtcggtttcgttttgatatgacccgcaaccgttgcctcttcaatggttgctgctccaaaatgaattcctaatgcaacatccgccgcatatgcttgatgaagtagagcggttagtttctttgcgtcacccggatcatttaatcgtttaattgccatgcctgattaccctctttgattgttattcttttgttgtatcgtagccgtaatatttcttagaaattttagtcaacgtaccgtctttacgcattttgttgatttcttttgtaaattgtttttgtaattttttaccatgtgcatcgtctttaaatggtaatgcaatcttgttcaccttagccgatcccttaacaaccttccaatcgaggcccttttccttaattgtggcctctaaaattggtcgggtgttcaccatgccagaaacatgaccgctattgagggctgagtatgcctgatcccgtgattcataggttttaataataattttcttgtcatatttttttagtgcgtcaatattgtttgatcccatcactgctgcgactttatgaccttctagatccttcagattcttaaattttgatcccttttgcaccgctacagccgttgcatcatagctgtagaccgatgtgaagaggtatttatcactacgttgcttcgtaattgcgacatcgttagccactgaatcaatcttgccattgtcaatcgaaccaaagaggccatcaaaatcggctgtcacccatttagttttatatcccaaccgcttagccgccgtattagcaacatccacgtcaaagcccgttaacttgtcgttctttttaaacgacgttggaaaactcgtcccagtagccccaaaagtaaccgtctttttggctgcctgtgcattttgttgtggagccagcacgaaaaacgccgccactgctaaaattcctaaaataattgatcctaatcctaaacgcttcttactcattatccaaaaccccttaatgtttgatatgtaatttagattgatccgtgatgactcacattttcgacgaaaaaaggcgcccccgtcgctgtctatttctagacaaggacggaagcgtcttccgtgttaccaccttaattcgaataaccctcacaagctattccttctcgggtactcactggcagtcgaaaaggactactagtttcaaaccccaactctgtaacgggagtacccgacaccacctaactaaatcgctcggcaatgagaactgcttatgagaccatcttcgattgctaactactatcatctctcaccaaatgatgactctctggaaagcagtatcacaatttactcatctctgcgttcatctaaacgtatcaatctgtttacgcaattattaagtattaattagaaaatgtcaacagtttttaagattatgatgagtaaaatttcataataaacttacgaaatgtaagctataaacgttgatatcacattgttttggtatttgaattaatatgttaaaaaaattttttattttatggcctcaactagttgtgaaaccgtttgattggtgcttcgcacaattttttctacttgcgcactttgcgctcctattgcacgttgtaacttatctataattttttcttgcggcaatggattggcgggtgatcccagcggatcatccacctcagacacaatcgacgccccattcacgaatacttccaaccttgcgggtcgtgaagtgactgatccctgtggcaaatcattggttcgtgaaaaaatttcgatgtctgtataaaattgtggctcaatcggaagcgcagcaaatttttgatcatcaacatccccgtagttcaatacttgccacacaatatactcaattgagaactttccctgctgcccagtttgaggccgtggttgattaagtactcgatcaccattttggggataatgaatgacgattttttgacagtctttccactgaattcctttttgccacagatctactgccgcatcatagccagaaattgcggccgaacaaaattggtgctgcttaaaccacagacctggtgtttggatttgggctggttttaaccaagtttggcgccaattagttgcattaacttcgaggtcaccgataactttaaaccagccgttgcggttgttaaatggatcttcactcgtagtaagtcccgcttgaacgatctgataagcagtcacagcattgcgagctgctagtcctgcatgtaacggtttattatcagtaccagcttgaaataacattcctgccgtctgactagctgcgacagacaaaatcgccaccgtgttttcaaccgataatcgtttaaaaacactaattgcagacgcagacgcaatactcccgattgtcgccgttgaatgccagccactaactgcatgatgcggattgagtaaccggccaaattggccggccacctcgacaccctgaatgtacgcccagaggagatcttcaatttggtctgtcggtgcagcaatcgcaaacaatgctgaaaaaatcgtcacactgggatgcccacgaaagttaggttgaacatcatcgtagtcgagataatgtccctgaaacccattaatcagtgcggcccgttcggccgtagttgtcaccgactggctgagaatttcagtgtcgccaccttcgattttaagctgttcaaccaagcgttgaacggctacttctcgatccgctagtttcaagctggctagataatcaattaaggctgatcgggcaatttggaaaagctcaccggaatcttcaggttgagcttgatgcaaaagcgttgcgagtgttttggttactgttgcgatagtttatcccctccattaattttactgtggtaattcaatcccatacttttcacttaatagatcgcccaaaaattcagctaagtgttcatgagcatatacattagcttcttcttcggccgctgggttgtagttagtattagtgttcacatcgtacacgtaagttttgccagccgcatcttccacccattcaacagccgcgacgtcaataccagcatgttgtaagaacaattcatatgcttctcgctgacgattcggtaacggggtggtaatttgaaacttactcgatgtttcgagctgttcatgcccctgtccaatttgacactcatctgccggacacaactggaacccatccgatgaatcgatcgacacagtgtacaaaaacctgtcattaatgaactcggagcgtcgaattttaccgtctgccggtttaatgtactgctgtaacaacgtaataccatcgacagaaggctcaaataactcgctatcaacgtaggcttgtagttcctcctcgttattgaagaggtggacgcccagtcccttaccggcccgattatgcttagtgataatcggataagcattcagttttcgagcggctttaatcaggctttccttgcccaataccgcaaccgtcttcggaattatcaatccatcattttttagagccagatactgtttgatcttactaatttccaaatcaatcgcgccgctgccgttaatcaccgttcggccattcgcttctaaccacttaatcatttgctgagtaaattcaggggcaaatcgatgaccacgagtatgtgatgacgccgacatccgattgtagaaaatcccttctggcggaatggtttgaaggtccaaaataccacttgaaaggtcccacagttcatacggaatctgtttttcctcaagccactttacaagatggttcgtccattcaagattctcgtgaataatatatacttttggttgcgtcataataggtcactcctgtttttatttgatttgtgataggtcaaatattattttcgaatttgcaataccattcaatacaagtatcccaacaaacatttttgcttttttgagtgtttgcttagctatttgttaattgcgcgcaattaacgttgaatcatcaaccgtaacctttttcccaatcaacatggacgtaccattcagtttttatgtttgctaccaaaattaagccttctttccaaatttaatatttgtaattttcaattttttattttggcttcgcgcaatcaatggcaaaatagctcctaacagaataaaaataattggcgtaatgatattaagttccaattgcgtccaccaagtacccccggtagtttttggaatcattccgaggatacatgcaaatgctgtgaacaagaaacaccaactaccaatggcaatacctacgtatcgatttttagtgagataaaaatcactcttatgcttctttagctgattactcaacaaaacaaatgctacaaaaacccataagaatctcattggaagtaccactgaattaagatttaacaaccagttaaacaattcattcatattgcctatatataaagctggtaaaataattaaaatactgaccagtattccagttaaatagtagccattgattaaagcatcgtgcttattacgttttactaactgtcgcggaataaatctgaaatccgcattatcacctaacagcattttaagtggtgcgtcaattgaaaatagtaacgccgcaatttgttcaagcgcattggcaattgcgtaaagaatcaaaaataagttaccagcatggtaatatgtatctaatttctgaaatgcatagtaagcaccattagccagtagatccttggggatgtgattactattaaataacaaccccatcgcaagtgatccagaaagtgcactcacaataaccaagattgccagtacaatcattcccagtgggaattcacgtcctgcattttttgttttgttgacatatggtgcaattttttccgcgcctccaaccgcaaagaccaacatcgaaatagttgttaaataatttaaattccacttaggtagataagaactagcctgattcatatgacttgtggaaaatgacacatcatgcattccaagtgaggcaaatgccaaaatcacgaatagtagagacataattcctaatgcaattcctgcaatactcccgattcgctttaatgttacaattccccgactggctaaccagaggaaaaacaggaaaataacaagacatattatctgaacccagattgatgacacgtgattcacgaaatttccatttccttgaaacaaccagctaaacgaaattaaaatagtttgtggtttctgagcaagatacgtgatattaaccacccaaaacgtccatgcagttagataagcaactttagaattcgttaaatctcttatccaggctgccacaccactttcattttgattaaacgtggccccaagttgccccacgattagtgtatacggtacaaagtacaacaatgaaattaaaatccatgatgttaccacggataagccttctaatgcgaagttgttgacgacattcccaagtccccacaccgacgcaaatgcaataaaagcgatattgttccatcgcagttgttttttagtcataagcaattctccaaatcatttctaatttctctctttattcgcacatagatttcttatcagcacatataaacaatgccacctactgttttcacgtattttttctcccctctaacaagcaaaaaagcacttccgcccacatctaaaaatttagataaaggacgaaagtgctttttcgtgttaccaccttaattcaagtaaccctcacaagctacttctcaacaggtacaccacttcacaaatttaagtactactcagtttcataccctgactctgtaacgggagttcccgtcatcgtctaactttcgctcaacgataattttgatttatctcagaccatcttccgttatccgctattattgcctctcatcaaatggcaactctctttaaaatagacgtaataccctactcatctttaatcacttttagttatataaaattatagagttattattaaataaacttgagcatatgtcaattattttttgattaatttcaaataatctttcttaccttttcaatttcagcattgtagggcctgtcatcaataattggtggaaccaacttacgaacacgtgtatataatcgtgccgttttgattcccaaagatgttggtgcatcatcccctagccgcaaataaactgcttgcgccgcattgtacagctccaaggatagtaatgtagacaagtgggtattgatgtccactagtttttcactaatgagtggcaagttcgaactatgatcttcaatatcacctgctaatccgtaaaactccgctgaaattggataagccaattgacgaattcggacgtctgcatccatcgcagttttttgtaacgtctgaagtccgaattgaaatccacgttgctgaattaaaaaacgtggtaatcctgtcatttggtcattattcagatgcttaattcgctgaaaaatacttcgtgacacatgcgtcagcgcttgcccaacagtttccgccactagcgcaatatcaatcacctcaaagtttcccgtagaaacaatctgtcccgtctcatgacaaaccaatggattatcatccgatcccgacaaaaacatatctaacgactcgatacagttttctactgtatgtaaagcagcacctaaaatatgcgttgcggatcgaaaactaatcggatcctgaacctgtttacgttgatgatgatcaaataaatagctatccgttagtgccgatcgtaaccgttgtgaaatctgcatctcgtagtcgttatggttagccttcgatacaacaggcaaaatcggcgtcacattagcatcaaagccttccaaactaagtcctaaaatggtaaccgcctctttcaacaactgccgtgtccggttcacaccataaattaactgaccaacgccataggcattggaactcagaaccgccaatgcatccttagggccgagttgaattgcggtaatttttaactttttaaacagtacttcagtattagtcaaagacccgtgataccacgcttgtcccctaccaattaccaactgggcaagtgccgataaaatgccgatatctgcttctccaacggacccgcacgaataaaagactggtaaaacatctgcattatacaggcgaatcattaatctaacgagtgctggattaattccagtaacgccttgtaataactgattgatacgaatcaaaaatacaattcgagcaatatttgttggtaccagctttcctgtactaatcagatgggacttaactaaattattgttgaactgattctcgacattttgcgcaatcgagatatctttattttgcccaacactagtatttagtccatacacacggtgcgtgttatgcaaaacgatagctctcgcttgatccaaattttgccatgttgccggcccaacttcaattttcaatttaaagttaattattttagtgattgttgcaacagtcaaatttttaccgttcaggatgatggtttgggaatgtcgttgtatcaattcgatgcacacccttctttttaacttcagtcaacgaatcactgtaccctgcgtccgcataacgtaataatcccaatgatgtgtcgttatcaaatgctaattttaaccggtcggccgcctctgaagtaccatctgcaatcacggtaactccagcactttgcatatatcctgcatagccaccaccaccggaatgaatggccactaaatcagcttttgaagacgccattgtcattgcattaatcaatggccaatcggtaatcgcatcacttccatcaatcagattttccgtcataatattaggatgggtcattgccccagcatctaggtgatctcgtgtaaatgcaatcggcgccttaatttttccttgcgcaaccaattcattaaccgccaatgctaacttcgtccgatctccatgaccgagccacccgattctggctggtaacgcctgaaacggtacatactgattggctttggtaatccaatcaacaatcaactcgttatccgcaaactcctccagcaagtattgatcaatcaagttaatatctgccgaatcaccggacaacgcaatccatcgaaatggtccgattgctttcacgaacagatctcgaagaaaagcttccgtaaaaataggaatttcaaaagcattctcaacaccgtacgactttgcctgtgttcgaatattattaccgttatcaaaaacaatactcccacaccgctgaaactctaattcgcttcgaatttcatgggcaattgactgtcctgccgccgcggacagcctatctggatgcgcttcacgttcctcactaacttcatccaacgtgtatccctctgggatataaccataaagtaaatcttgagccgccgtctgatcagatacgatatctggtgtaatctggcgatccagaatttcctgatatattgtcgcggcattaccaattaatccaaccgaaatagcctttttctgcgcacgcgcatcatcgatgaggattagtgcttcatcaagcgtccgagccttatactgtaaatatcccgtttcaatccgtttatcgatatgtgcctcatttacttccaccactaagatagcagcgtctgccataaacccagcaagcggttgggatccacccatccctccaagtcctgcggtaaggatgaatcggcccgctaaactaccattgaagtgcttctgcgcaataattttgaaaatttcgtaggttccttgaaccacaccctgtgagccaatatactgccaatcgccggcagttaatccaccccacgcggtcaaacccttgttatatagtgaataccaatattcagcgttggaccattgacccattaaattggaattagctaaaattacaatgggggcatcacgatgcgtttttagcacgccaatcggcttacctgattgaacaatcaaagtttcgtcttcttctaatttttttagtgcgtcaacgataccataataggaggaccaatcgcgtgcagcctttcctagtgcgccatacaccactaaattatcctgatcttcagcattttctaagttgttttcaattaaccgcaaaatagcttcctgccgccatcctttagcacgtatctgtgttcctcgctgtgctttaatcaaagatcatccctcctaattcaatccggatacatagctgagcactcgagtttgtagtttttcaagtccccaatttactaaaattgcaaaaatagcgatcacaattgatcctacaaccacttctgtataattattttgatttaatccattaaataacatcgtccctaatcctccagcattgatatagctagcgatcgttgcaatgccaattgtcgacgttgttgcaatacgaagcccagaaataatcgtcggtaatgcatacaatgttttaaatttccatagcacttcccaccgggtataacctaatgcacgagctgcttccacaatattgtcatcaacctgctgataacccacaatcgtattacgaacaagcacgaacagggtataggcaactagagccactaacgcgggtatcagtcccaatccgaaaataggaatcaaaagaacaaagaatgctaaactcggaatagtataaattaaacttaaaactggcataactactcggctaacaagttgatgattcgcaaaaaagtaacccagtggaattgcaatcacgccggcaatcaaaattgtcaatcctgtaatttcaatatgttgaaacgttaggtgaacaatcatccgccaattaccaactaagtacttgatcattagccgacccccactaactgtgaaatttcattcaaatgtacatagcctacccgatgattctgctggtctagcacccgtaccggctgttccggttgtttcaataatttttctacaacctttgcaacaattgattcagcatccacactattcgaattagttgtcgtactctcagcctgttgccaatcgctaatcaatgattttgcactcaaataacgccattgcgataattgctgatcaacacccaaaaactgtgcgacaaagtcatttgtcgggtgtaaaaataactcatttttatcaccaaattgctgaatctcaccatctttaaataacatggttcgatttcccagctttaaagcttcatcgatatcatgcgttacaaaaataatggttttacccgttgatcgttgaatttctagtagttcatcttgtaatttagtgcggttaaccgcatcaattgcaccaaatggttcatccatcaatagaattttgggatcagcagctagggctcgcgcaatgccaatccgttgttgttcgccgcctgatagctgatggggatgccgatcacgaaacgttgctgggtccaactggactaaccgcaacgtttcgtccacccggcgcgcaattttagccttatcccactttaagatattacaaaccgtcgcgatattttgagccacagtccaatgatcaaacaatccgtgttgctgaatgacatagccgatgtgacgtcttaattgattcacatttacctcttgtgtatcctgcccatccacataaatggtgcccgaagttggttcataaagacgattgatcattttcataagtgtcgtttttccagatccagatgttcctaaaatcgtgatcaattcaccttcattgatcgtaaacgacgtatcttttaccgcctgaactgcaccaaatcgtttagtaacgtgttcaacttgaatcaccggtcgttgttctgacatatgactccttctttcttcagcattacttgtcgagattgttatcctttacatattcctttgccaccgtctgatacttttcatggtgaacatcaactttgccattcaatgtctggaggtccttcgtcgtcagagttttgttaaccttattcaaggtggttttaacctttggattggccttcaacgtcttgtcacggacgaccgcggaaacgtagtaatttggataaaatcccttatcatccttcaaaaggaccagctttttattagctagctgcccatccgtggtgaatccaacagtaacatctgcttttttatcaagtaaggccttataacggacaccattatcgacggttgatgtgcttttaaaattaaatccaccgtattctttcttcaatccagggattccatccttacgcccttgaaactcagatgtcgtagcaaaatttagcttatttgcattcttggctagatcagaaaaagtcttgatattgtatttttttgcagcagttttcgtaataaccaatgcctgactatcattagcttttgacggtgttagccaagttaaattccactttgcatatcctttatttaatgtcttaaacactttagcatcatcatgagttgcatcatgttttagaacatcaacataacccgtacctgtatattctggatataaatcaatagaacctttctttaacgcattctgggctacaaaagttcctgataagtttaattttgcctttgttttaactccctgagcttttaacgcatccgtatagatctgaccaataatcaaattttcagtgaaattctttgaccccaccttcaccgtgctggacgccaataccggactagcagtggcaattaaagatgatgctccaagtaatgttaaaagtgttgctgtaaaaatctttcgtagttgtttgttcattaaccaatacccctctcagtttcactcaccatgttttttctttaattcatattctagtaacgaaaataccatctccgataggagtgccagtcccgtcactggtaatgcaccggccaacataatactggtatcatacatactcattcccataatgacgtaagttccaagtccgccaccaccgataaaagctgctagtgtcgccgaactaatcacttcgattgcagataaccgaattccggcaacaatttggctagatgctagcggcaactcaattttcagtaaccgataaaatcgactcattcccattccattagcggcttccaacgtattatgattaatgcgtcgaataccagagtatgtattaattagaattggtggaattgccaaaatagtcagcgcaagtagtgccggataaaaccccattcccattaatggtaaaactaacaccaaaatggcaagagatggaatcactcgaatagcattgaagaaactaattaatcgaccacccgtttttaagtggcgtgctgcataaatgccaattggaatggcaattaatactgcaatcagtaacgacaccacactgagttttaagtgaatcagtaaattcccgtcaaattccacctgattttcttgaatgtattcaattgcgccggttagccatttcatgaattaactcctattttttgtcacacactgacttggtgattcaatgtattaataaatttctttacgcgactttcgtctgattcttgttgtaaagcagctggtgaaccttcaaaatggatttccccatcttccagaaacaaaacacgatccgatgcttgttcagtaaaagccatttcatgagttacgacaatcatcgtcattccagcctttttcaaccgcaccattacttttaaaacatcattaaccatttctggatccaatgcagaagttggctcatcaaacagcaatacttctggatccatcatcagtgcacgtgcaattgatactcgctgctgttgaccaccagataattgactgggatatttatccttatgctctaacagatcgaccatatccaataaattaattgctttggcggctgtcttacctgaattcatatgtagaattcggcgtggcccatcaactaagttttccatcacagttcgattaggaaatagattaaaatgctgaaacaccattcccactttaattcggtatcctgacaatgtggtttcacttcttctggtcaaatttccctgatggtttactgtataatcaacttttgtgtcattaaacattatttcaccctgacttggcgcttccagtaaatttaagcatctgatcagagttgatttaccgcttcctgatcgaccaatcagtgtcactagttcaccttcattaactgataagctgacatcgtgaagaacttccttattaccatagtttttaaacaaatgattgattgaaattttggacattttattaccccgttacaagtcccatcgtgttgtattttcgttcaagtaaccactgtgcaatcataaacagactacataaaattaaatacaaaattgctgcaacgccaagtgtctcccacgttttataggtcgatgaatataagtttgttgcttgtaacattagatccggaactgtaatcaccgaaacttgggcagattcttttaaaagcgcaatagagttcgaaacatacgttggcgaaataattttaatcaccgctggcaattttacgaaccacataatttgccatggcttatagccaatcgctttagcagcttcaatctgtccatcatctaccgcacggaatccagacctgaatatttcagcaataaacgcacttccattgatcgttagccccaataatccagcgccaaacgcagaaagtttaataccgaacggcgcagaataatacaatagaaataataaaatcatcacaggaagtcctctaacaatccagttataaaccgccgcaacatttttcagcgttcggtttttggaaattctcataagtgcgatgaaaaatccaacaaacgttgcaataattagggctaataacgagattaacaatgtgattcccattccatgaatcagaacaggtaaattttgttcaaccattttcatgttcaatgacaacacaacctttaatttaaactctcactagtaacacccagatacttcttttgtaatttggcaatgttgccatttttagtttctttggcaattgccttattaatttttttcgatagtgtcgtgttacccttcttaaccgctaaatcaatatcatacttatgatatgctttaccaacaattttataatccttaccatctttagcagttttaatataatttttggccgctacaattcctgttgaaataacattaattcgaccaagttttaaatccttaaaggcatcattaggtgccttgtactctttaatactcttatagccgccaatttgttgtgcgtctttcaaatatgacgttcctgaacccgcacctactgtctggcctttgatatccttcagagacgaaattttggtgttcgatttttttacgaccgcaatagtgccatcagccgcatacggttttgaaagtaacaaagctttttttctggctggcgttgcttgcaaagcgccaaacaaaacatcaaacttgccattatttaaagcaggtattaaccccgcaaattgtccaggcacaaacttaaccttgacacccaagtccttcgcaaccaactttgcaacagcaacatcataaccgccaagtttgccatctgctgtcgttgtttgccaaggcgcgtagtcacctgtcaatccgactctcaagacacctgtttttttaacactgctccacgaactatctgttgctgcatttaccgttcctactaaaaaggaggtaatcgtcaatattgtaagaaataccagtattaagaccttttttaatttcatcccaaatcatctctctcattacttttctaatacataatcgtaaatcttaattccaagtgcttcttcaatttccggatagttggccttctcgtaaactcccgagctcaacggaaagtttgtactatcgatcttgaacacaatcacctctttaccaacgggaatttcactcgttgtcagcggcttcatcgtttccttatcaaaaacggtaatcacatccggatagttcgccaccctctcgccattacgattcaacgccataaactcgttggccgcgtacgctgttaatgtgttgttccgtccggcatcaactgtgatatgaccaatgtcataagtccccgcttccgaataagcgacattattttcggtcacttttccagttcctagcacctcaccatttgtctgattcaaaatggcttctaagactgcttctggaccgtctggttgggctttgagcactacttcacctagttcaattgccaatgtgtagccaccgacaaccgcattttccttcaaaaatttaacgctgagtggatttcgtgctgatgcaaagaacccaccagataaatcagacgctttacgaagtacttccgacgttttttccggttttccagtaataacaagttcaatgtgacttcccgtctcacgtttaccacccgacgcggcctcaatcgtttgatagtgcgcatccgttgttaatcccatgttgccaaatttgccagatggatgtgctcgaatatctcctaatgcatcgaccacaactaaatcaagtgccgccgcgggaagccagccattagttgacgatgacttaccattttggccggccataaacccgacaaccttgccgtcatagttttcgatcaacaattgtgccgccttaatgtagtcacgccctgtcatttcccagtcggttgtcccagccggggcaccaatggcagccgccgtcacgacaatatcgtcatcgttgagttcatcgagcgacaccagtttcaccttattaatcgtgattgcagcatgtcccatggccaaaccatgttcgtaaaagcctccgccaccactcgcataaattgagccacccgtcaaagcagataacacatcatcatgatttaaaattctcatatttcagttctccccatgttcatttttcccgcccacactgagaaaaaatgataatttattcgttcaataccgtttttggagtacacaaaaagacctccatacattactggtcaatttgccaaaccaaattagaatcgacttcccccatcaatgggaatcattatgccgtaccgccggcgcacttgtcggacgatcgttataattctagaaatcacttctaatttaaatgtatagagatccaaattctgattgcattcgaagggcaccaaacttcgtgacgaaattggctttgaggtgtacatgcgacacacgaatactatagattttagcttcaaatgtaacgatcagtgttcgcatctatctcatcctccctcgaatttttaatctattattgattcaatctgtttctaaacttcttccaagcactctattactttatttttaaatcttgcccaacgcctgttccaaatcatcaatcaagtcatctgcattttcgatcccgattgaaagacggacaaggtctggcgtgattccagttaatttcagttcttcttcatttagttgtgcgtgtgtcgttgaagcagggtggatgatcaacgaatgcgcatccccgacattagccaacagtgagaacaggttcaagttttcaatcagcttcttaccagctgcttcgccacctttgagaccaatcgtgaagatcgaaccaacccccttggggaagtacttgtcagctaatggcttatacttgctaccttcaagttctggataattgacccatgcaaccttgggatggttagtcagatatttgacaatcttgcgtgtattttccacgtgccgttctacccgcagcgataggctttcgaggccttgaatcaagaggaatgagttgaatggactgattgtcccacccaagtcacgcaacgattgtgcacgaaccttggtcgtgaaggctccaccctttaaggtattccaaactagcccgttgtattgtgggtccggtgtggtaaagccagggtaacggccgctagcagcgtagtcgaacttaccgttttcaacgatcacgcctcccattgtggttccgtggccgccgatgaacttcgtggctgagtgaacgaccacgtcagcaccatggtccaatggttgcaccaagtatggtgagccaaaggtgttatcgacgatcaaaatcaagccattatcatgtgctaccttagccacggcctcaaaatcaattaggttaatgccggggttcccgatgctttcaatgtagagggccttagtcttatcattaatctctttggcaaagttttgtggatcgtcaggatcaacgaagtgggtggtaatgcccagctttttcaacgtaacgttgaagagatcaaatgtgccaccatacaaagtgctggcagcgacgatttcatccccttgatcggcaatgttcaaaatcgcggctgaaatcgcagctgaaccagttgccaaggccacaccggcagtcccattttcaagagcggcaacccgggcttccaatacagaagtcgtggggttggttagccgagtgtaaatattgccggcatccgtcagggcaaaacggccagcggcttgagcggcatccttaaagacgtatgacgtcgtttggtaaattggaaccgcccgtgcaccagtttcatcaaccgtttgaccagccgtcacttgtaaggtttcgaaatgtaagtctttgttttcactcataattaaattcctccgttttgattatcgttgtgtttgatttcattcttaaattaaattcgttgggtttattgtttaggttgagcagattaattagcaacaacaccgttgcatcgctgctaatcctccagcatgttcataagatttcaatttcatcactaccacgctcctactcgctttggctgactaaattccaataaaaaagcgtcccttacccgccaattatgacaggtaagggacgcatgatcgtgttaccacccttgttcgtgcacgaatgcacctcaacgataccatcagatatctgggaagttaacggttcctaccgttcgccaagcgtgaacctgacgacacactattcgagctcatcttcactatgttgacgatgtcctttcacaccacccggactctcttgcttcgccttcaatagctactcttctcgatgcattgaaattattgtcgtttgaattgaaaccaattctaatctaattttaattattgtcaagctattttttaatttttcttttcatccacttctcgccgatccgctgctgaagtttaactttgtgaaaagcaatcaagtccgtccgttgtaattgtgaattcacaatgtgcaaaaaatatttttcagcattatttgaatggcgctatttggcaacgattactaccaaacgggcatttgtgaacttgtcactttttcacaagcaattttcgccccttggcaagtgaaaaatacatggtattctatttttaattacatttgaatcaaaggggaaccatcatgtcagaaaataaacgttacggcgcagatgccattgttgaaagtctcattaatcaccaagttaaatatgtctttggaattccgggtgccaaaattgatcgtctatttgacctcctagatcatccgaaagaccctaattcaccacaaatgatcgtgactcgtcacgaacaaaatgctggttttctggcctccggaattggccgaatcaccggcaagcccggtgtcgtcatcacgacttctggtcccggtgccagcaacttagctacgccggtcgtgaccgccacggcagaaggagatcccatggttgccatctctggtcaggtgcaacgtaaggacctcttccggttaactcaccaaagcatggcgaacaaggaactcttcgccacgatttccaagtacagtgccgaagttggcgacgctgaaaacctctccgaagtcattgctaacgccttccaatcagccacgcaaggcaagcaaggcgccgcatttgtcagcattccacaagatgttgatgatagcgtcgtcgactcacccgcccttgccccacttgctgaaccaaagcttggttcagcggataaagcttcaattgcggaactagtacgccgaatcaaaacggctcagctccccgtcttgttggtcggaatgcgggcttcatcaccagaagtgactgccgcaatccgcaaactcgtaaagacagctaaaattccggttgttgaaacatttcagggtgctggtatcatctccgaagacctcgaacaaaactacttcttcggccgggtcggtctcttccggaatcaacccggtgataaacttctgaagcacgccgatctcgtcgtcacggttggttatgacgctatcgaatacgaaccccggaactggaacgctgaacaagatgccgtgatcacggtcatcgatacagaagcaccccaactggataagcatttccagccaacaaccgagctgatcggtgatatcgccgcaaccgtggatcaacttgacgaagaacttggcagttacgaaccttcaaaggggtcacaacactacctacaaacactccacgaagaaattgaagccgaccaaaaacaaacaccacccgctggcgttggcaacaccaaccatccgttggccgtaattcaagccctacagacccgggtcgataataagatgaccgtttccgtcgacgtcggtagccactatatctggatggctcgtcacttccggagctatgaaccacgccacttacttttcagtaatggtatgcaaacgctcggcgttgctttgccatggtccatctcagccgcacttctacggcccaacgctaaatccgtttccgtttccggtgacgccggcttcctctttaccggtcaggaacttgaaacagcggtccggctaggactcaacaccgtccacattatctggaacgatggctactatgacatggtgaagttccaagaagaaatgaaatacggccgtaatgccgccgttacctttggccccgttgactacgtgaagtacgctgaaagctttggtgcaactggcttacgcgttgaaacacctgatcagcttgaagacgtcctcgaccaagccttcagtacaagcggccccgtcgttgtcgacattccgatcgactactctcacaacccagaattgggtaaaacactcttacctgatcaattctaattcatttaaaaagtaccggtcatgatccgtcaaagatcatcgccggtactttttcgttagtgtcgatgctaagtcacatcatcacttgtgactctccaaactgctggcaattttacgtaaaacaccatattttctcatttttcatttgtcagtatcacgtctaccatcaccgttacaggtaacaaaacttaaattaaattaaaaaacactcaccattttctcaaacttctattcccaaccactgccgcaatgcttatactggggttaagcgcttttatcacgcaccggtcataccggttaatacttggaaagaaggattttttgcatgccgaatactaaacccagcctcctgaaggatctcaatcacaactacgacgggctccaacccaatcccattcgtatctttgatgccgaagctagtaagattgacggtgttcttaagctatcgcttggagagcctgattttaacgtccctgaacatatcaagcaggctgccatcaatgccattacaactaaccagtcccactacggtccatcgaacggttggccagttgtccgtcaagcagccgcagattttttgaaggaccgctacaatctggattacaaccctgatactgaaattgcactgactgttggcgctaccgaagggcttcatagctttttggataccatcttaaatcccggtgataaggtcctcatgcctagcccaacgttctcgctatacgatcaactgatccgaattaatggggccgaaccggtttacattaacaccgaaagttccggtttcgttttaacaccagaacaactgcaacacgccatcgatgagaatggggccgcggttaaagccatcctgttgaatttcccttccaaccccaccggcgttacttacaatgccgctcaggtcaaggcgatcgcggacgttgttcgtaaaaccgacctaatcgttatctccgacgaaatctactccgagttaacttacgatgcgccccacgcctcatttgccggcgaattacctgaacaaacactgttaatcaacggtgtttcaaagtcccacgccatgacgggatggcgaattggaatcgctgctggtccggccgacctcatgaaacgtgtcagcctggcccacgcattcaacgtcacctcagcttccaatcccgaactgtacgcagcggctgaagcactctcgacagaagctggccgccaagataccctcaaaatgaaggccgaatacatcaaacgtcgagacttcgtggtcgaagccatgactaagctcggcttcaagattgcgaacccttctggggccttctacgtcttcgctaaaattcctgccggttacattcaagatgacaatgaattctgttacgacctcgtccgtaagaataaattagccttaatcgctggaagcggctttggtcccggtggtgaacactacatccgtctgagctatgccgcttcaatggacgacttaaaggaagccatgaagcgtcttactgcttatattaatgaaaacaaaccagcataattgtttcatgtgaaacataataggtatctccataaaaggtctgagaaaacgagtgattttcttagatcttttttcatgcggtgaaaatagaggttcaacacgtcctgcttccccaaaatttgattcttaaattgataccactcgtgcggtaatatccaccacttattgacctttgcaagacacacagatcagtcgttgctatactaacttccaaattaatcatactggaggttccatgcatggcactattaagcgctaatcacttaaagaaatcttttggaaagaaaattgcagtaaaagatatcagtctacaaattgatccaggtaaattcatcgcccttcttgggccaaacggtgcgggtaaatcgacaacaattagtatgctgattggcacacttgcccccgatagtggcaatattaatttcgatgccaaaattcccaatgcacaaaactaccatcgtcatattggcgttgtttttcaggaaagcgtccttgatggtcaattaaccgttcgccaaaatttaacttttcgcgccaaaatgtacaaaaatatcacaacacaccgcgtcgaagatgttctcaacgagtttcagctattaactgtcgctgaccaaaaataccaaacgctttctggcggacaacaacgtcgtgtagatatcgcacgggcaatcctacaccgtccagcacttctttttttagatgagccttcaacagggctagacattcagacaagaaatatgatctggcaaatcctcaatcggctgcgccaaaacgagcatcttactattgtcctgacaactcactaccttgaagaagctgaaaatgccgatttcgtctacattattgacgatggtcacgtcattgccgccgataccatccccaaattaaaagctacttacgcgccgacacgacttactttaatcacaagcaccccagatctcgttcgcaaaaatttacctgctgatttgccgattaccacaacaaaaacaggcctaagcattgcactatccgattcaatggccagtattcccatcctaaaattaattcgaccgttaattagtggttttgaacttagaaatggaaccgttgatgatatttttctaacactcaccggaaaggaaattcgataatatgctaggtttgctaaaaagaaatcttcaattatattttggcgatcgcagtggggtcctcttttcactgcttggcgccttaattgcgtttgttctttacattgtctttttaaaacataacatgagtttaagctggggcaatattccccataaaaacgaactgctcgataactggctcattggtggtaccttagcaaccactgccattacaacgaccggtcacgcaacgagtctagccgttatggatcgtgaaaaaggacggttagtcgatttaatgttgactgatattcaccctgcaaatattcaggctacttatatttttaacggcatgattgtcggaaccatcatgcaactcgtaatgctgctaggattaaccacctactttcgcattacagatcagcttgggtttgactggtcactaaccccacaattactaatcgtcatggtattgaacgctgccacttggacatcctttaacgtcttaattcagtcatttattcgcagaatgtcaacactaagtacagtccattcattgttgggtactgccgcaggattttttgttggagtatacatgcccatcggaatgttgcctaaagccgctcagcacctgattgaatggacacccgcaccttatagcgcatctctgtatcgtcggatcctgctgtcacaacctttacgtgatacttttaacggacattctgtcgctcaaaccacctttgaaaaatcgatggggattgggattaacattaacgggctaactacgtggacaactgatacaataattttatgtgcatgctcttttattttcgcaattatcattgggatcgttgctcatcgtagccaacttctggccgttcaacgcagttaactatctccattgattattaacaagaaagaagtgaattttgatcaaaattcaatttgaaaaagccagcgagcttaacggagaaatagaaattgtcgttcgctctgaagaaatcacgcccgcagttctcacaataatgaaccaactcgaaactcttgaaaaaccgatccaaacacttgcactgcctgctgatgatcgtgttgtcatggttgctcaaaccgacattatccttcttgagatcaataaaacggatattactattcatactatcaatcatttatttcacattaccggccagttgaagcgaatgctcgctaaattaaaccaaaccgattttattcaagtctccaaaggagccgttctgaatcttaaccatctaaaaacccttgaagcagccttttcaggcaatatgacggcacgactaacgaatgacattaaagtcacaatcagtcggaaatacctacctgaattaaaaaaacaattaggaatgtgaggagatattttggataattttaaaactatcattcggcacgccggtactgggctcctaatcggtgctttaatgagtatgctcacaatgatttttgttagtcagtctgtaattaccgtttcacgttttcaattgaccgcaatgctggtcatgagtgctttaatcgggttattatcgtttatttttgatattgaaaagctccccttttatggggccataccgctacattttgttttaacagccatcatcgtatttggtactaaccatcttctccatggactattcggcgtaccatctcatctaggaatcatctacattgcaatatatataggagtttggtttcttctaaaaatttggtggtctctagatgttcaccgaattaatactcaaatcaaaaagcgcaaccaaaatcactaaatgaataagccaccttcccgagtcacaatatgtgacctgaggaaggtggcttattcgttatcaattcttaaattaacggttcgtttccatttcatcaacaaccggattggtatcacgttttttgaccacgtaaaagatggggagtccaatggccacaattgacaacgacgcaatggcgcccactggatctgaaaataattcactgatgatcacaaacagtgccccgacaatcgcgataatcggcgtgatgggatacaaaggcgttgaaaacggccgtggtcctggcatccgcttccgtagtaagaagacaccaataaaggcagccacgtagaagcaataaacggtaaagatgcaaagatctgataggtaatctgcattgaagaaaccaaccatcagactcgcaatggcgatgatcgccaccgtggcaatcattggttcgtgcgttttggcattcacatatgacaactgctttgaaaatggtaaatcatggcgtttagccattgcatacataatccgcggaaacgtcataatcttgccattcatacacccaatgatcgaaatgatcaccccaatgttcagtagccggccaccaatggtaccgaatgcctgagttgctaagtatggtgtcgtgttatcgcctaacttatggatcaggccagccgacaatccgttgaaaacaccaaacgtcacagccgtgtaaacgaccagcacgaacgagaggccaataataatcgccttaggaagcaccttttggggatttttaatttcaccacccaaattggcaatcagaatccagccatcatagccaaacaatgtggctaacaccgccaccccaaagttaccggcactagcttgagcgcccgcaacggtttgacccagcgcaccctgatgaccatagaaaaggccaaaaatgataattgccgcaatgggcaggagcttgcaacacgtcgtcacaatcgcaaatgcggccccataccggttttcaaacatgtttaacccaccaattaaaatcatggccgcgagcgcaagtggtacatgccaaacatttgaaaggccaaagaaacttaccagaagcactgctaaatatcccgcaagcgaagcgatgatggccggaccatacacgataatctgcatccagccagataggaagccccagatacgtccgtaaattttttccatgtagacgtatagaccaccggtgtaaggtaactgcgcaccgatttcagcgatcgtcaaaccggctgtcagggtaatgatccccccaattacccacgccagaagtgccatggttgaggaaccggcactgtccaagactgatgcttgcttgaaaaagattccggaaccgataactgtccctacgacgagggctaacgccgaccaaattcctaatgaccgctttaattctacttctggttgtttcatctgaatcccacctttttgataatctccgctcacggaaataacatttccgcgaaacaatgggaataagataacacgctcagtaattctagcaacctgtaagttataactttatttttaatttcaatctgaaatactgttatatcagcgtttagcgtccttctcagccacttttataaatatttttataataacatatcgttgatattttataaatatttttatttttagatgaatttcaaataccaattagtgatattcggttcttcactctattttcgtatacaccttcgtaggtatacggatgactaatatcaaccttaacattttacttatttttcataggaaacacatatattagcagttgaaaaaacatttagttggcgtagtatcgatactacaatctagttctgaaccacaaaggaagcacgcctatgatttatcattttatcgcggtttttaccgatccaaccactcaattaaaaactgcataccattatagtaatcaagctttaaatataatcacggccaaagaaactgattttgcgaatgaattcagccactgcccttacaccgcccatcgaatcgccactcccaatgccagctggcgctccgttattgaacatgattttcactttaaagcggtccaagtcacggaaagttttgatcgcatccggcaattagtgcaccacttggctttaactcaatgaatttctaaaagtacagcgaccttagtataataaagtcgctgtacttttaaattaatattttttgatacattcttccactaaatcgaagaatccatcatggtcaatctttcgaccgaccttagcattcggcgcctgtttcaaaacgtttaactcatcacataccgttcggccataacaaggcccccggttaatgtctacttgtacatacatcgcttgtgtttcaaatagatctgggttaattaaatatccaattgttgtggcatcatgaatcggcccagcttccaacccaaactcttcaaactgtgtttttaaagtgaaccgtaacagatcaccaaatagtttgccggcacgattaccaattgcttccatccgttcaataatatctggtgtgcaaattgtctgattggtaagatccaatcccatcatcacaattggtacccctgcgccaaagacaacataagctgcttctggatctgcaaaaatattaaactcggcagaaggcgtaaagttgccagttccgtatgcaccgcccatcaatacaatttccttaattttaggaataatcaatggctccattcgcatcgctgttgcaatattagtgagtggaccagttgggaccaatgtaatgtcaccatcactttttaatagtgtttcaataatgaactgtacaccgtttttcttttctgctgttcggtgtaactcgtcgaaaacggggccatctaatccagtagtcccatgaacattgccagccaccacttgtttacgcactaacggttgcggcatccccgcataaattttagcatcaatatctaacagctgtgccacattcaagccattatggaccgtttttgccagcgtttgattacccgcaacaattgtaatcccaagtaaatcaatatccggatgcgcattagccatcagcattgcgatagcatcatcatgtcctggatcacagtctaaaataattttacgtatcattattgtttccctccaatttgttttaatgtaaacccttacttacaacttgcattatactaatacgcctgatagcatcggtatgataaatctcataaagggagcaactattttgaaggaaatcaaaaacaggcaacttattcaacaatttttaaatgactgccacttctctgatcaattttcttttgatattaccaatagcgttaaattaatgtatttcgcaccccaatcctttattgtcaaggacagcgctaaaccagagtatctatttttcctagttcatggtaaagccaagttatatgacaacctttcaaacggaaaaactacgctaattgatttctttacgccgccttgctttatcggagaaatggaattaatcaatcctagtagtgtgcccttcaatatgcaggctctcacggactgctattgtttagcactatccatcgctgaatttcaacaaccgttgctaaacgatccaaccttccttaaaaaaatatgcacttatctttcccgaaaaaatgtcactgacattcaaacggccgccagaaatcaatcattcaccctttcgcagcggttagccgcctttattctgttaactgaacacgatggtatttacgacgaaaaacatacagaagcttcacaatacctaggtgtgtcctatcggcatttgctgtacgttctggcacagttcgtagatcaaaagatccttcaaaagcagccacataaatatcgcattatagatatgcccgctttaaataaactaagtcaagaagttactaattccaccaatcgatagggaacgccattaatttagtttctttggtacataaccgctttccaagtcacaatttgataatccacctaaagtgttataatgaaatatctttttgaaaacggagctctactatgacgattattctcacagtttttatcatttgtttacttgcagtacttatcggtgtcagcatctggtatcgttcgcttaataatcaactaatcgatctgcaattagaggcccacaaagaactcacgcccaaacagatttggcaggccagacgtagttttcgtcggcgtctgttaaggcagcaccggtttctttggggactacgctatttggcagtattttttgttgtcatcggcgttcttgcacttttctttgcaggtatggctcagtggcaaccctgggttctaatgcctacacgccaacagatcctgacttggctcctaatcggcatgaacgatcaacgaaatatcgccttatgggtagccgttacctgcttcttaagcggttgctttttatggggcgggagcgaatttaggttgctgacttacatggctgaacaagatggggataataccaatgttacattttggaccccacctaagttggcaaaacaacgttatctgtctcaactcactcgtatcattaccgtctgcattgccagtttaggattagctattgcctgccaagtcaactggctaccacaagccccttccgtattatcggctgttactcaacgcgcccaagactctgggcagacaacgtcatcgaccgttgttaccagtcaaagctctagcagtagcagcgcaactagtatcgatgatagtgcggctgcagattctagtagtactgcgccagctggaacaccactgggtgagatgcagcgttcatccttagcccctaaaagtcagttaaaaaatttatcaatgcaagataaagcaatcttattctacatggcatactgggcattaaatgggcaagatacagaaacattttttgccaatggcgcaccaaacacaacatacaactatcatattattgaaaatgggcaacatccaatgatcgtgtactcaacgacggataaaactactaagcaaacaacctaccaatattatgcatggatctacggagaccatgtttatttcgtcaatcttggtacttcgaatacaacatccattcgaagtatgaccgactcgcaatacaccaccctcaagaacggaacagcttatcccaacggagatccaatcaccaatagcaccctcaacattcgtcaattaataactgccttctatcaaacaaatggctatcaatctttcaaagataatatgaaagtgggtagtaccatcgaaaagtagctaaaatttggtgtcttattgttattagtaaagcgttaaaaattatcaaacatcattttttctaaaaataaccacacaaaaactccctctctagctaaattgcaaactagagagggagttgttttatctaaaacggcttttaaacaccaacttgatcaaaaatatagtcggcataccgcaaatgataatgatagtcgaacgcatcatcaatgtcggcaggtgttaagtgcttggtaatttccgcactaccttcaacaaggtcacggaattgaagctgttcatcccatgacttcgccgtcagaggctgtactaaatcgtaagcttgttcacgtgacaggcccttttcgatcagcttcaaaagcaaccgttggctataaatcaagccgtatgtgcgtgtcatgtttttcttcatggtttcagggaaaaccgtcaagttagcaacaatcttattgaaccggttcaacatataatctagcaaaatcgtagtatcaggcaggataatccgttctgttgaagaatgtgaaatgtcacgttcatgccacagtgggatgttttcgtaagctgtttggatatggccgcgaatgacccgtgctaagccacaaatattttctgaaccaattgggttccgcttatgtggcattgatgacgagcccttttgaccagccgcaaagtgttcttccacttcatgaatttccgagcgttgcagcccccgaatttcagttgcaaattcttccaaaccggttgcaattaagcctaacgttgcgatgtagtctgcatgcaaatcacgaggcaacacttgactggtgatgggttggcgattcagtcccagttgcttcataacgctcttttcaacttcaggtggcacattggcataggtccccacggccccgctgatcttgccggaattaacgccggcggcagcagcgtcaaaacgtttgatatcacgttcgagttcggtataccaccgcaatagcttcaacccaaaggtcgttggttcagcatgcacaccatgcgtacggcccatcatgaccgtattcttgtacttacgcgcctgttttgccacggtatctttaaacattaacaagtccttgcgaagcagttcattggcttgcttgagttgtaccccgttcgctgtatccacaacgtcggtactcgtcaaaccaaagtgaacccacttcttttcggccccaagagattctgaaacagtccgtgtaaacgccacgatatcgtgatgtgtcgtcttttcaatttcagcgacgcgttccaccgtaaaagtcgcattgtcttggatcttctttgcgtcctctgcgggtacttcgccctgttcaacccaggcgttcgttgctgcaatttcgacatctaaccaagcttggtagtggttttgttccgaccaaatttggcccatttccggtcttgtgtaacgttcaatcattatcgtgcactctccttttcccatggatcagtcaaaataattgtttgaagtctgtcaggcccaacagacaccgtcgataaggcgatccctgtcagttcactcaagcgtttgaggtagttttgcgtgttagcaggtaaatcttcgaagtgcgtgacatgcgtaatgtcttcagtccaacctggtaattcctcataaactggcttgcaagcagccaaatcgttgaggttagctggatagtaatcgatcttttcgccattaatttcgtaggcggtacaaatcttgatcgtatcgaggcccgtcagcacgtcgagtaggtttaaactcaaagcgttcacgcccgatacccgtttggcatggcgcatcgccacactatcgaaccaaccaatccgccgaggccgctttgtcacagtcccgtattcatgacccgtttcccggatgtaatcaccggttgcgtccatcaattcagttgggaaaggaccatcccccacacgcgttgaataggctttgcaaattcccagaacggtttgcaccttgctaggacctacaccaacaccggttgtcacaccaccagcaattggattagatgacgtgacgtatgggtaagtcccatgatcaacgtccaacataactccttgagcaccttcgaatagaacgttcttaccattatctagtgcgtcgttgacgagaacggaagtatccgtcacatactgtttaatttgttgtcccagatcgtagaatttatcgtaaatatcttcgaacttcaacggttcaacatcgtatagcttctcaaataattgattcttttcggccaagttagcctttaatttcgctgcaaatgtgtcagcatccaacaggtcagcgatccgaatcccaatccgggaaactttatccatataagtggggccaattcctttattagttgtcccaaccttgtgctcacccttggccttttcttggcacttatctaataggatatgatatggcagtgtcacgtgagcccggctagaaattcgcagaccagaaggatcaacaccttgatccttcaaatatgccaattcttcaacgagggcttgtggattaaccacgacaccattgccgattacactcaacttatcagtaaagaaaatgcctgaaggaatcagatgtaacttaaacgtcttgccatcaaatacaattgtatgaccggcgttgttaccaccttgatagcggacaattaaatccgcattctgactcaaatagtcagtcatctttccttttccttcgtcaccccattggctacccacgattacaacagaagccatattttgtcaccccattaaattcgattaagttcatatttcactcaccttatcagtgtaccaatcatcaaaaccaaggtcaagtaaaatccgaactttatccacgaaaaatattattattatccgtgattattgttgacaagcatcacagatacgattatattagcttatggtttacaacatgatttgtgaacccgaactacttttagcattacggatgtcacgtgaagcaccttggtgattcacggaactcaaccatttaaggagtggcaattatggacacatttgattacgatgatattcaactaattccgaacaagtgtattattaaaagtcggcacgatgcggacgctagcattcaatttggcccccaccggtttaacattccggtcgttccagccaacatggaaagtgtgatcgacgaaccacttgcaatctggttagctcaaaacaactatttctacgtcatgcatcgtttccaaccggaaaaacggcttggtttcgtgaaggatatgcacgctaaaaatctcttcgcttccatctcagttgggattaaggatgcagagtacacatttatcgatgaacttaaaggggcagatgaaacgcccgaatatatcacgatcgacgtggcccatggtcattccgattacgtgatcaatatgattaagtatataaaggaaaacttaccagaagccttcgtgatcgctgggaacgtggcaacacctgaagccgttcgtgatctggaaaacgccggtgccgacgctaccaaggttggcgtgggtcctggtaaagcctgcatcaccaagctaaaaaccggcttcgggactggcggctggcaattagctgcggttcgcctgtgcggtaaggccgctcgtaaacccatcatcgctgatggtggaatccgtcacaacggcgacatcgctaagtcgatccgttttggtgcttcgatggtcatggttggctcactgctggctgggcatcttgaatcacccggtaacatgattaagctcgacgaaaagcaatacaagcaatattggggctccgcttcggaagtccaaaagggtgcctaccgtaacgtagaaggcaagcagatgctcgtcccataccgtggtgaaattaaagataccctcttagaaatgcaagaagaccttcagtcttccatctcatatgcgggtggccgtgatcttgaatccatccgtaaggtggactacgtggtggttaaaaactcgattatgaatggtgactaattcgttagaagctgcacattagcatcataatgcgaattgattattaaacaaaaggtgatcgcaaatgcgatcaccttttttctatcccttgatgtaccggtattcctgcgtttgaccaccataaccccaagcatcgccggccacatcgtgcaaaaccacgtagcttgttggtgccaggtgaccaaagagcgtttgaaagttagtgaacgtttcgcgaacaaacgccgccttctgatcacgggtattggtcgccgccgtgattttgatttcaacgtaaaagctcgttgcccccgttgctgtcagtggttgtccgccaacgaaccaagttgctggatcggtaaaacggacatccactgcaacggcgctttcatcttttttcaactcggtcaccgccaagccagttaattgttgtgctacctgttgagcggtaaccgttgtttctggtgttgcaattctcacgcgtaagtatggcatcttgagttcctcctcgatatcatgttattgattaatcctagtttagcttcgtcacgcggttttgcatattaccggattatgatatggttatcgtaaattatgataagggaggtcatttttatgcaacttcaggatttcgaaatttaccgtcaactctacgaacaacgttcaatcaacggggtcgccaagaaaatgggattcgcacaatccaatattaccgctcgacttcaacaactggaaagtgaattcgacgcccatttttttgcccgtagttaccaaggcattcaaccaacagcagcgggaaccaaattttatgactatgtactaacggtaatcaccgccacccaaaatgtaacccatcaactacacacctcgcataccaaacaacaactcattatttcagaacttctcttcaactacctcgttattgaccaacaccagttcacgctggatcaaaccgagtttcaaattctggggtccacagctatcgaacagctcaccaccccgaccgtcgatcaagtaatcacctacgcccagtttcaccacatgaactattcagcgcttgcccaccaccgattagcggcaacttttcttactggtacctcgcaataccaacagttaccactactcgtcaatagtgatcgacgttgtccctttcgtgcccggacactcacgtttgccaaacatcgcgacctagccattcaagaaattgattcttggacaaacatcattaacctcgttcaaactggtcaaggcgtcgcactactaccatgttacctagcccgacaacggccacttcaatctgcttacatctcccagcagtacaggattccctacacgatctatcaacgtactcaacgttaataactcctaaaatttcgtaagattacaaatatccctgcatttccgtttcgtcggtttcgtatcagttgtataattggcgttagctttgaaagaaagatagggtctcaagttatgccaagacaaacacgccaggagcgctacaatgcacggccaccgcgtcaaaaccggggaattatttttttcatcatcatcgttgtcctgtttggaatcgtaaaaatcgcgcacggcacctataagtcattgagtgatacggtcacaaattcataccaaaaggcgaacatcaaacaccggcgagatgttaacaccgtcattaaacataaaaagcccctctcaattttgttgctgggaaccgataccggcgagttaaaacgaaccgacaaaggacgaactgacaccatcatgttggtcaccattaatcctaaaaccgaaaaaacgaccctttattccattccacgggacacaatggtcgcaattcccggatatgaaaaagactttccgtcaaaaattaactcagtttacacttacaccaatattagcgacacagtgaataccatctccaactatcttaacgtcccgatcgactactacgcgttggtgaacatggggggcttggaaaagctcgtcaatcaagttggtggggtcacgattaagtcgccgcttaccttcaccttcagtgccgacaccgcccatgaaaccggaaaacatcgctataaattctatcagggttctagtacattcaagtatgcggccgatggtcaccatttcaaaacctatcacaaaatgaacggggctgccgcactagccttttctcgaatgcgctacatggatcctaacggggattacggtcggactcaacgacaacgcatggtcatttcggcaatcctcaagaagacggccagcccacaaatgctgtttaataagcagttcatgcactctatttcggccaatgtgcgaaccaacctcacattcaaagaaatgctctcgattgcgggggcctattatcaagccaaaaataacgtcgtcaccaagtccgctactgaacaaacggtcatgcataatggtgtctcataccaagtgctatcccgttcagaaaaacaaaaaactaccaatcagctccgtcaaaatcttgatttaaagacggccaaaaccgggccgatcgttgctggtaacgctaagaaagtacacattccgttcgatattgaaatggcgctaaaagaataatagttgcactttattaatgagaagccgctggcttctcatttttttagaccatttttggtcgttcaatcatgaacaaactaatcttttttattttttcatcacaaaactgtagatccccgatatagataggatttctgggactttttaagttagacttgaccctgtttttttaattagtttgttgcgtaaacaaactggaagcgctatactaatcgtcatgaaaacggttactgcatttttgaagttatctattagacaaattagcatttatcatgaaataggaggcattgtcttatgacaaatagttcgacgaagcaccgcttaccagtcggcttcatttacttcttcggggcccttggtgggttgctctttggatatgataccggggttatctctggtgccatgctctttattggaaaagaattgcacattgctacgggatcttttgaatacggtttcatcaccgcatctgtcctattaggagccatcttaggggcggcaattattggacctctctctgatcgccttggtcggaaaaagctacttctaaccgctgctatcatcttcttcattggcgcgatgggatctggtctcgcaccagattatgccctgctggttagcttccgggttctcctcggaatcgccgttgggggtgcgtcggctctgattcctacctacttggctgaacttgctccagccgacaagcgtggtggtatcgggtcgctcttccaattaatggttatgactgggatcttctttgcttacgtctttaacgaatggctctcaccagaaggcctcttcggggtttcacaggctcatggttggcgctggatgttagccctcgccgcagttcctgctgcactgctcttcttcggcggattgctcttacctgaatcaccacgattcttggtcaaaacaggcaaaatcgacgaggctcgccgcgttttactccaatttaataataatgacagtatcgtgaacgaagaattacacgatatcaagcttcaagcttctattccttctggtggttttaaagaactcttcggtccaatggcccggcccgtgttgatcatggcgcttggactagcgatcttccaacaagtcatgggctgcaacaccgtgctctactacgccccaacaatttttatttctgctggatttagtgaacattttgccctccaatctcacatcatcatcgggatctttaacgtggtcgtaactgccattgctgttaaaattatggacaaaatcgatcggaaaaagatgttaacgtacggtgccattgggatgggggctgccctcttcgtcatgtctgccgctatgattttactgaaggccggcgacggtaaccttggctcatgggtctgtgtcattgcgctaacactgtacatcgcctgcttctccgccacatggggccctgtaatgtggctcatgattggtgaagctttcccactaaacattcgtggacttgggaactcattcggagccgttattaactgggcagccaacttcgctgtttctgaatccttcaccgttttgctggttgcctttacaccaagtggcgttgcgaacgctgaaggtcaaggaattgcccgcctctttatcatctatgggctgctatgctttgttgccatctggttcgtggctaagtttacaatcgaaacacggaaccggtcactcgaatcaatcgaagccgacttacggtcacgggcccacgctaaggggtacaccgaagctggtgaaccaggccaaaagtaactaaattaaaactaattactcaataactcaataaacccggcatgaaattaattaaaatttcatgccgggtttttaagtatctagcttaacgaatcagcccaaaatagataaccactacgatcccaataacaattcggtaccaaccaaaagccttgaaattattgttgcgaatatacgcgagtaaaaacttaatggaaagatacgcgacgataaacgaaaccacgacgccggttagtaggaccaccaattgcccgccagtaaaggtgttgccattcacaaaatatttggcgactttcagcaatgatgccccaaacatggtcggaattgctaagaaaaacgaaaattcggtggcaacatatctggaggccccaatcaaaatcgcgcctaaaatagttgccccagatcgtgatgttccagggaccatcgacaaaatctggaagattccaattaaaattgccgttttgtatgataattgattcaaattcgtcaatttagccgtgcgcgttcggttgtaattttcaatgacaatgaacaaaataccgtacacaatcaaggttgtggcaatcacctgccagctagtcaaatttgcttccaaccaatcattcgctggtaacccaatcacgattgatggtagtacagccacaatcactttaaaccataaactccacgtttgacggcgttcaatgacttgcttatttctcgcccacggattgagcttattgaagtaaagaaccaccaccgctaaaatcgcacccaattgaataaccaccataaacatgttaatgaatgcggtggactcatttagcctgacaaactcgtccaccaaatacaaatgtcccgtcgaactaatcggtaaaaattcggtaattccttccacaattcctaaaatcactgccttaataatctctatcacaactctagtacctcccgacaacatcattttttcagatcgtcaccacaaattcacaccgatcaaatgcggtcaaagtgccccattcattctaattggttaaatcatcatctcgtcgaactaccttgatttagcacttggcgataaatttcgcgcagctgttcagcatgtagtgggactggattattcttcaatcgttgaacgttaactgctgaaactagtgtctctaattcagcagtattttttaactgtggtctcaatagttgtaagtcatcaatgaagtgattcaaccagtcaattgcttgcattggttcttggaaacctaataaataagcaatttcatcgaaaacctggctcagctcttggcgttgttgtggatcctcaatcaaattcatatgaacaagcatttcgcgccaaacggccggcagacacagtcctactgcgtgcccgtgggcgatatgataatttgtggttaattgatagctcatggcgtgagcggccgtcgtagtcgtgatgtcaatcgccattccagcataatcggcagcctgcagcattgcttgattagccttattttgattcaccaaaaatccttggtgggcgttcaaaatgagttctattgctttactggcataccgtcgactagtattcgtggctttaagtgcccaatatgactcaatcgactgacacagtgcgtcgagcatccccgccttacgctgatattccggcaatgttcgtaacaactgagcatcgagaatcacatagtctggccgtaaactttgatccgcaattgaatatttcgtttcccgataatatagcacggcaaagtgggtcgcttcgctgcctgtccccgcagtggtcggaatcgctaagtgtttaagctcactaggcagtatcggctgttcaacgtatggtttcgctggcgataaattatgaaacgccttaatacacttcgccacgtcaatagaactcccaccaccgattgatactaaaaaatcacactgctgatttttaaaccatgccattccctgaagtacttcgttatatttcggattagccgagaaatcactaaacacagttagttttcttgacgtatgttcaatatgcttgatcaggcgttgcacaacttgttggcttcgtagtgtggcatcacagataatcatcggcctttgaacactcaattgatcaaatatttttagtaacgttgtcgaaaaggcgccattaatgcttacttttcccaaaatattcatgttagcattgtcagtcccctcatcagttgaccattgccacaatttcatatgtctgcacgagttcaatcaatcgctggatatcggctgtagtcacctcaccgatactgccaatccgaaaactattaatttttgatacctttcctggatagatgatgaaccctcgttgacgcaggaaatcataaaagtttctaaaatcaaacgcactggatgggtatttgaatgacgtaataatcggtgattgaactgcctgattaatgactggtcgatagcccaactgcatcatttgatcccgcaacatctgctcattttgttggtatcgtttaaaccttgcagcaacgcccccctcttgcttgagttcatgcaaggcttgttgaaacgcataaacaacgtgcgtaggtgaagtaaaccgccacttcccgtcgtgttcctcaaaacacttccattgatcatataaatctagtgaaagcgtattggcatttccctctgtttgctcaatcacaaccgtcttagcaatgacaaatgaaaatccggggacaccttgaatacatttatttgaactactaattaaataatcaacctgtaactcatcaatacttattggaacaccaccaaagcttgacatagcatccacaatcgttaaaacaccacgacgcttcaaagccggtacgatcgactcaatcggattcaatattcctgtcgtggtttcacagtgaactagggccacatgcgtgatttcagggtgtaggtcaatcattgctaacaagcgctcaacatccagcggctcatcttcagcaaattcaacttcaacgtgtcgaaccccaattcgctcgacaatctccctcattcgacgtccataagccccattgatcgcaatcaaaagaacggattcgtcattcaatgcggtgctcagtgttgcctcgaccccataagtgccgcttccttgaatcaaaacactcgtatagtcagccggatttgcttgaccgaccgccaacagttcctggcgaatctgctgggtgacctgtttataatcatcgtcccaagtcccatggtcgaccatcatcgtttgtttaacggattcactagtagttagtggtcctggtgtaaggaggagtggggccgcttcgtgtgtgggcatattcaattgatcgatcaggggaattaagtctgccatcgtatcgaccgtaaagtccgcgccggcgtcttcaaatgtttttctagcagtttgacagtattcttgacgctgtgattcgcttaactcatcaaattcagcggctgaaaggccaatgacattactgccttcaactacaccgacagaaattgtatgtgcatttttaccctcgagaatatcatttacagtgtcgccaattttgatcacagtttgtggatcatcaatatgcatccttttcatggccaagttcagcattgcagcctgcggtcgaccaatcagatcggtttgttccgaagtgatgttgatttctggttggtatccttgccgagccgtcatttttaaattttgtgcaaccatcgattccgtatatcccgatgtcgttgctatctggagatgatgctgattcaaataattaataagggctttcatgcctggttttagaatggccgtctccccaattacttgggccacctccgtctgaaactgcgcataaactaactcaaccgccgcctccagattaacctccggatgttgtgtttgccattgttgccaatttacaggttgtttcaatatcttttctacatgcttaattttatccagtccaacgtcagtgcgaatcgttgcctcactcagcccaattccaaaacgagcaaatgcgcgctgaaaggcaataatgggtgcccgactaccgtagtcaaccgtggtgcccgcccaatcgaatactactgcttgaattgtcatttgatctcctccatctttcctatgcttcaataaatttggctcttaaccgtcttgaaactaattccaaaccaaacgtaaaggccaaaatcagataaataatcatccctacctcgtgaaaatcaaagtagaagctgcttgccatgtagagttgatacccgataccgccggctccagcagcagcgcccactaccaccgcattcgcaaaattgatttcaaatcgaatgaatgtccaactcaataatcgagacttaaccgttggaattaccgcttgagcaataataggtaatatcccaatgccaccaacttttaacgcctcaatcgtgtcctgtggcaattcttcaatgctgttagcaaatactttcgcaagataagccacactatgaaatgtcagtccaattacggcggcatcagcccccagtcccagtgacacactgtaaatcaagacccataaaatagtaggaatcgcccgaattgatgccatcaagcttttcataatctgtgatagccaccgtggtgccaaattattggctgaaagaagggccatcacgaacccaccaaaagcccccgcaatggttgttaaaccagctaaatagatgctttgaccaagtgcggacaataacttagaaaaagtatcattccccacattaggacttaaaaacattatttttaagttccccatgaattcattcaccgcctcgattaccttaaaatgggcgggaacaatggttgccaaagtataaatcgtcaaaattcccaagactgttaaaacactgttaatcgtcagtttacgccggcttagccgtcgtttctttttagctcggactcgaacttggttttcaattaccgctctttgttccattatctaatcgaccttccaattctgtttgacgagatttctaagaaaatgaccaatacggcaattgaaaccaccaccattccggccgcaccatattgcaaacttttaaaatacagatcaaaaataaagccaattcccgttccagttagtaatcccaccagggtcgcatcccggatattattttcaatcatatataatagccactcgattaatggcactgcagtttccggtaacatcgcttggacgactgaagtggtgtaggtggcccctgttgtctggatggcttccatctttttaacatcaaaatcttcaaaggtttccaaaaaagcacgggtcagaaacccaatattcatgaacagtaatgctaaaaatccagtcaattcattttgtttaaacgaaaacagtaagatcatcgcccaggcaacgatcgggatgttccgcataactgaagcaaaaccgcgaatgagccatcccactttccattttgacggccccacgttttgcgcacccagcattcctagcactactgcaatcaccgcagcacacgatgcagccgcgaccgcgatcaaaaatgtctgccacagttgtgccaaaatgtcgggcatatattgcaaactattcgcatttggaataaagttctgtgccaaccaaataatgcctttgtctgtcgccaaccacgcactagagttaaaccccgtcagtgctgcggcagcaaggtaaagaactacaatttcagtaattaacagtaataatcgatagttgcgatgcctaaaaaactgatgggcactttgattcatcaaatcatcccctcgtctagtcataaatcgttcgaatggcagcaacgtctaacgctgaactggggccatcgaacacaacactcccagctcgtaaaccaataatatgatcagcatattccttcgccagctcaacttgatgcaacgtcacgacaatcgtcattttcttttcaattgccaatgcccgtaagatatccatgactaacgttgccgattttggatccaacgacgcaaccggttcatcgcatagaataatttgtggatgttgcatcagtgcccgcgcaatcccgacccgttgtttctgaccaccgctaagatccttgcactgcttgaaagcaaattcttctagccccatttccttaataagcgccagtgcctcttgctgctccttatccgaataaatggacaaaattccaagcaatgttggcttaccacccaaggtgccatgtaaaacattttctaaaacggtgagtggttcaattaagttataattctgaaaaaccattccaattttgcgcctcatttgccgcatcttgctccgattaagggttctgacatcgagcccatcaatcaaaatttctccctgatcatccttaatgagttggttgaggcttcgcagcagggttgtcttccccgcaccagaggggccaataattaccgtaatctcacctttttcaatttccatcgaaatatctttaagtgacatcgcttcttggtcataactttttgacagttcattcactgctaacataccgttcgcctactttcctaggaccttgtgggttggtgcataccacttatcgctgactgcaataaaatgcgttttaccctctttggtaaacatccctcgtgttttagaacctggtttggcaaagaaatgctgatcattggtaacctcctttgaagtcagggccttgacgattttcttcacatctgacttgctgacctttgcctcattcgcaacaatgggttcattttgaacagcataggcagcaatcgccgtgctctgcttaccacgaactgcgttgaacggtgccggcgcatcattattaacggtataagtggcgccagcacccgtcttattcccgctaaatttaccgtagctcaccatgtcaatgtcatcaaatgcggcaacatcagcatcccctttaaaaagatttaacgctgacccttgatgggattgaccgtatagtacttttgaaaaaattgcgccgctcttttgtaactgcgcttcattttttaacttaaaggttttcttcagggcccctgctgggattgcatagcctgatgtagaagtggtagatacaaatgaaatccgttgatgcttgatcttgctcaaatcatatttaccattcgtttgatagttacttgctttattctttggcaccatcaaataactgtaatattttgcatcttttaacgtacccgatttgccagaatatgtgactaacggctttacctgactattttgtttatgggcttcaatgtatccatcaggacccattaacgcaatttgcgctttcccagacgaaattgcattaatggcaacgttgtaatcagtcgtcgtttgcacctttacctttttaccggtcgcctcactaatctttttactcaaatccgtacgtgccgcggattcttccttagccgaatcacttggaagaaagaccaccgtcagtgttttacttgattgactcttactagaacttgcacaccctcccagacttaagacaatcccaagaagactaactgccgcaacaattgtctttgataccttgttcaaaaaaatcaactccctcctatggtttcaacatcaatatacctgctcgatgtaaatgcaaagtaaatcatatgtaacttttgaattcataatctttaccatgtaaaatcagctcgctaaaaaagcgtttataaatctcactaagatttataaacgcttcatttaattttttaaacgagaactcccggtttaacactctgtgccatttcaaaatcatccgttataatgccagcgactcgcttttcaaaaagttgcttcatcttttgtggatcatctactgtccaaattcgttcttctaaattaggcaaattttgatagtacttaagatgaacccctgacaaatgtgcaatctgtgctagtcgttggggctggtacaatacgtggtcagataataagcagtattgctggtgagcatccactcgatatgcgtttttcaatgtttggagcgaaaacgaagaataaataactggatataccaaatcgtagtcacgcaccatgtctaacacaattttttcaatattggtatagtgcactcgatctgttttaaattctaaatttaagtaaacccttcgctgtgccacaagctgtaatagctgttccagactgggaatcgtttctccatttgatagttgaaactgctgtaactcatcaaaagtatactgtcttattttgccgtgcccatttgtcgtccgattaattttttcatcatgcataataacggggatattatcttttgtcaggtgaacatcaaattctaatccatcaattgcatggtcaatcgcataactaaatccactcaacgaattctctggaaatttagctggatacccgcgatgcccaaagattaaggtttcatcaatcattgtgaactactccttttttacccgctgactaatttcggaatcaatagttgcaccaccgcaaaatcgagctaaacgtgcccccgctctcttttacacggacattttagcaaggcaatgtaaaagtaaagtcaaagtaatgtaaaaattccgcattaattttaatgagaatattctaattttgaatcgttctaaactagaaaaagaaggcccaatttacgtgccttcttttcagctattctaattaagaattagtatcatctagagaccgaaatgccgttatcatgccgtttatccgtaattggaccgttgactgatttttctttaaatgagaaaatgattaaaatattaacttcgacaccaaggagggcaggagacgtgaaaactttagctgaacttaatcgccgtggcaactacattatcatttcagtaaatggcgaccataaactcaatcgccgcttggccgaaatgggaattatcgccggtaaaagcatcaccattatttctacttcgaacggccccatgggcatgatgatttactttcagggtcagcgactggcaattagcgatgagatcgcgcaaaaaattgccgtccgtaatattgctgaagacgacgccgtggagctgcaaaccatgtccgaattgcaggtcggtgaatccgggatcgtggtgaagctcgtcggtcctaaagcgctccgcaaacgcctgcttgatatggggctaactcgtggcaccctcctaaaggtcaatcaaattgccccgttaggcgatccaatcgaacttctcattcggggatacaaattaagccttcgcaaagccgacgctgatagcattatgattgagaaagtctgaggtgattaaagatgacaaccctagcactcgtaggaaatcctaatagtggtaaaaccaccctattcaacaccctcaccggttctaatcaacgcgtcggcaactggcccggcgtcacagtagaacgtaaggaagggcaactcaaacaagaccacaccatcatgattcaagatctcccagggagctactcgttatcaccctacagctccgaagaagtcgttacccgtaacttcttaatcaataaccggccccgcaagattctcgacgtggtcgactctaccaacctagaacgtaacctatacctaacgcttcaaatcatggaaactggtattcccatcgtcttgattttgaatatgatggacctactagctaaacaaaaaaatcgcaccatcaatatgaagaaactcgcgtacatgctcgacgttcccgtcgtcggcatcagcgccttaaagcataataatatcgacaagctcattgataagattcgggatgacgacccacgaacttattcaatgccaagctacgatccacggctagaatcggccattgaaatgatcaaagcccagattaaagatcgagtacctgaagatcaaagccgttggtttgcgatcaagctcttcgaacgcgatgaagaaattactgcccagttcgagttcgatgcgcaccaagcccaagaaattgaaactattatccatactgccgaaggaatcttcgacgatgaaagcgacagtatcgtggtgaacgcccgctacgactacattgcccgcatcgttaatatgtgtgtcatcgatcacggtgacttcaagatgtccgtcagtgataaaatcgaccgaatcgttactaatcgttggctagcgctaccgattttcgtcctcatcatgtggttcgtgtacttcctctcgattcaaacaatcggtaccattggtagtgactgggtcaacgatcacctctttgggaccctaattccaaacacggcgacccagattttaactgcttggcacgtggcaccatggctggaagggcttattgtcgatgggatcatcggtgggattgggtccgtcctcggctttttgccgcaaattgcaatgctatttttgtgtctcggcattttggaagactgcggctacatggcacgcatcgcgtttgtcatggaccgtctttttcaccactttaatctttcaggaaaatcgtttatccccatgctaatcgcaacgggctgtggcgtacccggaattatggcgacccgcacgatcgaaaatgaaaaggatcgcaagatgacgatcatgctgacgaccttcatgccctgctccgccaagttaacaattatcgcactggtttcgggaaccttcttcccgcacaatagctgggtcgcaccatccgcctactttcttggtggcttagccgtcgtctgttccggtatcttcctgaagaaaaccaagatgtttagcggcgatcattccccgtttgtgatggagctccccgcttaccacctgccacgccttgataatacgctgcgtagtgtctggcaacgtgcctacgccttcatttataaggccggaacgatcatcttcttgtcttgcgtccttatttggttcctctccagtttcaattttcggatgcaaatggtcgaccaaaatcatagcatcttgcgcgccctgggggccgtaatcgcacctatttttgcaccactgggattcggtgattggcacgcaaccgtggctgttttggcgggcctcattgccaaagaaaactgcgtcggaacccttcatatcacctttatgtccggagcaagtggcgccagtttcaccgaactcctacgtgccaactacagcgcaatggccggctattctttcctcgcctttaacctgctgtgcgccccctgcttcgcctcaatcgggacgatgtacaaggaatttggggatgcccgttccacttggcgggccgtcttctatcagacatcagtggcctatatggtggccctggttatttatcagagttcacagctgatcaaccatgtcttttcacctgttggcctcgttttggcagctattgtcgttgccattattttctacggtctctttgttaaacacgcccaaagcgataacgaagccgttatcagcctctaacatagaaaggaagcttttcccatgtcaaccatcatcattgctgtgattctattcgccattgtcggtgccgtcttttacaatcgattcttgaaaaagggccacagtgccgctagttgtcacgaatgctcagagattgggtgccccttagtcgagcaggcaaaaaccgttaaaaagctatctaagcatcaggcctaacgacgccttccaaataaccgtgcgaaatgtttgtattttcaatctagagagcactataataatcattaggatgtgttaaccattaacaatcctcaattattttgtgatttacagcggtttgtgataaagaggtgatcgatatggcaaaattaagtaaagaacaacgcaaggccatgatccaaaaggccgaagaagatcgtgcaaagcaccctcaatcaaaaaagggctctggattcgccaatcttgataaggaagccgagcgactttcaaacgaaaactagaaatttctcttaactagatattctaattgagagacaaacaatgaaggcagtcactacttagtagtcactgccttcatttattatttacataaaattcagtctggataaggcgacagttaaagcagtcaacgcttaattgtcataataatcttacccactgcgttcgaatatcattaaaattgaaatgctttaccaggcaatcatctaatcaatcttaatgaacaaaaatactaatcaataagacaatgaggagcccaacgaaggagttaacaaattccaaaaccccccacgttttgaacgtatccttaagtgaaataccgaaggattgttgatagagcaagaagccaccatcccacataagcgttgtcgtgttactcccacaggcacaggccaacatcataagtgctggattaacatgaaaagcaaccaccattggtgcgacgattccggcagcagtaattgcagatactgctccttggccggtcatcaatcgaatcaaaaccgtaatgacccacgccagaatcaaaggggagatgttagtatggccaactaggtcaacaatcttattaccgatcccgctatcgataattacttctttcatcacaccaccagcagcaattaccattaaaacattactaatactagaaattgcgtcggacatatgtgcagagatctgtttaccagtcataccgcgacgatagccaaaaaggatcatggctacaattacagtaatcaacatactaatttctgcgctcccaataaaactggcaaatttatatgttgtagttgttgtggcagcaaagctttttgcaattgacgcacaaataataataattgctggcagtaacggaataataatactaattttaaaacttggaatttcatttgccggcttcttaggtgccggcttcatcacgttacctaaaggcatatctgccaacccaggaataaatcgttgcactagtacaccagaacaaataatagtcggaatgatcacaattgccccaagaatataaacctgagcgatatttgcatgaaacgccgtcactaacgccatgggacctggttgtggcggaaaaatactgtgccccatagtcgccccggcaatcgttggaataaccaatttcatgtaaggcaccttcgcctcgtgcgcaatgttaattaccaatggcattgtgattaagaacgcaacttcataaaacatcgacatcccaaaaattgtaccaataatcaataaggcaaatggcagcaacttaactcccattgcgttaacaatggtatccgcaatttgttgtgaagcgccagattcagtcatcattttcccaatgatcgccccaaaaatcacgatcagaaccaatgacgccataacgctgccaatacccttttcaattgtcgcggcgatttttaccattggcatgccttccgcaaaggcaataaacaatccagaaatcaaaagtgcaatcacattgtgaatcttagtcttaacgatcaaaaagacaagtaacaaaataccaacaaacacccataacagggccaataaatccgcagccataaccattctcctccaaataataactaatcaaactaacatatcagtatgcgcttacataatatcttaataattagacgtttgcaatacaattgacaataaatagtcctaaatattctaaaatcgtttaatatataggacaaatctatttcaggaaactaatttatccggataacttatatatcagtaatagttattaattaattttcatctggcttgaatcctctttcggcacaaaaatgcccagcaatttaactattgctaggcatttttttaagtatctatttaattaagtgaaccttttttactatttcgttaataaaattacgctctaacttgggttgcttccgcttcgtgttgtgataccacacccaagtagtaatcatcgcgttggaggtagtccagcgtccgcttagcgtctgcgccttcaaatgattcaatgatctggaaggcttcgcgccgagaaatatgttgcaggtcatccgttatccggccttcttgtgttgcccgtagtagatcactggcttcacccttgttgcgagcccgaagcacatacgagttgttgtattgatcagtgcatacatagtagaaatgacgtttgatttgtgtcaccttttcacgatcaacagctggtcgcttggtgtttttcagtaattgattaactttgtccaaatctacacgaagttgattgtaccgcttacaaaacagacattgctgtccttcgccaatttcgtgatcactctcttcttcttcatggacgttcatcaaatccagcagttcgcccatcaaaataccacgatacttctttaatttgaaccgacattgatcttcactactactcatcatgtgcgttcctccttcaaaaccaattattttattcgacatttgagttatttctgaccaaagtaaatatctcaaagttattaattcacgcctatttatggcagttatcatttgtacgggtttacaactttaagaataattcacggagctaactatgtcgatggtgtcactctctggtatttttgccaaaatttaaaaaaattgagagagttttttgagattaatttaaaaagttcgaccctaaaatctcggtttcgggatacaatagagttaccaaagtaaatacgtggcttatcattttgattcaaacgggtgatcagatggactaccagcttttttttgaagaggacgacgcactttattatcaaattttgcagcaacttattcgtcatcatggacagcgtgtttcggaagctcagttacaagaccagttttcgcttacgccttaccgacttcacaaggcaataacaactattaataatgacttaatgaccatttccaacgcggataatccaatttatctggacgaaccggaaaagggtattttacgtggcaatcagatcacaacggtcgcactccaaaaggtgggtttaatctaccttcagcgttcactggtgttcgttgtttttgagtaccactatatttatgcccatcagtcttccaaaacagactacatgaaggaacattttatcagcaatgccaccttctaccatgctgaaagtcgcatgaaaaaaatcatcaagcagctcgacttcagccataccgtggtcagcaaaagcttaacgagtaccgaatatatgacgcggttgcatctctttcagctctactacaccgcctataacggtatcgacagcccctttagtgacctagacccattgatcacaatgcttattgatcagttgaaggccgtctttgacatcagctatacgccaacgcgcctcaataaattgtctattttcttgaaactttggattattcgggtcaccggcgaaaatccagtggcagctaatttattaaccgacattccacaatcgctagtcgaccagcttcaggcaattcgagcgctccttgctaaggagtacctcatcaatgttagtgatgacgaactcgactacctgtataccttcctaatggttcaagattacatcgctgtcgatgtgacacgctttagtccagacattgtccctgctgctaaccatctgaccgatctctttatgaaaaacgttgccgctcaccatattctggtggatcccgcgcagctcacgcaattaccacttcgcgataaaatttctaacatccatatccaattcacaaccttctacattgaacccacaacctttgtggacgccagccaggtaagcttctttcaagaatcttatccgctctttgatgaagttgtgagcagctttattatgcaactccaacgtaattccgacttcaaatttacggcgaaagatgccacgaacctgtacttcagttacatgtttgccctcattaacgcaattcccaccgcagcactggtagataaggtttacgtctgtgtcgacttttcacagggtgacctttacactgactacatcgtgagcacactccaagctttcaacaacgcccatattgtgatcgaagaaaatattagtgaccatacaaacatctacctgtccgatttttattctagtttcattacccaaccacagattatctggcaagatccgccaacacccactgattggggtcaactggctgacaccattatcgcctgcaaaaaggcgcaggattaggtgcgcacccgagaggaatttcatcatggatactcacgaaaattcacaacaatcgcataatattagcgcgtcaaagcgctggctctggggcagtttgctcaccgtctcaactctgagtgcactcacgctagccacaccagctcaagcagcttcttcggccggctatcaagatgccaccgtgcagcccgccactagtaacccaatggtgtccgacgcttcagcagagaccacatcggctagtgccatcgcgtctatctcgggcagtgccctcgcagccgacgtgaactcttcggcagccaccgacgcggccgtcacagcagattcagcgaataccgcagattctgctacaagcgctactactgatagtcagacatccaatccaataactaccagtgccagtgcaacgattaccatcgcagttgaaggtcagaccacccgaacagtgaccgtaacgggaaccttaggggattcagttgcggaagcttttggttacccatcactaacgcaatatgatactgcgcagtatgatgtcacaacgactaacggtgttgggacctttaccaacgatcagagtgataatgtgacgattacgatcacccataaacacgtttataccgactttgaacatagtggactcaccacgcaaagaaccattacctttgacaacgtccccgcagacgctgacggtacggttgctaatcaaacacaaacggtcaaatgggccactgatacggacctcgttactcaacaaacaacgtatattcctatggcgagtgcttatattcagtacgtttttcaccaaccaaccggttatgacgccaccagtaatgacgtccaactgactagtagtggtcaaaatataatcgtgactgctgacgcactcagttcaaccaccaccctgccaactaatcgggcggtcattgtgacctttacaccagcgcttattaatggccaaattgtgttttttgacgatgatcgtgacggtgaacaggtcgttaccattgaattttcaggttacacgaatagcctccaattcaagattccgacccactatgtcgtcaccaatttacccgtcgttcttgcgcaactgcgtgatagtgatgaactggcttttaatagcaccgccatcggtcaaaatatgacgttcaacgtgtatctcaagcaccagttagaaacaacgacccaatccaaaacgattacggttaccatcgcaaataatcaagctcaaaaagccttgacgttcacccgaacggcaaccaccgatttagttactaaccaaaccagtgttagcgactggaccacggacgatcagtttagttcactaaccacggatgacggcctcactacgtttgacgctcaatcggttctttccaacggaaccacactggccacaacgattgccaattttgctagtcaagccgatgctaccagtcaaaccgtttcgctaaccgcgcccgaccacgtcgtaaccaccactgaacacaaacaatttttgatcaccattggtggcaatcaaaatcaggctaccgttaacttttcgcgcacaaagaccaccaatttgacgactaatcaatctacttacagtgattgggtggccgatcactccttctcttcattgactacggatgacggcctgactactttcaactcgctgtctgttgctgataacggcctgacaattgccgaaaatttggccaactttgccactcaaacagacaccagtgaccaaaccgtttcactcactgaaccgcaacgattttccactacaactcaacacaaacaactcactgttggtgtcgaaaacaatcaaagtcaagtggttattacgttttctcgcacaaagaccactaatttgacgactaatcaatctgcctacagcgattgggtggccgatcaacccttctcttcattgactacggatgacggcctcactacctttaactcgctgtctgttgctgataacggcctgacaattgccgaaaatttggccaactttgccgctcaaacaggcactagtgaccaaaccgtttcactctctgagccgcaacggtttaccactacaactcaacacaaacaactcactgtcggtgttgaaaacaatcaaaaccaagtggtcattacattttctcggacgaagaccactaatttgacgactaatcaatctacttacagcgattgggtggccgatcaacccttctcttcattgactacggatgatggccttactacctttgacgcccagtcagtcactgctgatggaatgacgcttgcggcagttttagccgcctttgctaatcaaacgaacacagccagtcagacaattacactgaccgaaccgcaacacctcgtcacgacaacccagcataaacagctcactatcacactagctggcaatcgcgcacgggttacactttacttcacacgtatccgcactaccgaccttgtcacccacctttcaacatacacggactgggttagcgatgagtcattccaattaacctctgacgacggtcaaactactttcacattgcagtcattagccgacaatggattatctatcgcggccaatattgccacatttgcgcgccaatctggaaccgcaagtcaaacacttcaactgacaaatccagaagatcaaaccagtgcaacggtcatctacaccgatccaaccactcagcaaacagtcacctcccagacactcaaaggtgccgttaacgccccgatcgtcttcacgaccgttaatcacttggccgcgttacaacagcaaggctaccaagtgattagtgatgagactgcgctgccacaaacatttacccgcgcacaacaagttttccacgtcacagtcaagaaaacggctaaggcgaccccacgtaacgccatgcaagcctaccaaaagtactttccaacatctccaagcgtcaaaaaaacgacgactaaccaaaaccggcacgctacacccagccactacacgaccagtcaacaatcagtcaacgacctcaaaaagagccagttaggtcctggccatcaacaagtggtcttcggtggcgccggttcatcgcacgcttcacacgccattggtggcggaaacgacaatatcacgacagaactgggccaatttttcgtaagcctatccggaacggttaactttggctacgttgattagtccacgcgtgtccctaaaaacaccaacactatcaaaaaaatgcgtaccgaaattcatgaaaaattgaatttcggtacgcatttttacttgttcgatctttaatttcgcgactcattttcagtcccgaatcaaagactagtctcccgtcacaaaaacaatccggttggtcgtctccgttggccaattttcatgaactgtactcaatgggtaggcggttactggtacttgtagggtaccatcgctaatcaacgtcagtaacttcggcaaatacgttactaaatcatgggcagaaaaagagccctgcccactgccaatgagtgacaatgcggtacttcggagcgccgccgctgggaacgcaaagctactgcccgctaatgaaccaatctctacccagttcagtagttgatgatggttctggcactgcttgagcaatgctgacatcactcgtgcggtgacgtcaccccatagatagtccagcaccacatcgacgtcgctcacctgccccaattgtgcttcaaaatcggtgtcggttaaattaagtgttagatcggcttcactcacacgcaattcttcagcattacggcctaccgcgatcgttgtgctagctcctaataatttactaatcgtaattgcgagacgccccgcattaccagtggcccctaaaacgagcacttttttgccctgaacttgttcttgccctaaccgcgccatgatcgccatgtacgatgacatcgcgggattaacggttgccgccactacgcttggggttgcattggcgggtagcggcatcacatagtgcgcatccgtgacgacttgctcagctaacgtcccaaaacggggctttgacccaacaaaatagacgagctgaccatctgctgttttgcccacaccatctaccccaggaattaatggtagctgcccttcactagaatagtgcgttccgtttgccttagccatcaccactcggttaacactggcggccagcacatccacaacgacttcattcgattgtaccagcggtaaggtggcttcttgatacattggtgcttgattaaaatctgtcacaactgctgctttcataataaaacttccttttgattgtatttagattactagtaatgtaaaatgagtatacaattaattactggtaatgtaaatatattactagtaatatttattaaaaaaggagtcccgttaaaatgctagataaccaaacgatcctcttagcaacaatcagaaacttaggtcatcaccaccgcgactttcaaactgccttgactaaacagatggccaacgattctcgcctaacaccggcagcgcgacaatcgttagagaaaattcgcctgaatcattcagaagttcaaattttgagcattgtcaatcggacgggtgaactggcatacgcacagctaaatgaacaagtaactttttcacagggaatgttatcacggtacattaaaaaattgttgcaggctgagttactacataaggttgcactaccagataataaaaaagcctatcggttagccattacagcgaccggaaaagtacttgcagaacagcacgatcaattacatgaacgcgaaaatcaagccttccagcaggcacttgcacagttttccgatcaacaattacaggataccattgcggttctacaggccattgaaggtgtgaaattaccgtgaggctaatttcaacaccactggtcatatcaattattattatcactttgtcaaatttgactataactgaatccaccgcttacaatgtccccatatcttagaagttgaggagacgaggactatggcaatgtttctccatgcgatcagtggcgtactagttatcttggggatgatcgcggttggctacgtattagctaaacgcaactggtttgacgaagccagtactaaattaatcgctaaaattgtgactcagctcgcgctgccctgttacatgctctcgaccattatgaccgatttctccaccaaagaactgaaagcactgctaccagaccttaagtttcccgtactgtccatgtcggtgctctttgtagtttcaattctggtcgcccatatcctccatattcggcgaaatcgacaaggcttatttgagtccatgttcttcatttccaacactgtttttgttggactagcagttaacgtcgctctgttcggccaaaaaagtctaccctatgtgttggtctactacatggccaatacgaccttcttttggacccttggcgtttacctcatcggccgcgatggcggtcaacgaggacaccttaattggcgacaaactctcaagcaaattttttcaccaccactactcggattcgcactcgccgtcgttctcgtattgttacacgtgaaacttccaccgtttttaatggccgatttcggctacatcggtggcctcaccatccccttatcaatgatctttattggtatttcggtggcgaatgctggcatcacccatattcgtttcaatcgctataatctcggcgttttattcggtcgtttccttctcgctcccgccctcatgagcctgctagttctcccctcatccatgccagtgcttatgaaacaggtcttcattctccaatcggcgatgccggccatgactaacgcgcccgtcgtagctaaactctacggtgctgattcagactatgctgctatcatggtggccgaaaccacgattttgagtttagtagttattccgattttgatgctattgatgaactaaaatggtcatttccatttgcttggaaatgaccatttttatcatcattgtaatatatccaaataaatttctttgattgccaaccgatccaattttatcggattattgcggagacgctgcaaatttactgaattggtaaggtcttctagctgttctttactttgaatcgttggaactgttagttccaaactagtagttagtgcctcgaaccactcaattgctgctgtaacatctttttggcccaatgcttgcgtaatcatttcaaatcgtcggcttactgtctgcgcgtcaattcccttctgaacttgatctaaatgtaccatcatataacgccaaatctttggcaaacacagcgcgacagcgtgaccatgagcaatgccatataacgaagtcaacttataagccattgcatgtgccgcagttgtcgttgaaatattaattgcccgacctgctaagttcgcagcttctagcattggtccatttgccttcacatctccagctaggtagctccgatagttatcaatccattccattaacgcccgttgtgcatctgtttggctttgacaggtcgcttttagcgcccatattgattcaatggcatgacacaacgcatccaacatgcttgcttgccgttgatacaatggtaaactatctagcaatgatggcgccaatacatatgcctctggcaatagactctcatctgaaattgagtatttcttgccttgataataaattaccgcaaaatgcgttacctcactccctgtgccagctgttgttggaattgctatatgcacaattggattggcaaaaattggttgattgacgaacggaatatcgggcttcatattgtaaaatgctttaatactctttgccacatccattggacttccgccgccaatcgaaattaacaaatcagagttatttcgataaaatgccgctaacccttttactactgattcatatttaggattcggctcataatcatgaaaggtggttattatcacatctttcatcattaacaactcttggtacgagtgtgtcgtcataaacgaatgaccacaaaccaagaagggacgatgactatgatacttttgaattaattgctgcagatcttgtaccattgtttttgtctgcgcacttgaaatactagttgccatttcaacgcctcctcggctaatactgcactggaatctgaacatccatttgaatgagtgcttctttcaaaacaacataaaattgttgaatatcttcgggagtaatggctcctagtgcacatagtctaaacgtaggtaaatctgaaaccttacctggatagatcgtgtaaccctttttatacacaagatcatgcatttgatcaaatgaaaaatgtgtatcatttggatattttaatgatacaaccaatttagattgatacttcttatcaatcaacaattcaaaacccagtgcctcggcaccatccactagtgcttgccaaacagcctgatgacgcccccatttagcagtttctccttcagcaaagtactccttgagaccttgtcgtgcagcataaattgtttgaactggtggcgtaaaatgcatttgcccagtttttttaataaaactgtactgcgtatatagatttgtataataggacctagttggataatctctagaagcttccaaaatagaggttcgtccaatcgtgtacgataggcctgtaaaagccattatgcctttttgtgctgacgacatcacaaaatcgagattatcacgttccatgtcaattggaatcattgcatatgttgaagttgtatcaacaaccattgtatcgccatattcgtgggccagtgcaccaatttcacgaatcggattcagaactccagtcccagtctcattatgacaacagtaaactacggcaatatccgagtcttgttctaaggctgctcggatagcacctagatcagctggtttagtaatgtccagctttaaatcgacatagtccatgtgataatattgagcaacttcaactgctcgtcctgagtaggcgccattatcaacaatcaatattttctttcctgcgggtactaatgaacttactgtggcatcaatgttaatcgttccagacccacaaaaaaggactgctgtaaaggcatcttcaccgtgaacaactctaaccaagtcacggccaatttgtttcattatgtcaccaaattcatcttcacgaggacatatatctggcacaatttgtgcgtatttaactgtatcagtcgttgtcgcaggccctggattaagtaacacatttcgtttgatttttggtaattcatctgtcttcatcatcagctaatttcctccatctatttccttttccctgcaatcagtgctagggctatcatcatgacattgactatcgtaataatcagaaagagtaactcccagttattcccatctagcgtaaatccaaaaataattgcctgaaccgatgccccaatataagccacaaaatccatcatgccactagcagtagccgcatattgacgacctccagcctccatcgcaggggcccatgtcagtccattaatggcgtaaacaaaaaatcccgcaacgaacaacaaaatgctaattaataattcattacgtgtaaatgggaaaattaatgccaccacaccaccaactaacgcacacataataactgccggtagtcgattgctggcaaggtatcgatctgcgagcattggtacaaataaagcaccaaatcccataccaattggtaatactaaactttgaatcagcccagaactcacatcaaaatgcagcattttagtaaagtacagtggtatccaagtcaggagaccataacgcacaatactttgaagtgcaataatcactaaccaaacgtcatatttccatgattttaataaataaatatatggataaagttgaccgtgattccccatcgacgcttgaatttcattttccgactgtgtcagtgctgcatcatctgtaaatggttgtaatcccaatgactccggtgaatctttcgtcaatctccaatagataatggcaacaattgcagcaacaataacaggtaagaagaatgctgagcgccatccaagattcggactgatcttaagtgcaataacgaccatgatcatggcaattgcctgaccaaatccagaaaagccatttgccattcctgttgcaaatccccgcttattagctggccaccatcgtgataggagtgccatccccggagcccatgccattgactgaaaataaccattgaatgcccataaaattgtaattactatcagtgaggattggaatccgatcacaatattggcaaatgcagatagtaacactgccgaaacaatgaatcgattaacaccaaacatctcgcttaatcgaccattcatgagctgtcccaccccatatgtccaaaaaaatacggatgaaagaactcccaactgtgctgttgtccaccccatttcctttaccattagtggaatcgcggaactaagattaagtctgccactgtacagtagacaataaactagtgaaaacccaattacagctcgccacgcatattttctgaacagtgaatattccgccgatgtatatcctagcatgtcatttgtcgtttgcttcaactctcttaacacctctttcttagtaattactataactataagttattaaaacggtgcggttcataatcaacaataataactaaactttcagcaaaatcaccaaaatcacatttgttaatgtcataaaatgtaacatctatcaattaaccaccttcacatatcgtttatcattcggccgattgataagatgctgtgtagaaaaaagataatcaatttgttcatcactcataattgcttgtgttttcaaaagcgttttgactgactttttttgcctaatcgcttgcttaactaagttcatagcacgttcatagccaatcaccggtgccagaacagttgcagaaatagctgatttttcaacttgttccttttcgtattcagcatttacctgaattccttccaagcaacgtgtaactagcgtttcaagcgccccagttaaaattacttcaccatcaatcaaatctttaaatattactggttcaaaagcatttagctccagctgtcccgcttgcacagctaaactcactgttgtgtcatatccaatcacttgaaaagcaacctgattcactacctccggaataactggattcacttttcctggcatgattgaagaacctgcctgtacggctggtaatcgtaattcacaaaatcctgcttgtggcccacttccaagtaatcgaagatcatttgatagcttaattaaatccaacgataacatcttaagagaacttgaaaatgccgctaaagcatcacaattttgcgtagcatcaatcttgtcttcagacacaacaagcttcactcctgttagatcatttacttcatcaacaatatgttctcgataaaactcagatgcgttcaatcctgtaccgattgctgtgcctcctaaattaacatttcgcagtacgtccactgcttgatttactcgctgaagatcacgtttaaacaaggaatagtaagcatgaaaactattaccaaatgtcgtcgggacggcatcttgtaattgtgttcggccaactttaactgcatctttaaaagtttcagctcgatccaacaacacgtgaactaatcgttgtaattgctgtcttagggctggatataattgtagtaatgtcatcttcccagctgttggaaaaacatcattagtcgactgagactgattaacatcatcattcggatgaattacaattgccgtatattgaccagccacattagccacgacctcattcacattcatattagcggatgttcctgcgccaccttgaattgccgcaacaacaaattgatcatcatacttacccgataaaacatcttggcatgcccgaataatcgcccgtgatttttgtgagtctagtgttccagcctgttgattcacaaccgcagcggcctgtttaatcaagactatgtttttcatcagcgctacatcagttttctcagaactaatgggaaagttttgctgcgcccgtgcagcatggatgccatacagtgctttgtctggaattgccaaacttccgacacaatcagtttcaattcgcattccgtttcctccaatgttataaaacataacataaaccatgttattgagatatatcttacaagttctgtactcaatttcaatatttttacatgatctcgttaacttctcttactggacatattactcaagccaagccttctttccatatataacagtgaacacagcaaattaaggaaagaaaaaaaaaacgaagtttcatgttatgttttataacacaaagcttcggtttttaccttattttctcgatttaaacttcgatcattttcccaatatccaacaaataaagcaccttatgagccactttttgacgcttaatactggtaagtgcccgtgcataaaggttaacctgcccccgatagcgatctaccacctgctggattgcaactgggttgtccccctttacgtgatcagtcttgtaatcgaacagtaccagtccgtcagccgtctcaaagtagccgtcaataatcccatgaattagaattttttcgtccgctgttagctgggtgaagagttgatctccccgcagtagcattgaaaacggcgcttcccgctgcaagctatcggcatgcgtcaacagtgcttgccccagcgctgtatcaaagaatgcttcaatttgagcctggttaattttttgtgccacttccggcgaaataatattgttcaattgtaatcgtgtcacgacctgactaattgctgctgcatccggacgggtcgccatggataacgtttgtaacaccaagtgcgtggccgtcccaatctgcgtgggggtggctgtttgttcctgctgcataaaatgtggttggccaaactcactcttgacatagcgaccttcagaacgcgcctgtgggtttaattcaatttgaatcaactcctgattatcaggatcgtcaaataagcgtttaatctcagaaaccgactggtatgccgttgtcattgtggcggcttggtagtcgtactgcaggtttagtacctgcaacacagcctgctgctcagcggagctcagttgaccgtccgtcgccgtttcaatctgttcgtcaattgagggcaccccgaccggttcgtccgccgcatcctgctgcaggtctgccgccgtcacaacttgcaccgtaaacgtcgtttgatcttttccaaggccataccacggttgcggatcggtcagcagattctgatcaaactgcgggtgtcgtactaaactcatgccaatccagtccataaagttagtggcctgtgctcgttgctggtttggtagcagcatccccgagctttgaaaggcccgttgccagttggcaatcgccttattcgcatccttgtacgcgccagcaataattaatcgctgttcggcgcgcgtcaatgctacataaagaactcgcatttcctccgcgcggcttttattttgaatcgtatctttcactatctgtttctgcagtgtggccactttcacgttctcgtcgttcaaataagtgaccccaattccagcatgggcatccaagagacagtcctgccgcaagctttccatattaaactggtgcgtggcatcaatcaggaacacaaccggaaattccagccccttactgccgtgaatcgtcatcacggataccgtatcactagacgtttgcgccggtgcttgagcaagatccttattgcgcttttgcatctgttcaataaaccgaacaaactgaaaaacacctttaaagctactttgctcatacattgctgcgcgttgatacaatgcgtgtaaattggcctgtcgttgcttaccacctggcattccacctacgtaatctaagaacccggtctcgtcataaatggcccaaatcagatcgactaaccggttttggttagcaatcgttcgaaatttggttaattgatccaagaagcgccggatcttaacctgcaattgttccgcaaatgcatccttgggcgtcgcacgggcaaacttcgtcacggccgcaaaatattcatccgttttatcctgaatccggagataggccagctcgttttcatccagtccgaccatcggcgaccgcaacacagccgctaacggaatatcctgataggggttgtcaatgatccggagaagcgccatcatgatccgaacttccgtggcctgaaagtagttttgagcgtcacggacggtcaccggaatgcccagttggctaaactgttccacaatcagattgttattattcttcgttgctgataatagggtaatatcgccgtatgaaatgggccgcatctgctgggcctttcgatcgtaaaccagttcatgctgctcaaccattcgctgaattcgtaacccaaccatctgaatctcaccagtcaacttatcaccggcttctaacagcggtagtttttgatcaagcgccgtgggttccgtcgtcgaatcatacagcatgatttcggtcggcacgcctcggtccggatagtcggtcgccccgtacttcaagtgggcgtcctcatcgtaatccatctccccgacttgtgtatccattagctgttggaagatcagattggtaaagtcggtcacattattcaccgagcgaaagttttcggctaagacaattgtttccccgtccgtactccccggctgacggtaggtggtgtacttccgcaaaaagagactcgggtcggcttgccggaactggtagatggactgtttgacatcccccaccataaacatgttacccggatcgtcattaactaacgtttgtagaatactttcctgcagttgattcgtatcctgatattcatcaaccataatttcatgatagtgatcccgcagttgagccaccacggcctgaccatcgggcgttgccgtggataaaatttgaagggcatagtgttccagatcactaaaatcgagtacatgacgacgttgtttttcggtctgataggccgcacggtagcgttccaccacatcgaccagcgtggtcactaattgctcggcctgacttgaaatctgctttgtggttgcctcatcgagtgcaaagtagtgcggtgccagagcgttaattgcctttttcgcgttattacgcagttccttgatcgattcaaatgtagctttcgcttcatcgtccttggggccccgcaatgtgctaaattttaacgcttgtaaaaactgacgacaatcatcccaactcgcacttcccaccagtttttctgccgtttttgcctgttcgagttctgcttccagtaccgctttgaccttttcaaactcatctccaccagcctggtacaaggcatcagccagatcggcttcgatttgttgcagggcatcaactagcgctggcaaaacctgctgttggtacatcgccgtttcaatcaacgggccctcacctaccgcatacgtggtcggcagttgagcaagccactcatgtggccgaggggtggcggtcgcgtaactatccaattgattgacaacggtcgttaatccatcgtcgctacgatcactcgaaaaattccgagttaactgttcgaacgctgggtcgccactggcataaagtgtttcacggacgtcattccacacgttttcacgcagtaaaatcccctccgtttcgtccgttaacaaccgaaactgtgggtctaaattaatcaggtaataatactgcttgatgaggtgcagacaaaatgcgtgcagcgtactaatatccgccactgccaatcgattcagttgatttttaagatgctgtttcacatcggtcgtgttggtctgggcaatggcctctttgagcgcctgaccgatccggtcgcgcattcccttcgcggcggcctctgtaaaggtgacgactaagagacgatcaatactttcaccaccgagaattttttggatgacccgttccactaggacggaggttttgccggacccagcagaggccgatacaagaatgttttgtccttgatcatcaatcgcttgttgctgcgtcacggtgaaatgcgttttactcatgatcttgttcctcccttagtttcgctaatacatccttggcactcagtgattccaattgacgataattattttccggtaacatggcatcaaattgaaatacatctaaaaacggtgagttttgcagactcgtcgattgatccggcatcttcaccggattcagggccaccgcgccggcaaaaatatccttggctgccgacacgatccgttcccgatttcgtttcagcagtaattccaactgatcacgggtaactagactgtcaccactaaacccttttttgattttgcggaagggataaattgcagaaaagccagtcctatcgtccagttgttgatcaagactatccagaagatcgggctcgttgagtaaaatccccttatagtggtgaaccttcatccgttcttgatcgagatccttgcctgccacatgatcaaaattaagcttcgggtcgaaaatatgcatgtacagtgcaccggctaattcgctacgttgatgattatcaagcttgtctaagttctgttcgaccgcgttgagatacgtgagcatttgcatcgctaacccgtaatatgcctcaccaaacttaaactcgtgttcactcgacttgtaatcaacaactcccaaatagtccccggtacccgtgttaaattcatcaattcgatcaatttttccacgcacccgtacctgatgatgatctggcaaatcgaagacgagcccgtcaagcccctgttgatcttgaatctgaccaaacaatacttcggtttgaattggtcgggctggtgtatagcggctctgtcgctggagcgcataactcatttgttgtaccgttcgtttcagttgacggtgcaggtactgcattcgcgcggaactggctaaaatcatgaattgcggtgcctgactgacattatcaaccacctcattgattagttcatccaactgcgcttgagagagttcattgaggcgaaggcccaactgattaacccgtttgattaattgatccagtactgaatggaagaattcacccgtgttggctggtgtcagttcaaacatttcccgttcctgcagctttagcccaaacttcaagaagtaggcgtattgattacgataaaactcttctagttttgaaaccgacgtgttaataacattgccataaaggccctgtacaatttctgctcgtaacggttgtggttgattttggtagtgtaggctcgccataacggtcgtaaagtgatcatgcagctgcgacttttgattcagctgttgataaacaaatcgccacttgggtgctaaccactgattgcgatccgccgcctgtcgacttacccgaatcagtacgctcagcgttgcggccgggctgctgacatagggcgcaatcttggacgcacccaattctggtacctgggtataatgttgaggggtaagtttaaagaaattcatgatcgccgtcacatacggtgacacccgaatttcttgtccaccatcatcaagctccggtgctgacaaataaaggcgctcacaaccactcatgaagcccaaataattcacgtaaggttcgttagccagctgtccaacattatccgctggtaaaaactgactttcatccagatgcgtctgcaactgctccttatcggcgtccgttaaaaggctctgactggtgctaacggttggcatttcggcgtccgtagctccgatcataaatgtcactcgccgctgatcgctttgaataattccggtttccgaaatcacgacttgatccagtgtcgaaggaatctgtgagtacgttgccgcactgaatccggcctgcaacagatcgcgaaagtcatcgggattaaaggggcggtcacccaaaattgccacgtattcatctaaaatgccacaaaatgtctgccaaacctgctgcggttgagacgccgcgtccaattgtcccacatctagttggcggttttgccaccgtgcaagctgttcggtgacgccgttttgcaccagaaattgatacagactttgcgcggcctgcgtccccgtagttgccgtttctagcgcgtcaaataacggtggtaggctctctttaatgaagtgccgaattaagttaatttcagtcgtatagtgggcaaccttatcactttgtgtctgaccactgtcggtagcctgaaagcgataatactgccagtcggcgtcacgcaaccaatcatcaccatgcagaccggtttttaataaccagttttcagttaacgccagtgccgtttcaaaccgatcacgggagatatactcaccattaatcttgggcaacagtaactccgtcttcaaaagctgcatcacgtcatcataacggtagtagtgctccttaaccgcgaacagcgcatctaaaaagagaacgagtggatgatcatccatcaaccgttcgtggtcgttaaaagcaggaatatcatactgatcaaatacaggttccaaaaaggccgcataggggtccaatcggcgagctagcaccaaaaaatcgcggtaacgataccgaccggtcgccactaactgacgaatttggcgggcaacctgttggagctctgtcaaccgactatcacccgtaaagatctgtagattttgcgggtgcgccaatgaaacaggctcaatttgagccatcttagtttccgccgcccagaaacgatccagctgctgtaactccggactaacccggggggtcgttgcaaaccggtccactaaaatgggaatctgttggacagccgcttgtcgatacagtcgatggtaaactcgaccagactcgaaaaagagactatttacatccggatcttcgtgcggcgccggttggtcaaggttcaatgaaatcagcgcggaagcggcgttagccacaattgcggcgacaatcttctgttcactagccgtaaactgtgagaagcgcgcaagataaaaatgggcgtgcttcatcggctgtgtgttgagatagctcacgagttgatcgtatacttctgcgttaccgagatactgcccggtcaatgcctgctcgtaccgagtataaacaagaaccatatcatgcagtttcgctgtcagtgtcggatcatcgtgatgcatatcagcggtcatttgggccaactcatcagccgtaatattggcctgttttaactgttctaactgaccaactagctcctgtacaaaaccaggatggttcacttcaccggcaaataattgcagttcgccagcatgatcgctaataatctgaaacaccagcattgataaacccgtccgtgagatgcgaggaacctgataagcagccgtatcccgcaacaaataccaagccagtcgactaaacgacagcacttgcaggttggactgggcgtagccactctctgtagcgtgttcatcacgcttggccagctcactcatgacggtaatttcagattcaaatttaatatggttgggtactaaataaaaaaattggtcgttgggaaactgcaccatatcggccgctaactgatctaataatactttgcggtggtcctttgctgcagtaccgagtacaaagcctaaactcatgggagcctccttataatcgtagtcgtcattcgtcttccttattatacgcgaatctaagtcagagctaaacgattgacgcggccgcaaccttaatttttataaagcgttcgcatactgtaacgtcgtcacttcaaatttcaccacattagcggtatgataaccgcaaaggaggccttgctatgtggtccaatgatcaactgcaacacttcgcacaactagatgatttctatgttgcgccctttcatccagatatgaaaacgaccggcacgctgacctacatctggtccgtcgtcgccgatcatcagctctatattcgtggcggctacggccaacactccaaatggtatgccgcagctcggcaacaaaaagctggccaaatccaacttggcggccagctgtacgacgtcaagtttgaactggttcccgaaacagggcatgaggccttaatgacggccatcgatcacgcctacattgataagtacacagctaaaagtgcccgatccactaaacacatgactgaaaaatcggtcgatggtccccgtactgcaaccgtccgtgtattacctcgttaaacatttttcaacttaaaaggagtctgtattcatatgaaaaccgcaatttttgtcgaaccaggaaacgtcgcaattaaaaatgtagataaacccactgtccaagccgacgacgacgttattttacacgtcgtccggacttgtgtatgcggttcagacctttgggcctaccgtggcttagaagaaaaagctcacgattctgaaaatggtggccacgaagccattggaattgtcgaagaagttgggaccgccattaccaccgtcaaaccaggggacttcgttatcgcaccctttacccacggttgtgggcattgtgcggcctgccgtgccggattcgacggcgtttgtcaggaacatgccaataactttactgccagcgctcaggccgaatatcttcggttcacccatgccgaatggtcacttgttaaagtgcccggccaaccagaagattatagcgaagaaatgcttaaatccttgctcacgttagccgatgtcatggcaactggttaccatgccgctcgtatggctcaagtatcgacgggtgataccgttgtcgttgtgggtgacggtgccgttggcttatgcggtgtaattgctgctcgtcttcgcggtgctaagcgaatcatcgccatgagtcggcatgaagatcggcaacaactagcacgtgaatttggtgcgaccgatatcgttgccgaacggggagacgaggccgtcgccaaagttaaagcactcactaatggagatggtgccgacgccgtactagaatgcgtgggatcagagctggccaacgtcaccgctatgcaagtcgcacgccctggtgccgcgattggtcgtgtgggattgcctcatgaacccaaaatggacatggcgccttcattcttcaacaacgtcaccattgctggtggtattgcatcggttacaacctatgataagcagttacttttgaaggccgttcttgatggtgaaattcatcctggtaaggtcttcactaagagctttacccttgatgagattaacaccgcctatcaggccatggataatcgccaagcgattaaatcgttgttggtagtagattaactcaccgtgaactttgctggtatgctaaaccagatactaagatttcgattatttccttggaaatacttttcaattaacttagcaacacaactattcaacatatcaaccacttcacgtatttgtacgttgatatccacatacgtatgtaggataataatagtgtaattttttctagacaaaaattacgcctcgactactgagctccccagctcggtagtcctttttttatcctcaaatagcaacttaaagactgatacaaagccatgcccataaactgagcatgacttttcttgagattcccattttctatgattgttaaactgatatacttttcctaaagtaatgacacgaggagcaaatcatatgccacttggagaaaaaattaaattaaatcgaactcgattaaagttaaaacaagaagatctcggcaaaagacttcatgtatcacgacaaaccatttcgaattgggaagttggtcgcagctatcctgatatcgaaagtcttatcgctctgagtgacatatttgatctctctctcgacaaattactgaaggaggatgtcaacatgatatctagtttgaagaagcgtcccttaggagaagtcagctacatttcgttcatgatcagtttaactattggtggcataattacagcaattgtggatatggcattaaatcatacactaacatggtcattaattgttttagccgcctgcttattatcaggaacttttatcaccgtttttaaacataccagcagctactatctcattaaggccagcattagtgcttttattccagggattatcctattttggtcaatttaccttgctataccgacccttaatttcattcggatgcttcaaatcggcactttctggtttatatttttcatactcattgtctgtctgatagaattatctaaaattagattttggaacttattaacgatcatcaccttaattagcattcctcttgaactggtagctgaaatattagtagatgaaaccgcattggatattgcatcggtcattagtgttttttcaaatttcgcgttagcgatcattttctttgctattgaacgctcacatttagataaaaataaaatggagaccctactatccaagttccgaaagcatacccagcaaatttgaataacttgccatatgccgcaaaaaacaaaggactccacttttttaattccacgatcttctttagaattccactcaactacccctatcgctttaatacagaaatgccatcggaattaccaactaccacctcatctaccacattcagaaacaaaccatgctcaacaactccaactgtgctatctaggatagttgctaatttaatcgggtcgttaattttttccaaatgtaaatccaaaatataattatttgaatcagtctttacaatcgcactggtttcattagttcttaaaactggctgatagccaagcgcttcaaatttttccattaattgttcgtatccaaacgggattacttctacaggtaacgggaaacgccccaaattctttaccagtttactgtgatcaactatccaaatattcttttgcgaattagtagcgacaattttttctcgcagtaatgcagcaccaccacctttaataccattcatgttgctgtcaatttcgtctgcaccatcaatggtaagatcaatttggttaatatcacataacgagtacaccggtaatttcaatcgttttgcctgtcgcgcagtttgactagacgtcgctacacacttaatttttaagttattattttttactttttctgccagtgcctctacaaaatatttaacggttgtcccactaccaaccccaacggtcatgtcatcttccacatacctagtcgcgtattttccaactaacttttttaaagtttcttgattcatcaactatcatcctttttctttgatttaaaaaatgtaatcagcaaataaacagccgattacattttttacgttaattgagtaaataatttcttactcaccgcataccactattttttccaaagtctttcaaattcagaaacaatgcgatcaacagtaaatccatattttctttgaactgcttctccatttccactggcaccaaactcatcaaccccaatggtacagccaccaagtccgacaaactcatgccatccaaatgtactttccatttcaattgaaatccgatgtgtaacgtcattaggaagtacctgctgctgataaccagcagtttgctgacggaatagttcaacacatggcattgataccacactaatatcatatgccttagcttccaaaacttttttagcttctaaagccaacgataattcagatccagtggctatcaaaattccatcaggtaaatctgtccgtgctggagaagcaacataaccacctttagaaacatctgcatctgaagtttccttcaaaactggtagtttctgtctagacaaaattaatgcatttggggtgtctacgtctgtggcaatgtattgccatgcattaagaacttcatttgcatctgccggccgaataacattaatccccggcattgatcgtaatgctgccagttgttcgacaggctcatgggtcgggccatcttctcccaccgcaattgagtcatgggtgaacacataggtaaccggtaacttttgaattgcggcagagcgaatagctgacttcatatagtccgaaaatgtaaagaaggtactcataaagcaacgggttcctccgtgcagcgtaatgccatttgccgctgttgccattccaaattcacgaactccaaaccaaatatttcgattttgtggatcctcatctgagaaacgaccactggttgctaattgcgttttattgctggaggaaagatccgcagcaccaccccaaaagtttaaattacattcggaaatctgttgcataatttccgaattagcagacctagttgcaatcatatcgccggtctgctcttgcaccgcaaccttttccatattaagttcaggtttggcctgtaaactaaattctttggcttgtggatcactagactgaaactctgtaaattctttttcccattgattatatttttgcttaccacgctgctgcatatgtttcttaaaaacatcatatactcgctcatcaatttcaaacggcgcatactggtagtgcagtgcatcacgcgtcatatttacattttcatttcccagcgcggcaccatgaaccttgtttgttcccgcttctggagaaccaaacccgataattgtcttcacttcaattagcgttggtttataagttgctttagcggttgttattgcctgatcaatttcagctaaattctcaccatcatcaacttttaaatagtcccaaccggctgccttaaatcgcatggctgcattttcgacagattcgttagataatgggccatccaaagtaatgttattcgagtcatatagaacaattaattttgagagtttttcattaccagcaatattaatggcttcttgactaacgccttccataagatctccatcaccgactagtgcataagtgtaatgatcgacgatgttataggtatgattgtaaacctctgccaaatgtttctcggccattgccattccgacggccattccaattccttgccctaaagggccagtggttgcctctacaccaaccgtatgcccatattctggatggcctggggtcttggaatccaactgacgaaattgctttaactcactcattggaagatcataaccactcaaatgaagtaaactgtacagcattgctgatccgtgccctgctgataaaacaaatctatcacgatcaaaccaagttggttgctctggattgactttcagatgatagttccacagtacataggccattggagacgcgcctaaacaaattcccggatgacctgaattagctttttgaatttcatccacgcttaacattcgtaatgtattaaccgctaacgtatcaatttcattaaactttgcatttgcttgtttctgtgtcatatcaaataagtacctccacgtaatttttcttcaaaaaaattacatcccttggatgatcgcaatttaccacgtttccaaaaaatgtaatttttaatacctattagctactttgctgctttactacgacgatcccgtgcgttcaacatcatgctgatcaaaataaccaaaactaggaatactaaaattgatgtcacaagtgcgacagttcctagatttcctaaatttcctagaatgataccaggaatcaagtaatcagtatctgcgaaggtcgatgcggccatttgtaagttaccgagtacgggtaaaataaatagcggcaaccaactaatcagaattccgttaaatgccgaacctaaaaccgcgccacgacgaccaccatatgcatttccgtaaattgcggctgcggcaccacagaagaaatgacctacaactccgggaataatgactgttgttttcataccgatcatgataaacatactgatcgttccaacaataaagcttgtaaagaatccgattaaaactgcatttggcgcatacggaaagatgataggaacatccaatgcaggttttgaattgggtaccagtttttgagcaattccttggaaagcgggaacaatttcagctaaaatcatccgaacaccttggagaacaacaacaaatccagcagcaaaagtaccagcttgaactaacgagtaaactaaatagttagtacctgcgcttaacttagtttcgataaagtgtggtcccgtcacaattgcaagagcaagatagacaatcgacatcaacaatgtaatcgatactgtagaatcacgtaagaagctgagactctttggaatatcaagatcttccgttgttttcttcgggttcccaaacagtttcccaatcaaaccagcagttgcgtatccaatgttacctgtatgccccatggcaaccgcatcaccaccagtaattttacgcataaacggctgacataaagctggcgtaaccgtcagtaatgtaccttcaaaaatcccgcctagaataatggttttccaaccagcgcccaaatgagcagagattaataccacggcagtcaaacaagaaacataaagcattgcttgacctgttaagaagatgtatttaaaacgggtgaagcgagccaataaaatattaacaatcataccaacaaacataataagtgcagttaccgaaccatacttaacaagtgcaatcgcgactaccgcttcgttacttggaactaccccttgaacatgtaatgcaaatttaaacatcttagcaaaaggatcaagcgcaccctgcaaaatagtagaaccaccaattaacaccaaaaaaccggcaaaagttttgatcgttccctgaataacttcagttgtctttttacgctgtaacaccagccctaaaagcgcaattagagcaattaaaatggaaggctgtgtcacaattgaaacgaataaatttaatattcccttcatagctgttctcctttcaatggttagttatgggcaatattttctcgatccaaaataccgttaacatgttctttgatttcatctttatcaattaaactcttcaataaaattaacttatctgatggaatactacctaacgtatcccccaacgtagattcaacaaagaaataatccgcagaatctgctgtagtgctaccaacatctgagtgatcaaccacaatttcttcttgaacaccctcatcttttaaaatttgttgaatattcatctgaaccataaagctacttcctaaaccactttgacaaactgctaaaaatttcataattttgacccccaatttattttgttccaataatttctaataactgttcaacttttgttgcgttacacatcgcttgaactttctgctcgttcattaataattccatcaaaccttgaataacacttaaatgtgtttggttatctgtcgccgccaatacaaaccacaaattaacaggatgatcaggattcactagattgactgcttgatcagtctttaacagggacaacgatattttattcactcccgcttctggtcgtgaatgtgcaagtactattcttgaaccaatattaaaatatggtcctttctcaataaccgtgtctagcattgcttgaacatatgtctctttaactgatccgttatttactaagggttgtgctgataatttgattgcatcactccaatttaaatcattgccgtttacaatttggaccgtccttttggttaataatttatctaacaactcctgtcctcctctcctgtatggtttatatcttactcttgatgtaaacgctaacaagtgcaataatgtccagagtaaaagtgcaactatttcactattaattagcaggaaggtgaatttcatcactaatattgactcaattccgcatggacgtgccattcttaatcttttgcaaaacacagagcactatattacgtcacttgaaatacaagaaaaattatctatatcacgacgtagcttttactactctcttaaaaaaataaatacttatttggatcataatcacattgagccaatcgcaaatttaaagggcattggttactatttaactgataatgctaaaaaaaacattaaggcagcaaatatttccatatcctcagacaaaaatttttctgccaatgagcgagaaatactatgtatttggaatctcatcaatggtcaaactatttcaatttctaacttaatgaccctgtttgacatttcgaaccacaccgcaattactgatttgaataaaatatccattcaactagaacacatcaacttacacttaaaacagcaaaataatggtaagacactagttggttcagaagtgacaaaacgaaaatgggtattggaacagctgaataatccagtttctccaattcatagggtctttcactttaatgatgactccctaacaaaaattgatctatcacttaaggaattagaagcctggacccaaaatttctttactgacaatgcccacatcactttaaataaatttattacctggttattaaatcgactaaataatccagaatatttattgactaatattgataaacagtttgatattactaattccactgtccttcactgggccaacgaactcttacagcagcaccatatcaataaccaatttgagccaatctttctatctcaaattcttaatacgagtcagttttcaagtattaatgcttctagtaaaaaaacactcgagattcaggacgtcgctcaaaaagttattgataaattcaatattgtttcaggatctaacatcaactcttactcactagttgtcgctctttcgacacacttattaagtacgctatatcgagttactctcgggattaaatatacgcatccagacttaaaaacatttctcaaaaaataccacgagctatttatctttaccaaatatgcaattcaccccttcgagtcctatgtgggtcaaaaactatctgatgatgaaatttcgttaattgcaatttactttggcggtcaactacgagagatcagtcgcaaaaatcgttggaacacggacgttatgctagtttgctctagcggaattggaacttctgtgttactaaaaaaccagttaacagcaaaatatcctgatgtatcattttcggaaccacttagcattttccaatttgaaaactgcccgctcgacgacgttaaactaattatttcaacaattagttttgacaaagattatggcgtgccaacacttagagtttccccactacttactgaaggagatctcaaaaaaattgataatgcaattttaagtagtcatcacactgccacgtctaataaccctaatgcagatgccttaattgacattattagcgaatttgctcgaattgaagactttgataaactacgtgaagcacttaataactatttaaattcatctcaaaaaacatctcatccgctttctctaaataaaccggttaatgaacttcaaaaaatattaactactacaaacatcgttatcaacgattcacctcatgccgaaagttggcaatatgcaattcaacattcttttaataacatgctcgaaaaccattctatttcacaaagttatgttgataaaatcatcgcgttgactcaacaaaaagggccctatatgtatttagggaatggtgtttttcttgcgcatgctgcaccacaagatggtgttaaagaaattggcttatcactttatatcagcaaaatcccgattgcattgacaacttcaaaccatccacaaaaaaacgtgaacatcattattggattggccccaattgatcaaagtagtcaccttaaagtactttccgaactttttcaaaatattcaaaataaagattggcttgaacacttaaaatccgcaaccacagttacacaagtactggaacaaattaaaaaataggacgtcactatctgtcttttcctattcttaagttgcgtgcttatgttacttagcgacataaaaaataaacaaagagatgtctgcattaaagcgccaccgagatcgttgttcaatctcgagggcccacttcacaggcatctctttttattaattatctaaagtaatttttaatcttagggttcagcagtaatatcaaaggacgtatccatcacaatttcttcagacttacgtcgatttccgagacgataatcagatggtaattggttttcgtatttaaaaaatacttttgtaaaatagttgttactgaatccaacttcattagctatttgtccaatagatttagtagtttctgttaataattcttttgctttttgaagtctaatagtttgtaatatgtggatcggcgtttgattatatgaatctgagaataacttgataatttgcggtttactataatgaaatttctcactgagcatatctaaagaaaccttatattgataattatcgatcatgtaagataatatttgggctgcatcttcagaatcataagaatcactaaatggaagtttaatttccttaggacttaactgaagtggctctggaactgttggctgtgagagctcaagtaacaataatttaacttgagtatcaatgttaattaaaatattactttttttatagtgctgaaaatacactccttggtcaataatttgagaaaatctgtttcgaatcatttcatcatcaatatggaaaacagaatttataaaaatggctttcattaagtcatgtagtccatcgatcatattaaatttaatatcaataatttttgattctttttcaaatgaatatgaatgactaatattgctatcaattaatgctatatcgttgggtttcaatgtatatattttatcgtcaatagttagtatttcgtttccttccaataaatattgaagttgataaaaattatgccgatgctgcttgactgtcatttccctagaatatttttttccactcatccataaaattgttagttgactatctctcaaatctgccaatttcatcacaactttcatatttttgtacttttataatatatccatttcaataaaaaaaccgctaattttgcacattataaataatcagcgataaaaagctgtattttaagcgaaaaagcctaaaaacactattaaagcgctttatttagagctattttgccactatttttaaataatcagcgactgacagttattttaccgtcgaatgtaaccgcttttatgatgctaatatcaagtcaagttgaagtattaattgcgcaaagatacctaacaactaaaaatctaaaacgtcattataacttgtttcatttaaatcgggcaaattgcctgaaggaggatcaacaatgaattcgacagatattctaagcgccagaaagaaagtacgctggcatattctcccttatcttttcatcatttattttgttgctttcctagatagaagtagtattacctacgcttctattggtggaatggatcaatcactaggattaacagcaacaacatatggatttattgccggaatattttttatcggatactttgtgttcggagttccaggaaatatgattcttgaaaaggtcggggctcgtaaatggattggtctaattttagtactctggggcgcagtaaccttgctgactgcatttgttcattcagcagttgaactgacgacgctgcgctttttcttaggcgtgttcgaagcagctctgtttccaggtatgactttgataattacgtactgggtacgatccgctgatcgtgctggagccgtcgcacttttcatgatagctcctccgctagcgaattcatttggagcaccactagccacatggattatcacacacattcacatggctcttgatttagctggatggcgttggttatttttgatcgttggtattccagctgtattattaggcttctttactttttggtatctagcagataatccaaataaagctagctggttaacgcaagatgaaaaaaaagccctcaatgaagagttagcctttgatgcaaaactaactgaagataataaagttcaaggtgctccattcaaagaggcgttcaccaatggtcgagtttggaaaatgacattcatcaacgttttttatgttgtgggattatatggattaacgttttggttaccacaaatgattggtgaattatcttccaagttttctaccatgactattggatggttaactgccgcgccatacttactcggtgccattgctctagtcctaaactcacgccattcagattcaacacacgaacggatttggcatactgcctgtggcgcttttctaggtggtattggctttatcggtgccgcattaactggccatatgccatggatcgccatgggattcttatgcttagccgccatcggtatttatgcatggtccgggccatattgggcaattacaacaatgatggaccctcgcattgccgcaattggcttaggaattgtcaatgcattaggtaatttaggtggttttgtcggtccatatgctgttggttggctaaaagattccacaggttcacaaattaccgcaatgattttcctggccacgtctttaatcttagcaggtttaatcgtactatcgttacgccgtggtaatgatccagtaaaaaaagtagaacaacaagaactttaattatttaggaggaatttaattatgagtgtacgtaaaatggaagttcctgaaatggaatgggtagatcaaaaagaagccggaactcaacaagtagccgttatggaaaaaattggaactgttgatatcaaatatgcaaaaattccacatgccaagagtggtgaaattcgtgtcgatgttaaatgggttggaatttgtggtagtgacctcgaagtttatcgcggtgctcgcaccccagaattcttgagttatccaatgagattgggacatgaagttgccggaattgttgatgaagttggtccagacgttgttggtattaacgttggtgatcatgtttctctccgttatgtatggggtgcttttgctgaatatattacttgtgatccattttcagcagttgtactaccaaaagaatttccactaatgcatggttctctaattgaaattactccaaccattcaaaccggtatggagcgagctgacatcaatcaagccaaaaatgttcttatcatgggacaaggtgtaagtgggttgcaacttactcaatttgctcatctatatagtccacgaaatttggtcgttacagacttgtttgacgaaaagctagaaattgcaaaagaatttggcgctaataaaacttataaaattccttcagaagatactccaaccatggatgtagtcggcaaagatttccctgatggttttgacgttgtcattcccgctcgtctcgaaggtgattcagtgattgatgctctggactgttgtgctcaagatgcacgactaattatgtatggcggtattggtaaaacaagtaaaaccattgatttcttcaaaatgcatcgtcggcgtgttgatatcttaaccaccgaacctaagcgtgacgttgataatcatgatttattccgtcggggtcgtgatatggttattaatggtttgattaatactgaaaaaacagtcacaaatattttcccactttcaaagattggagaagccttttcacttcggaatcaaacacgtggtgatgtgattcatgtcatgattgactgcgattcaacacatgatgatggccgttacgaaaacggtaatattccagaaggcgtgaataaagccactaatgaggacaagtaacaatgaacaatcgatttagggacaattgcttttattgtgagcacaatcaaactatgcatgaaagaatgattccaattatcacctttgatgcaacaacagtatatttaaatagagaccaaacacacccgggacgggttattgtagcacttaattggcacgttgatgaaatttttgaactaactagtgaacaacgttttgaatttattcaagaagtttcgtttaccgctaaaaccataaaaaaacactacaatgcatcaaaaatcaatttcggaatttatggtgatacagtgtcacatttgcatgttcacatcgtaccaaaattaccgacaaatgatgactgggatgatgcattcgtcaataatccaagcaaccctcaatatttagatgatgatgaatatcaaaaaataagggtcatcttaagaaaggaactagaaaaagcctatgaagcgatcaaaaattaacgaaataatagacgatacaattatttttgcaaaagaacgtggactatatttaccaccttttgcgtactggaatatggataattgggattcagccgatagctcatatcaagaaattattgataatatgcttggttgggatgttaccgacttcaatgaaggacattactctaaacgtggattaacgacttttacattccgtaatggtaacttcaataataaagaaaagtatcccaagccatattgtgaaaaactattaattgttgaagatgggcaagaacttcccttccattttcattggtataaagaagaagatatcattaaccgcggtggcggaacactagaactaacgctctataattcaacaccagatgaagaatttgatactgatagtgaagtcaccgttgttatggatggtcatcatatcactgtgccagcagggacaacattagaactcctcccaggagaaagtatcactttgacacaaaaaatttatcatcgttggcgtggtcaaaaagggacaggaaaaattatgttatttgaagtttcttctacgaatgacgataatacggacaatagattttatgaaaagttacccagaattccatcgattgatgaagacactgcagctacacatctaatttttgacgactataagaagctacacttaaaatagtttattttattagttaatcaacttacaattattcattgattcagatcaactactagctcccacttaatctgaaagttaaacaacagtatttaggctttcctgtgttcttaacgggaaagtttttttaattaaaaattatgtatttattttttcgattcaataaagccggtccatattcaccaccaatttttctcatccacttcccatcttgacaatcgcccattacagccggtatgctggtaacaatttaatgagtttctaatataagaaatgaggttttaatatggtttgggaaaacaagctgggcgaccaattgttccatgaaaacatgaacaatatcgcccccacggggattattcaatactacaatttagtgattaaagaagcccgtggcgctgccgtcaccgacgtggctggcaagcaatacatcgacttattgggaagcgcttcggccgctaacattggacacaatcatccccatctaacggaagcactcaaagcccaaatcgataaactcgttagctacgacgttggctacttcaccaatcctaccagcatcgcactaggtgaacgcctaacacaaattgcccccggtaattctgcacggaaaatctcatttggaacatccggatcagacgccaacgacggcattatcaagttcgcacgggccgcaacggggcggtcctacattgtgtcatatgaaaatgcgtatcatgggtcaacatttggagcgttgaccgttggcgcttgtgatgttgacatggtccggaaagtcggtccgctagtccccaacgtcgtccacgtcccctacccagacacctatcggcacatggctggcgaggatgagcatgcgattgcgcaacgctactttgcggctttcaagcgtccatttgaaacctacttacctgccgaagaagttgcctgcgtgctcatggaacccattcagggagactcaggcattatcaaaccaccggctgaatacgtccacttagtttacgatttctgccaagccaatggaatcctctttgcggttgatgaaatcaaccaaggacttggacgtgctggtaaaatgtggtcaatcgaacactttgatatcgaaccagatcttatttctactggaaaatcactcgccgccggacttccactgagcgctgtgatcggtaaaagtgacatcatggatgcgcttggaacctctgcccacgtcttcacggccggaggaaatccactttgtgcggccgcttcgatggctacgcttgatgtgatcgaggacgaacatctgcccgaaaagtcggccaaagatggcgaatacgcaaaagcccagttcctcaagtttatggatcagtacgaattcatcggtgacgttcggatgtacggcttaaacggcggaatcgagatcgtaaaagatcgtgaaacaaaggaacctgataatgacgcggcggcccacattatcttccgggccttccaaaagggtctcatcctcgttaagttaaatggcaacgtcctgcgcttccagccacctctggtcatcacccgcgaccaactcgatcaggtctttaccatcatggcagaagtttttgatgactttgaacatggtcgaatcgaattaccagatgaattaaaaaacatggtgtggtaagcacaatagaatagtgacttgaaagaccaagaaacgaacgtgtttcttggccttttgtattctaacaataccacttgatcacgcttaccaacctcttagacaattgctatttacgtcaatcacaaaatatggtgtactaaacaacgcgaaaggatgtgggtcacattgaaagtaagagtggaaaaggatgccagtttgacagaaccagaacttatcatccgaactccaactgaaacacccatgattgaacaactaaaaacgacccttgagaaacaattacagcatcaacagacaatcactgcctggctcaaagaaagtcaggtctatgtgcccgttgatgatattttatttctcgaatcggcagatcgacatgtcattgctcatacgatcgatgatatgtacacaacacacgatcatttatacgaacttgaacaatcgttgcccaaacagtttattagaatttcgaagtctgcaattgttaacgtctatcaaattcggtcaataacacgatcaatttcaacatacttagtgacatttcaaaaaactaataagcaagtttacgcatcacgcagatattataaaacactaaaaacgcatttagagaaaatgaggtaatgaaaatgaaacgacaacgttggttttggggaatcttttttattttaggagctgctattctcgtatctaccaaaatgcactggctcacttacacagccggtacatttacgatcatcgcatccatcatattactcgcaatttttattaaaagcattctttcattaacaatcccaggcatcgtattttccgcggctttcgctagtatgctctacgcgcaaccactcggaattacagccctggtgccatggacagttttgggcacggctttacttcttagcattggcttatccctcatcttttccccatatagttggcaccaccgctttaaatcacatcacaatatgtaccatcatcacgctaatcgaaatcactcccagtggcaaacggataccccacaagaaaacgaccctaccacggtaaacatgaccgttagtatgagcaacagcattcgctacgttcaatctgaagatttacgtgtattaaatgctgatatctatatgggtggtgccaaaatttatctggataaagcccaaatcaaagatcaggcgactatgaacctaaacgttgaactagggggcttggaattatacatgccacgcgattggaacgtcaaaattcaagatgatgtctttctgagtggcattgaggaaaaggggttggcgaatactaaaaccggaccaacagtcacgcttcaaggacgcctccggatgtccggactcactattatttatgtctaacccttcagcctagtacggcgtcaaaagccggggccattccggcaccatcacaatcgattaacacgaaatttaccaaatcggtatcaatcaaattcaaaattagtttgacacacacagtaatatgttgtaaattactattcgtcaaatagtaatcagattggagcaaatacatgaccactcgacgtgatatttcaaaagacatgatccgtggcgcaaccgacggtatcatcctcaatattttgtctcagggtgactcgtacggttatcaaatggtgcaacaaattaaacaactttccaatggtacctacgaaattaatgaggcgaccctctacaccgtttttcgccgactgagtaaaaacggcctcatcgaaagttattatggcgatgaaacacagggtggtcgacgcaaatactatcatattaccaatgccggtaccgaagagctcaatcagtttcatcaagactgggcatttgcgaaggacattatcactaaattaacgacaggagtgctaaaaaatgattaatgaagctcttattaccgctgccttaaaccccatttttgcgggctatccccaaaccgatgatttgattgatctttacgacgaagttaaaacagatgtccgcgagcatgctcaagatttgctagacaaccatgacgctgcttccgcccaagaagctgtcaacattgctgtcaaagagttgggcgatctggctgaaccgcttcggctaatcactgctacccccgaatctgaaattatcgcaacacccaattctcaagccacagtcgatcaaactttttcacctcaagcaattcatcaaatctttctggacgctgattatggtaatgtccgaattaccccaagtagtgatcaacacattcacatccggcagtttcaacggccgaaaacagattctggtcaattacagattgcgctggttcaagatagcatccgcctcactgttccagccccaagctggctccaatacatgattccattctgtcaccccacatcacttgtcgaaattaatttaccgagtgacttcactggaacgcttgatgtagctctaaaatcgggctcattagtggcacgtgatctcgataatcacaccgatgtaaaacttaaccttcgatccggcagcgccaatctgtcacgaagttcattcgcgacactcaatgttcgtctcacctctggtagtatcaaaaccgatcaggtgagcgccgatcagttcaccgtcgacaatcattcgggttcaatcaaaatgagtaacaccaccgctcaatttgatatattagcccactctggtagcgtcaaaggaacaaccctcaccggagcaggacgattcatggcccactcgggttcgattaaactacactggacgcagatgaccggcgatatcgatttagaggctcattcaggctccatcaagagcgaactaccactcgatgaacctttcaaatttaaccttcaagcaaaatcggggacgattaaagttaatcgccaagccatttttgatgtccaggtaatcggtgctgcgatcggaaaaactgatccttcagcccagtacgaagtcaaaggccgggcccactccggtaccatcaaaatcgattaacacaaaatttaccaaatcggttcattagctgtttacatcactaactgatagtgggataatcctacttgctctgtttgactggccggttaatgaaccggaatacaaacgcgctttggcgtttgtaaatgcaattattgaaacctatttatggaggaacttttatatggtgcttaaagcaattggcaagtacaaattactcgtcactgccgcattattaaccatgctacttcaggtgggtgccgcgctttggcaacccagctatatgaagaaaatcctgagtgtcatggccaacatgtcgctatcaaccaacgggaaagttgataagattagcgattatggtgttgccctaatcggtatcgcgatcattggtttggtcggttcgattctcaatactgtaacggccgctaaaatttcacaagctgtttcggcagatttacgtgaaatgacctttcgcaaaattcaaaccttttcatatgaagatatcgaaaaatataaatccgaaaacttagttgtgcggatgactaacgatatcaaccaaattcagatgctcctgatgatgattttccaagttctcattcgggtgcccctacttttcgtcggggcttttatcctgtcaatcatcacgatgccccgcctatggtggattatcgtcgtcatggtgatcttaatcatgctagttaccggtttttccatgaaactcatgggaccccacttcatggccttccaaaaattgatggatcggatcaacggcattgccaaggataacctccgtggtgcccgggtcgtaaagtcatttgttcaagaaaagagccaagcagcgaagttcaataaggaatcagatgaactgatgggacataacctcgccgttggatacgccttttcaacgatgattccagcgttcacgatcatctcacaattggcaatcttcgtggccatcttactggtttccacgttcatcaccaagtccgcttcgtacgcccaggatcaattaggcggtatcatgtctttcattcaatacatgatgcaaatcatgttcgccattatcatgggtggaatgatgtcgatgtttgcctctcgtggtttagtctcaatgggccggattcgtgaaatcaatgacaccaaggtttcaatgacctttgacgacgtcgctgacgaaacacttgatggttccgttgaatttgatcacgtttcattttcataccccaatgatgatgcaccaactttgaaggacatctcatttaagatcaaaccgggtcaaatggtcggggtcgtcggggccaccggagcgggtaaatcaacccttgctcagttgatcccacgactctttgatccaaccgatgggacggttaaggtcggtgataaggacctgaaacacgtctcaaagggcacgcttaaaaagaccgtttcgatcgtgctgcaaaaagccatcctcttctccggtaccatcgccggcaacctgaaacaaggcaagcctgatgcaaccgaagaagagatgaaccgtgccgctaaaattgcacaagccgctgaatttatcgatcggctgcccgaccgctacgacgccgaggtggaagaacgcggtaacaacttctccggtggtcaaaaacaacggatgtccatcacccgcggtgtgatcaagcaacccaagattcttatcttggatgactcaacgtcggcattagatgcccgctctgaaaagcttgtgcaagacgccttcaaccgcgaattaaacgacaccacgaccatcattatcgcccaaaagatctcttcagtggtgcacgctgataccatcttggtgcttgatgaaggccacctcgtcgcccaaggaaaccacaaggaactcgtggcaacttctgacgtttaccgtcaaatttacgatactcaaaaagcaaaggaggcttaaaaagaatgaacgatacagcgcgtgcaattaagttcttttatttgtacctcaaaaaatataaacttcaatttctcatcattgccatcttcatctttgcggccacctacctgcaagtcgaagcaccggttgtgatgggagatgcaatcacccatttgacaacctatgtaggcgactttttcactcatcagcatgcccatgacgccattaaagcgctcaagaaaatcgctgatggtgccagtcaatcacaagactcactcaaggccattgccggccaacttagccaagccagcggtcataccatcacttggacatccctcaccgatgctaacgtcccacaacaggtactggataagctaccaaagggaacgacgattcacagtctccaacaaatggctcacatgccaactaattggaagcagctgacggacgctaacgtgccagccagcatcatctcttcacttccagatggcaccacaatccacagcctacaccaagtcgcaacatccaatccggccagcaaacatgatttctttgcgtccatgtggaagctcctggccttctacgtcatgacggggattgcccaactgatctacacgctcctctttacccgcattgtcgctcactcaacgaaccggatgcgtaaaggcctttttggcaaactggaacgcatgacgattgcctactttgatagtcacgaagatggtgatattctggcccgcttcacctctgacttggataacattcaaaacaccttgaaccaggcagccgttaacgtaacaaccaacattgccctgttcattggtatcttgattatgattttccaccaaaacgtcagcatggcctgggtcacggtttcaacgacgcccgtggcagtgctctgcgccgtcatcattattattcaagccaagcgttataccgaccggcaacaagccgaagtcggcgacttgaacgcctacatggatgaaaagatttctggtcaaaaggccatcatcgtggaaggtcaacaacaagaagccattgatggctttgtgactcgcaacaagaaggtccaaaaatcaacctttgcggcacaaacttggtccgggatgattttcccattgatgaacggcttttcactgctcaccgttgccctcgtaatctttttgggaactcgaattgcgttgcacgataactcactatctactgctgcagctctaggtctggtcgtaacctttattcagtatgctcaacagtattacaaccccatcatgcaaatctcatcatcattcggtcaactacaactagccgttaccggcgcaacgcgcttgaacatgatgtttgacgaacccgaagagattcggccagtaaacgggcagtcgtttgacagcattgacgatggcattcaaattgaacacgtggactttggttatcaacctaacaaaccaattctaaaagacgttaatattaacgtgaagaaggggcaaatggtcgcactcgtagggccaaccggatctggtaaaacaaccgtgatgaacctgatgaaccggttctacgatgttgataagggaaccattcgctataatgacacagatattcgtgactttgacctcgataagcttcgggctaaggttgggattgtgcttcaagaatccgttctcttctccgggaccattgcggataatattcgtttcggtaagcctgacgccacgatggatgacgtgattacggtagctaaaacaacgcatattcatgaattcattgatagcttacctgataagtacgaaacctacgtagacgacaacaactccgtcttctcggttggacaaaaacaacaaatttcgattgcacggacaattttgacggaccctgaaatcttgattttagatgaagccacttctaacgtggatactgtgaccgagcaacaaatccagtacgccatggaagccgccattgcgggccgcacctcattcgtgatcgcgcaccgtttaaagaccattttaaacgctgataagattgtcgttttgaaggacggtcaggtgatcgaagaaggaacccaccacgaactagttgaagctaaaggattttattcagaactgtaccataaccaatttgtgtttgaataaaggatacacagtgacttacttggctactgtgtattagcacaaaagcacgctgatttaaatcagcgtgcttttttataatctagagcgttaatattacaattctaactttgcttccaaggcctccgtcaaagtcgccgaaaaattgattccctgttccttggctcgttgcgctaagtctgcgggaaccgtcacatttttacgaactgttggtcgtttaacctgcgatttaataacgtttaaatcgaccatcactaagacgatcaactggtgtttatcttgttgaatcttttcaatcggtgttattttaggtaaagtacgcttgttgtacagggccagtcccaacgcctcttgaccgtgttgtactgcttctgtaaccgagctaccaaatgataacgcttctgggacatctacaaattcaatatcaaaagtaccattttcatctggtgtaattaacgccggataggtcactaaatttggtttttttattacaattttcctttcgctgatactgcttaaataatttcatttaagtcccgcttgcttcaacattttatgcagtaatcccttgggaacttctcgcgagtgaatagaaacaatcacagtcctttttgtcacctgattataataggttctatgtgaccctgcttgtcggattgcttcaaattcatgatcattcaaaatctctggtcttcattggcacgtccaatattccccaatcattatataatgtaacgatctgcattcgcactcaatacgcatatacgcattgagtgccatgccaaacagtctcttatatacaaatgcgaaaattttccctaatttataaaaagaacaccaacaaaaatcaaaaaccacagaaaattaatttaaggtacaaaaataatcccatcaaagatgagatcatttttttctacaatatcggtgacagcaaccgtgaaaacgtctgtttgaaacgtaaccacaacgactgatttttaaacgcggcagcggtcataactgtactctgttcaatatcctcaagatacagcttttccagctgctgcgcaatctgctcgtcatacataaacgcgttaatttcgaaattcaatttaaagctccggaagtccatgttggcggaccctacggacgataacatgccgtctgccaccattgtcttggcgtgtaaaaagccgttatcgtaagtgtaaattgttgcgccagcttcggctaattgccgggcataatactgcgaggcccggtatacgaaggcgtgatcgggtttgcatggaatcataattcgcacgtccacaccggactgaatggccaccttcaaagcatccagtacactgtcatctggaatgaggtatggactttgaatccacagccgttccttggccgaattaattaactttaggtaccccattttaacctgttcgacgtcgctttccggaccgctgctaacaatctgcatgctcgtatttccgtccttggccattttattgaccgggaaatactggcggtaatgcgtcaatgggtgatttttgctcgtcacattccaatccaaaatgaatcgttgttgcaacgaaaaggtgccagcaccaataatttttagatgtgtatcacgccaatagccaaacttcgccgaacgaccaaggtattggtcgccgatattaaatccaccgacatacccgatttggccgtcaataaccacaattttccggtgatcacggaagttcaaacggaaatcacgaaggtttgatccaacccccaagaagggttcggcttcgccaccatgccgtcgcagttggtcaaaaaagcttcgtttcgtgcccatcgatccccatgaatcatagatcacccggacttcaaggcctttttgagcctgtaattctaaggcctcgcgaatttgattcccgatttggtcgttataaaacgtataaaattcaatatgaatactatgtttggcgtgctgaatatcagctaatagttggtcgaacaattggttcccatcattaaaaatttgcaccttatttttctgggtaaggtaggcatgatcaatattttgaaacagtaaaatcatgcttctaaccgctgccgttagtcggttcatcggcgctgccgtcatcccgatttcgcgtttttgagcctcaagcgactccttgagttgtaacggggtctgttcgttaatgcgatccaaccgccgatgcgatagcttacgtccgataaaggcgtaggcaataaagccaactaccggtaataacaccagcacaagtagccaagcccacgttgccgcaatatcgcgcttttcacgaaaaacggtaaaaacggccccaaccacgttcaagataataatccaataaatcacagtcttgataatttcccaagtttccatatcatcctcgattcccaataatgttttttctaatttgaaagcgtaaaatggagaaaatacgttcgaaagcaggtgttgcagatggttgttcaactccccatcgcgattggtcagtatcacgcacttcacatgttaatcaaagaaaatcccggtttggcggtttgtatcgtcctgcttctcattgtcttggccttttatttcaagggtaaacgctaattaatcgttagccatgctttgattgagcagtaacgcaaactgcacgttttgcgcagtctgcggatcggccagatcaacatcgaggagttcctcgatctttttgatgcgataaataatcgtatttcggtgcacgtacatgctgcgggcgacctgcgccacctgctggtgaaaataaaaaaagttttgcagcgttttgagtaacgctgttttttcttcgtcgttatctagttgcaataacggtgctaagaatttttgctggaaggcactagcctcgtcacgtggaatcaatgaaaccaattcctgcacatactttggctgatatttatgaaccttcatacttggattttgcacgacactacgtgttgcctccaaggcttccttaaagatggcactaagccctgcaatcggcgcctgactattactataacccatcaaaaagccgtaagccaccgagattttatcgctaataaaccggtgtagcgcaatcacaaaatgctctgggtttacatcggccccaattagcaggaccaatcgctgccgccacgaaaataaaatggcgtttgtttgatactcattgataaaccacatgatcaactgctggatttgttccaataactggtagttgaccatttttttattgtcaattgccaccacttgggtcatcacacagctatacttcgccgttggattgagcttcatttctaacaatcgcttatccaatagatccgtcgaaataccaccgtctagcacgttcaggaaaaaaccggaccggtttcgaaaatcactttcgtttaacatatcaatccgactgttcacaaaactgagcgtattcatcaataattgctgcaaaataattctaaattcatcagtctcctgaaagtttttcaccgcaatgaacgccttattttccttaaatgctggaaatagtgggaataacgtgtacgaatcttctccctgccgaacggtgatttgtttttctagctgaaaataatcgattcgggtctgtcgaaaaaattctgttaattctaactcgtgatttcgaagggtttcggaggccaccgcaacgttaaagtgactatctagcagtaacactggggtgcccataatctgttctcccaggtccagcacactttccactttcggatgcttaatcaccagatcagctaatttttggttactttcaataatgtgtcgtagcttttttgttttttgttgcaacatagcctcgaaaaacagttgcatgccgtcactaattgatggcaaagttggaattttgataatcggtagcgcgacccgatcggctaactgccgcaaaatagggccaaacaatgccacttgactatccataataaccagtccggccgcattattttgtgccagttgcttaaccagcgtcatcattttgacctggtttcgaaatagcttcatgctatccaggagatacagcatccctgcttgatgatacttttctacgcgatccgtttcaatagtttggactgtatcaatcgtccgaaatttcccgttatctccagcaacgtacccaacctcatgtaagagttcttctgctaatagctgttcaatcgtcatggtgcgcctcctaatctgcttcgaagtttcccgacttcatcgtgttacatttctctcatcatgcaggcatttcaaggacgcttcgtcccatcataacgcccgctttatgcacttatgccaaatttcctccgcctttttgctaaattagacaatgattaaaatttaattagatcatacaatacttttaacatcaaaaaaaggggcgatccatttggatttactacgtaagaaagatttatcgttaattatcagcggtaaatatgctagtccactaaaaaaagaactcaaaacatttgatttaacaatgctgggaatcggagccatcattggaactggtattttcgttttgaccggtaccggtgccctcaccgcggggcctggtttaatgatttcatttgtcatcgcggcattagcctgcctattcgcgtctctgtgctacgccgaatttgcatcgctcgttcctatctcaggttccgcctatacctattcttataccacccttggtgaaattattgcctttatcatcggttgggacctgatgctcgaatacctgctttccgccaccaccgtctccgtcggctggtcgggttactttcagtctttgctagaggggctgggcattcacattcccaccgtactctccgctgctccagggagtttagcccacggtgccgtttcgtactttaaccttcctgcagcactgattattctcttaattaccgctctaatttcgatgggcgttcgtgaaaccaaacgcgtcaataacgtcatggtcgtcattaaaattgcggtcgtcttacttttcatcatcgttgccgtgcgctacgtcaaaccggccaattggactccgctattaccatttggctttaaaggggtctttgccgccgctgccagcgtcttctttgcctttatcggcttcgatgccatttcatcatccgcagaagaaacggttaatccttccaaaacacttcccaaagccatgttactcgcgctcggaatttgtaccctactctatgtcatcgtaaccgccattatgaccggtgtcgtgcactatcccatgtttgctaacttcatcgatcgccctgtatccgccgtacttaaaatgtccggccaaaattggatggccggtatcgttgacctcggcgcaatcttagggatgaccaccgtgatgctggtgatgctttacgggcaaactcgcattaccttctccatggctcgcgacggtctgatgccgaaattctttggcaacgtgaacccgaagactggcactccgtttaaggccacatggttatttgggtctatttcagcaatcttagcgggcttcgttccgctcaccacccttgccgaactggttaatatcggtaccctcaccgcgttcgttctcgtttcctactcggtactacgacttcgtaaaacacaacccgatttaaaacgggtctttaaaaccccgctggtaccattcgtccccattatgtccattctattttgtctatttctcatctttaacctcaaccccctaacttgggttcgtttcgtagtatggctgattatcggcatgatcatctactttggctactctcgtaagcattcaaaagtcggcattgaagagttaactaaaaacgtctacaaagttaaagatgacgtgaaccgtaaattgtgaattagcttaaaaaatgactagccacgtgtgctagtcattttgtttcgtcatctttatttttccccagcaaaacgtccttcagttgctgggttgctggtgcgaggacctgctgtttacgggtcaccaccgagatcacaaacctcggttgctggggatcttcaattttaacagtcaccagatcatcttcaggcgtgaccgccagttgggttagaaacccaattccaaccccctgcttgatcatatttttgagcattgtcacatcgggcgtgcggtaaacaacgttggggtgcatttggttatgctgcgcaaaccaatcgaacgcgcgcacgtggctaaacccggccgaaagcatcacaaatgcaaactgctccaactctgcaaaccggaccgtctcacgggtagcaaggacgtgatccttcggcaccacaatcgcaaatgccgtccgagcaatctgcgttgcctgtaattctgagtcagtattcggcccactcgaccccagaagggcgatatccagctgtccatcacggacctgctgaaataaagcgtccgagccactctcgaccgtttcaatctgatccatcagtccctgtccaattaacgctcgggcgatcttgggaaaatagtagttgcccaaaataggcggtaatcctagccgaatttttttatcccgaatgcgccccagttcctcccgagccagatgtaactggacaatcaccacttgggcgcgtgcataaagctgttctccggccaaagttaccgtcaaatgcccgtggctttggtcccgttgaatgagctgaatcgtaaactgatcttctaaccgtttgagcgccatggtaatggtcggttgggtcacgctaaagtgcgctgccacctgtgaaaaattttttatttcaactaattttacaaaatattccaagtcccgagtattcataaacgccctccctatcagtcatataaatttatattatcactaatttgtggtttgactataagtttttgtccgcgctacagtaagggcattaattcatacggaggaactagcaatgcaactcaccccacaacaactactaaataacccctttctcaacaaggggacagccttcaccaaagccgaacgtgatcaatacgggttaaacgggcttctaccaccggccgttcaaactctcgatcagcaggttaaacaagcctacgcccagtatcaagccaaaccaagcgaccttgaaaagcggctttttttgatgaccttattcaacgaaaaccatgtcctcttctacaatctatttgcccatcacgttgccgaaatgatgcccatcgtttacgatccaaccatcgcagattcgatcgaaaactacagtgccctctttacgaacccacaaaatgcaacctacctttccattgatgaccagaccgacatggcggcggctatccgccacagcgcggacggtcgggatatcaagctcatcgtagtgaccgacgctgaaggtattttaggtattggcgattggggtactcagggcgtagacattgccgtcggtaagctcatggtgtacacagtagccgccggtatcgatccttcccaggtcctaccagtcgtcctcgatgccgggacaaataaccaagccctgctggatgatgatctctaccttggtaaccggcatccccgcatttatggtgaaaaataccacgccttcgtcgatcagttcgttgccaccgtcgaagagctgttccctgaactgtaccttcacttcgaggactttgggcggagtaacgcagccgatattttgaaccaatataaggatcaaattacgaccttcaacgacgatattcagggaactggaatcattgtcttagccggactactcggtgcaatgaacgtttccaaacaaaaaatgaccgatcaaatttacatgagctttggggccggaacggccggggccggcattacaaaacgcgtgtacgaagaatttctgcagcaggggctgacaccagcagaggcgaaaaagcacttctacctagttgataagcaaggcttattattcgatgacatgcccgacctaacgccggagcaacggccctttgcccgttcacgcgcggaatttgccgatgctgatcagctcacgaccctgttggactgtgtcaaagccgttcacccatcggtactggttggtacttccacccagccgggagccttcacggaagctgtggttcgtgaaatgaccgctcacacggcccggcccgtcattttcccattgtccaacccaactaagctcgccgaggcatccgctgaacacctcattcaatggagtgatggcaaggcccttgtcgcaacggggattgccagcgccccagtccactaccacggtgtccgctacgagattggtcaagcgaacaacgccctcgtctacccaggactgggtctgggaacgatcgctgcgactgctaaactcctcaccgacggtatgatttccgccgcggcacatagtttgggcggcattgttgatccagatcaaccgggggcggccgtcttaccacccgtcaccaagctcaaccagtttagccaaacggtcgctgctgcggttgctcaccgagccattgcggaggggctaaaccggacccccatttcagatgtcgaccaggccgtggcggcgatgatttggacccctgtttaccggaagcttccggctgacatcgagatcatcaagtaactaccaacgatttaacaaaaagaatgctgatttcctgccaacgaggaatcaacattcttttttttactattaaactgaacgactcataatgatatcgcgttggacgtcatcctccaactgaaaaacatggtcacttacggcttcaaatcccatgtgtgcgtagaaagcctgcgccgcgtcattatgttcccaaacgcctaaccaaaccgtccgttggccgccttgttgggccacttgtagggcatgcgtaattagcgcagtgcctagtccttggcgtttaaacgcctgcttgacatagattcgttcaacttctagcgcatcagcgcccattgattcgctttgagccgccccaacgttcaatttcagatagccagcaagctggtgatcgactagcatcagctcaaacgtcgtgccaaattggttaagttcacgtgtcaattgtgcctcactgtaggcccttgctaaataggcgtgtaagttggctggtgtgttttggctaccaaaagtggctgtaaaagtttcaatactaatctgccgtaatgcggcgatctccgccgacgttactcgttgtaattgcattgtcaaaactctgatcctcctaatactggcgtggctggccctttttaacgccctcccaatctgcactgacgttggcactcattttagtcagtaattgggtcaccgttttgatctgcgctgaactcaatccctgaagtgccaccgtcgtggaatagtcgttttcccgtttgatctgcgggtaaatgcgctgccctttgtccgttggaaaaatatgcttaatttttttatttaccgcatcggcttgacgcataataaagccatttttttcgagtttttggattacccgtgacgcactggttcgatcgactttgatcatctcaattaaccgttcctgaataatccccggatgttcgcaaactcggacaaggtataaatactgtccccgggtcagatcaaactgcttaaattcgatattcgcaattgaatctagcgctcgggcaattaccccaatcgaacgcagcacattttcgtcggccatcctaccatccccttcttttgattacagtatacttgcataatattgtaattgcaacataattcattaaaaaaaataagacgttcaaccgcaattgaacgtcttacttttgtgatgctcgcaccaacagatcgtcaattaaactttggagcgaaatttcacgcatctgttgttcggctgcatcctgcacccgttgataagcctcatccaaggtagcctgaatattacccccgaccggacactgcagatttgttttttcgtccacatgcagtaaccgtcgatcatcatccagcgcgttgtaaatatccagtaacgtgatctcggttgccggtttcccaagttttggggcaatttttcccggttgcgtctgcaacagtcccgcctgcgatagcaacgacatcaaccgccgaatcaagctaggattcgattcgacacttctggcaatggccgcactcgacaaatcatcaccctgacaaatatcgacataggccaaaatatggaccgcatcgcttaacttatgtgaatacttcatcgttcatccatccgtttcgttattcttacaagctatcataccgcactggcgggaagttgcaacgatctttacctcgtcgttattccagtatctcccgaacttgatcggttagcgctggaagagcagtacctagaaccgttgcgaggtcgtcagtcgtttcagctaaatcaccgtcacgaattaatgtctgcagtgacgtaatcacagccgcagtttgcgcatcaattccagcttgttgcaagccctgtgtatatgccgcatcgctcacactcttaacagggaagtcatgacccgtaacctggtgaacggccgtagccagatcggcataggtccgcgattcgcccgcaaactcataaaccggtcgtggctcgtccagcagtatgacctgagccgctgcttgtgcgtaataccgttccagcgcccagccgacacgtccctgtcccgcagagtaaacaaacggttggttttgctgaccaccctgaataaaactcatctcattttccaagtaccagttatttctgagaaatgtatgctgaatccccgtctccttaatgagcgcttcggttgcctggtggtcactcgatagtggtgattttgccgtctcgacatggggaaaactggtataggcaatcaatgcgacacctgctgcctgcgctgccttaacgacattttggtgctgggttagccgagcgactgcaccacccggttgcgacgaaataaacaataatcgatccacaccagccagtgaatcagtcaattgtgcttcatccgtataatcaccggggcgaacctcaacgccggtagggagtacctgcgttgctttggcggtattgcgtgccaatgcaatcacattttgactaccaatttgatctaccaatgtttggatggctacccgtccaaattttcccgtggcacctgtcactgcatacttcatgtttaaagacctctttctatacgttgttattttaaaagtaacatgtattttatatagtaacaccattttcaaaatacgcaagtcatcgccttcaaaaaataaccaatctaaccactaccacaacaaaaaaagtccctcatcagtagctggttactacctcgggactttaaacttaattataggtgtgctctatgttgttttaaaaacagtaacgattatacgcttgttacaaatagaatgctatatggaatatatctgtgcgtgccaccgccaatgcggcgctgatttgatcgagttcgcacttaatgatctatgtgtcctgccgtggcaggaattatgatggtgctatgtggtgtaggaagttagtcttccctaatatgtgttcgaaatctgtacttcattaaaactatgtgtttttataatatgtgtatggtgagaaattgatactatgtgtttacgttttgcccactgatttaaattcctaatctgactaatgtcagaaatgtccgatttcatcgccaccacctcttctactgttcatttgaataaaaaaacgccctaccaacaactcgattactcgaatcattaataggacggaaaaacaccgtgttaccacctaagttcacctatctatcactaaacaggtctctcacgtacaatcatacgccggcacggtaatgggtgctttccaattcactttacttggcggacgccgttcaagtaatcactcaaggacgattttcaactacctcgttgccattccatctcaccatcactggaactctctaagttaacgaagatagtctactttttcctctcaacgtgttctcatgttttctcattcaaatttaattatgctattatattagtgccatttcattgatttgtcaacgttggattgtaaaaaaattctcatttttgataccagtcattaccttttattaaaatttactaatagttaatattattttcttcgttaattttcaaagatttcttcacaattacttcaaacattctgggtactatataaacataccaattaaacctctttcatttactcctcccaagtaatgaaactgggtggccgtcctcccaagcggtcaccatataattctactcctaaaagcaaaagccgattagccctcccaagctagtcggcttttgtctattccgtgtaagagtgtataatacgtgcatagaaatagtccgtactgatacaatagggatgcaaaatcaattagtcataatttttgaggtggtcttttgaataaccaggaaccaaatagtcgtgttgctcgttacgacgctaaaaaagaacaaaaaaagggtagtaaacgaggcttcggctttcaacgtccccataaaaataaaacgcctaaaaaaggtaagggaccccgtaaaaatggcccccggaaaccacaccggtacgtccgttggttgctttttgcgctccttgccgttcttctgatcatgatcgttgtcttcgcaatcaagcaacgcgatccggtcaatacgaatgacaccgactccgacgtctccacgtacacaagctcgtcgcacaaaaagaagcatcataagaagaaatcatccagttctgaatcatctagctccaccgcataccaggcaacgtacagcactagcactagcacatactcatcgtctacgcgcgcatctagtgctaccagctcgtcagttgcccaatctaccactagcagtgtcagctctagcacaccagctagctctgcttcgtcgtcttcaacaccacaaagctcatcttcagcacagcaaccaagcagtagtagtaacccgcagccatcatctgccagcagcgccgccagcgttgcgcaataattaagcgttactaaaagccttcaggcattctgaaggcttttctcatttcactagttagtctttaaaagcttttcaatgctttggtagtgcaaaaaaattccttgttgagcaagtgctcgaatttcatcactggtcgccaaccgataattcgtcacttccgagccctgtggcaccacatcggccaactcaaaagacaatttaaaccggtaaacatccacaaaataattattttgttcctgcggattatctcggcgatatgtgtatgcaaatccaccggttgcggccgtgacgtccagtccggtctcttctttaatttcccgtatcatcgcgtggtgcgagtcttcaccggcccgcacgccgccaccggaaacttcccaccatcccgcagcccagtccttgtccaactgtcgccgtgtaatcagataccggccatcctgattctgtaaaataccaagcaccgttaaatggtagtcgcccggcttcatgcgccaatcgttgcgggccattgtgcggccggtaaggtgttgatcctgatcgtagatatcccactgttccatgttctctaatctccccgagattgattttgtcatcactactgtaaggagtcccatgctggcaatacggttgccggtccttgggccaactgctgttgcattggtgtcagatacttcttattaaccaccacttcataagtgtaatcatcaaaccactggtccgtcatgacaaaatagcctttttcgccattttcttcaccccagctgttttcgaccttccatcggttgggctgatcgttcactaaatctacaccggtgagcgtcatcgcgtgcgtcacttctgcttggccactcgctaatcgatccgccttgctcatcgataaatcaacgtccaagagttcatcacgtctaaacagcttagaatctaataatccgcgcttccgatccatttgttgcaacacatcgttaccaaaccagaccgtctcaccatcttgaagctgcgcaatcgccgtccgtttcaactcctcaattggtgcgttcaagaattgaattggcagaccaccagcaacattgtcctgacttggcaatgcatataactgattgtattcgtgatcaggggcgttcgtcaataccacataatcgcgcagttgcatcgtaaagtactgctcataaaaagcgtggggcgttagttccggtacacgatggtaatgatgctgatcatcccggtactctaacgtgaaatcgaccggtggctctccaaaagcatatgcggctaactgataaatttgactgatcatcttttgttttgtctgctcaatgacctcatcactcgcctgagccgccaccaagtgacgtatttcgagggcgtccttacgtaattttaggttcatcacgtcgtcaatttccgtcgtattatttgtgttgtaggtttctggcataacgtaatttggaaccagtccgtacttctccacaaggctcgctgccatatcccactggccaccatcactagccgccatgctcagataaaaggcaacttcacgatcctttaaatcacgatccgcggtattgatgatgttttgaagaaaggtattcgcccgttcgaccttgtcccagaaaaagaggtagttttgagacagctcaaagtccttcacctggtatttagtcgcaaactggtggcgtagtgtattcagtgttgaaaataaccaacaccgcccactgtgcttctgattagaaacctttcccgtcttcaactcgacagaaaatgtgcgattgagtcgttgcgcggctgtcggatcttcactacttgccttgattccgtttttcataacggcccgggcaattaccggtgctgtttcacgtgaaacaaagtcctgatggtattgtttaatttgatctgtagtaattgctttgttagtcatgggattgctccacttctttcgcatcaaatttttgttcgcgagtcacagcgccttgagcaacagcacgcattgccgtgactaatccctctgcgcgttcgcctgcatcttggatggcttgggtcacgacgtcttctcgaatcttagtcacttgcggacacagcgattcaccatggtcagttaaatataatttagacattcgtcgatcggaggtcacaatttcttttcggacaattccgatgttaaccagctgattaattgaacgcgtcacgttactccggttcaaaaacatcaggtcaatgagcccttcctgcgtaatccccggccgttcatgtaaccgtaaaaggtaataatagttactggagctcaattttaacggtttgagtcgccgatctagttgtattttaatgtatcgatccgcaatcgaaatccacttgaggagttcgacctgatttgcttcgcctgacacggtgatcccagctttctctacgtacttaatagtcaatatgtgcgaaagcatatatcttttccccttaatagtcaagcaatgcggccatttcaattattgtggggtataataggacgtaatttattgcgggaggcagtacaatgaaaaacttttttgtcattcttggcgggatgggatccctggctaccgaaagctttgtccggttaattaaccaacgaacccctacgacttcagatcaagattatcttgactacctagtggtcaaccacgcgacgattccagatcgttctacctatattttggaccactcacaaccaaatccgggaccccaattagtcgccgatgtacaacaatttagcacgcttcatccccaatttttcgtgctcacttgtaactcggcccactatttttaccccgaaatagctgcggcaaccgataggcccattcttcatatgccccagttggccgttgaagaaatcaagaccatcaatcccagcgccaaacgcattgggattttaggaactcccggcaccgttaaaacgggcatctacgaccacttcattactgaagcgggttacgaaattgtaaaacccactcctgaaattctggccgaaacagaagcgcttatttttgaagatatcaaacaaaaagggcaggttaatccgcaccgttaccacgaagtgctacgacgaatgcaagaagatctgcactgcgataccactattttaggttgtacagaattatcattagctcaggaacaggcgcctgatcacccctactccatctccgacgcccagtccattttggccgataaagccatccagttagcgttgcaaggtcgccaaaaaaaggcgtcccaaaactaactgctagcccttaacataacaggcgccaccgccccagacttgggacgatggcgcctgttatattacgatctcaattacagcttaattatcaaaataactcttccagaacgtgttgatgttggctttcttcgttgcatcccgattccagaatggcacctttacaaccccgagaattttgttctttggcacgaagccccagtaccgaccgtcgtttgagacgctccggtgatctcctaatacaaagtattcaccctttggtaccttggttgcgccctgattcttttgccactggttttctaccgaaatgctttggagattccagttaccggtgcccgttgtccgttctgacgtcccaatgtagctttgatccgtcttcttaccattaacgtagatcacaccgttcttcgagctcacggtatcacccggcaatgcgatcacccgcttgacgtagtccgttgacgttgtgacctgtggatcgaccccctgggcctcaaacacgattacactaccccgatgaatggttgaccgtttcgatacaaggacccgttcgttattttccaagttcggttgcattgatggtccatcaacccgaaccagctggaaaacatagtttttaattaatagtgctgctaaaagtccgatcgcaattggtacgatccaactcagtatttccttgagtgctttcatagtagaattccccacttaatacgttctaataattgctggctcctaattaataacaattgtaatacaactcgcttgataagcaaacaaacaaaaccaagttgcttactatttttctgttttcatcccgattccatttcaaattcacgaatctggcctgtcgttagttattgtcttcactccccccgccaacaatgctaaaatgtaggttaatcaaacttttactggagatgagactatgaaggccgcagaatttgcagaactccttcaattaagccacgaagatcaacaaaaattaaccaatattgaaattaccgatgtcacacaagatacccgccaactatccgatgggtgctgtttcgttgccatcaagggtctccgttttaacggccatgaacatgttcaagaagccgttgatgctggcgcccggctcatcgttgtcgatgaacccgtcactgtgactggtgacgtaacggtgatcaccgtccctgatacccataaagcactggctcaaatcagcgcccgcttctttggtgatcccagcgctcaaatgaccatgtttggggtaacgggtaccaacggtaaaacgacgattacccacttgattagcaagattctagatgatcacgacagtaaaactggcattatcggaacaatgtataacaagattggtgatgaaaaaatcccaaccgtaaatacaactcccgatcctcacaccgttcaaaaactactgcgtgaaatggtcgaccaagacgtcatggaatgcgccatggaagtttcttcaattgcactggttgaaggccgtgcatggggcatcgattttgataccgccgttttcactaacttgacggaagatcacctcgatttccataaaacggtagaaaactactttgatgccaagaccctcctattctcacaattaggcaatagctaccacaaaactggtaagccaaagaccgctgtgattaacatcgatgatccttatggccgtcgtctcattgacaagaccgccgcaaacgttttgacgtacggaacgcacggtcaaggtttgctacaagccaacaatattcgcgtaacaagtcacgggactgaatttgacctcagcatttatggtcacagctatcccgtcaagcttcaactaatgggcgacttcaacgtttataacgcgctcgcagcctttggtgccacctacgaacacggtttagcaccggaagacattatcgcatcattagagtccgttcaaggtgtccggggccggttccaagtggtgcctaacgaccaagatgtcaccgtcatcgtggactacgctcacacgccggatggcctaaaaaacgtcctgaacacgattaacgcgttcgccgaaaaacgggtctactgtgtggttggctgtggtggcgatcgcgaaacaacgaaacgcccgattatggccgaaattgccctgaataactcgaccgatgcgatcttcaccgccgacaatccgcggaccgaagacccagaagccattttagatgaaatggttgccggcatccccgctgattcctattcccgcaattcggaccgtcgtgaagctatttacatggccctttccaaggcccaaccaggcgacgtcgtcttaattgccggtaaaggccatgaagactatcaaatcatcggtaccaccaaacaccattttgacgatgtagaggtcgttaatagtttctttgaccaacaagactaatatgaactcacgataatgcttggcattatcctgcatattacgatcatatccgtagtttctcagtttcaaccaaataaaatgaattaatctccgactttgatcagagactaattcattttattgtttttaacaccatttaacttatttagtgaggagtcgtaaaaactatgcgttctttttggtatcactatcgtggcacgattttactactcatgggcctcatcatcggtggtattgccggtgtcatttacggtccccaagtagccatcgttaagcccctaggagacttattccttaatctcatgtacatgattttaattccattggtctttttcagtatttcgtcagcgatcgctaacatgactgaaattcgccggctgggtaaaattttagtcaccaccctcatcgtttttcttgccacgtcactagtatccgcgatcctcgggtacttagcagtcctcatcttccgaccaattaataatgtagatatggccagcgtcaagcacctcatggggagtgtcaaaggtgcaggcgggcacagttactggctaaatcaactagtcaaaaccttcaccgtcgacgactttaataagattttgaccaaggataacatgctatccctcatcgtggtcgccgtcttcactggaattgcgacatcaacctctggtaaagcggcccagccattcgcccagatcctcgccgccggcaacgttgtggtcatgaaaatcgtcaagtacatcatgtactacgccccaatcggactaggctgtttctttgctaatattatcggtaatctgggcgccgaaatggtcaccacctacctacgcacctggctcgtttatcttggctacagcgtcttctacttctttgtggtgatgagtggctacgctctaattgccggtggtcaacgcggggtccgggccttctggcgtaacattgccacgcctgcgattacagcgattgcaactagttcatcggctgcttcaattcccgttaatattgagtacactaaaaaaatgggcgttaaggacgatatcgccgaaaccgtcattccgttaggggccaatacccacaaggatggttccgtcgttggtggcgttctcaaagcaacgttcctcttcgtcctgtttggccgtaatattgcgaccctagaaaacgccgcactgattatttgtgtcgggtttctggtaggggtcgtcatgagtgcgattcctggtggcggatttgtcgctgaaactgtcattattaccgtctttggcttcccaatggccgccctaccactaattttgatcatcagtgaaattatcgatattcccgccactttactgaattcctcgagtaatactacctccgcaatgctgatctcccgcttcgtggaaggtaaaaattggctggataaaacggcctaaaaatgaaaataggggtcattaaatcccgacctaacaaaaacaagctgagtaaaaatagctatttttactcagcttgttttaatgtagtcgaacatatttatagttaacaatcgccccaaacgaggagaggtttaaccccgtcacattaggcttttgcaggtaggtgaccccctgctgatagatcggtgccacgacggttgctccctgaatcgcctgtttctctagttgctgaatttttcgccaccgagcaacggaacggttcgctaggcaccccgataggtctcgtaatccctgatcatagcgtcgattactatattgtggcacgttggctaaactcttggaggcgaagaacgacacatagttagccggatctggactattcggcgtccaagtaccaatgaccatctggaagtgtcccgcttcctctaacttgatccgttgagccagtgtcaccgtcttaatgctaacttttaatccgggtaaattatgctgcaattgcgcctgcataaattcggccatattttgattgccagccgcgttggaaactaagagttgtaacttgatgttagatgtatgcagctgcttcttagctaggagccattccttgtgcgactggcgtaagctgtacttagaggtcgccacccctttttctgccgcccggtagtctctgtgatgtaccggatccttgacgaggcccgttggaatcagaccattaaggggggatgagccgtcacgtaacacgcctctagcaagtagaactttattatacgagtgggcaattgcccgtcgtaggtgaacgttttgcagttgtttttgctgcgtgttaaagaataggtacgccgccgttttagttaactcctgatgaatcaccttttgcccaatatagcgttgtagcgttcggtccgtcagttgcgcgtaggccactttaccttgatcaaacagggccgccgccttcgctgacgtcgcgatcattgcaatcttgacttgctgaattttaaccacttttcgatcccagtactgcggatttttaacgtaactccagtggcgatcccgacttcccgtccagttctgaacggtgaacggaccgtttgagaccgtatactttgagctggttccgtatttcgatccaacccgttctacatagctttgatcaagcgggccaaacgcgcgccccgccaacagctgcggtaaatactgacttggcgctgccaacgtgatctgcaaagtgtactttccgatcgcctttactcccagctgcgtcacattctttttaccagccgtgatggcgaccgcatttttaatcactgataacttgctcgcgtttcgtgagcccgtggctggatcaacgacccgccgccaagcgtacacaaaatcactcgccgttacctcatccccgtttgaccagtgagtatgccggagttgaaatgtataccgcgtccgtgcttggttaaccgtcggcttttgcttagcgacccccaacataatccggttatgggcgttatacgtatagagtccctccgactgggcctgaatggcttccgcatcggctgttgatgcgtacgtactgacatccagcgtcgtcacggggacgttcgttgtgcttcgcatgacctgatcggcatgcacgctagttccctgccacagggcgccacttaccagcgcggttaatccgactatccaccacttcatcgtttaatccctactcccattaatccaatttcggtaacgcgggtttactgtagtagtacccctgcgcccattcaatcgataattgtttcatcatcgctacgtcttgatcagtttcaatgccttcgactgcaaacttcaactgattttgtgcggctaattcctgccaaaaagcgacctgctcccaaatttcggcggtttctcgctcctgccgtaaattctgaactgcaaactttaagcaatccacgtcggtcagtagcggtgccactttgtcgtacaggttgtccgattccacatcatcgattgccaattctaccccgccagcgtgataaatctgactcatctggtgcatgattgcggccgtcggaacgtgggtaatttcgacgatcattgctaccagttccggctcactttgaaagtacgccaccagttgatgtgcggtatcagggtctgcaaactgatcttttgtcaggtttatactaatcttcttaacatctagttgcggcaaaatattcttgatgagttcaatttgagttgctgccgaaatttcaaaaacgcgtggcagctgccactgcttgaaccggggatgatacatccgtaacaacaactcatgccgtaacgtcttgcccgttgccacatcaacgatcggctgggtaaaaaaacgatacgttaacgaggcgacattatggtggtgggagcgaaaggtttggttttcgaccgtaatcgtgtcacgaccactttgcttagaatggtataaactagcatcggcccgctgatacagcgcggtaaagtctggatccgccgcttggcgctgactcaccccgaccgacaatgtaatctgcattgcgtcatcttcgtaataaaactttgcttcccgaatctgggtccagaactcttcaacgagttccatcacctgctccggtgtgtgatgtccaaaaataatgttaaactcttcaccgccagtccggtagaagctataatcatccatcgtactatccgctaaaatctgggtcacccgctcggccacgccgactaataccgcattcccggccatatgcccgtagctgtcattaacctgcttaaaatggtcaatatcaaacatcactagcgttaacggctccgttcgtgaacgggtttgcatcagtaacttgccatcagcgtcaaacgacgaaaagttcctaatacgtgtcaagccatcgtagttgacctggtgcatcagctgactttgttccacctcgttgcgccgcgccgacgtccagtagaaaaagttaaagatactcatcatgccaaacatggcaatccccatgacgaggtattccctcgttagttgtgtttgcgtcaaccagaaattgatgcccagccaaaacgacattcccaaatcggcccaccagtggtcggtgatctgccggttccacttatagatgatggccaaaataacgactagattgaccagcgatgcgctaaaggtccagctgaaaaccggatcgttgtacacccaaaacaccatcagtccgagtgcccgaaccagatattccttccctcccatttgatcatccatcagtgggatcgccagggcgtacaaaattaaattcaagtatgtagtactgttaatcgggtcaataatggccgcgaactggaaaaagatcgccataacaaaaataaaggcggtcattccgccacgcgttaggcgttgtcgttgcttttgtgcgtaatgatgattacgattcaaaaatggaatccactcttggttgtaaaagaccacgaatcccgaaataaaaaagatcgcgatgaccacttctaccaaccaggtgccccaattatatgtccccattgttatacctcatacttatcaagtgattattaatcatattttgtcaattcacgttaactatacaacatccatttctatttccaaaggtaaagtttaagatttattaaagaaagcggtgtcactcgattgaaataaccgaataatgattaaatttcacaaaaaaatagcgttgcgcaaggacactactgtgttcgcgcaacgctattttgcttattgggccgcttttagcttggcaattttgccttgttgaatatagacactcaagatcgcaatatctgcggggttaatgccgctaatccgcgatgcttgggcaatagtttccggccgaatcttgttcagcttttgatgggcctcggtagctaggccatcaatggcatcgtaatcgattcgatctggaatcttcttcgcttccatcttcttcaaccgttcaactttttgttcggcctttttgatatagccatcatacttaatttggatctcgacctgttcaatgacccgccgatctaattcgtgatcggctgctgggataaattgaagcaaatcggcgtacttcacttctggccgccgcaagaattcacttgcgagcacaccatcttttaacggcttttgcccatttttagctaaaaaggcgttcacagcctcattgggcttaatccgaattgatgccaatcgtgcttcttcggcttccacttcatgccgtttggcaagcattgcttcataacgctcgtcgctaatgagaccaatttcatgtcccatttccgttaaccgtagatcagcattatcatgacgcaagatcaaccggtattcggcccgactcgttagtagccggtaaggctcgttggtgcccttagtaaccaagtcatcgaccatcacgccaatgtaggcatccgaacgcttcaggattagagggtccttgcccagggctcgcaaaccggcattaattccggctaacatgccttggccggctgcttcttcataccctgacgttccgttagtctgtccggccgtgtacaggttcttaaccagtttcgtttccagtgtgggccgtaattgataaggcgccacaacgtcgtattcgatggcgtaacctggccgcatcatttctgcattttcaagccccttgattgaatgaacaatctgctgttgaacctcttctggtaatgacgtcgacagcccctgaacataccactcatcagtgtttcgtccttcaggttctaggaacagctggtggcgtgacttatccgcaaaccgtacgatcttatcttcaattgatgggcaatagcggggacccacccccttgatcgtgccggcaaacatcggtgcccgatccagattatccctaattaacttatgggtgtcttcgttagtgtaggtcaaccagcaggagagctgatcctttaacaagaggtagtcactatccggggtcgtaaagctaaagtggttaggctccgcatccccgagttgttcctcggtttcggcgtagttaatcgtcgttccgtccacccgggggggtgtccccgtcttgaaccgcttgagttcaaaaccgagctcttccaagttaccggatagtttcatggctgctttagagttattaggaccagattcgtattgcaactcaccgataataatcttgccacgtgccgccgtaccaaccgttaagacgaccgttttggcaccgtaatgtgccccagtattcgtcacgacgcccttgcagaccccgtcttcaacgatcaaagaatcgaccactccttgccgtaaggttaagttcggttccttttcaatcgtatgtttcatttcggcatggtacgcgtgcttatcagcttgggcccgcaatgctcggacagcagggcccttccccgtattcaacatccgcatttggacgtaggtcttatcgatattcttacccatttcaccaccgagagcgtcgatttcacgcaccacgatgcccttagcaggccccccaatggaagggttacatggcatgaaggccaccatttcgagactaattgtgattaacagggtcttatttcccattcgggcggcagcaagggccgcttcactaccggcatgaccggcaccaacgacgataacgtcgtaatcttttcctttataaggtaaagcttgttccatgatttttgtctcctaagtttttaagttaaatctaaacgttgcactgcttggacgaaccgcttattttcccaaacaaaattggctaaagagttgatctagcaactcatcttgatagctatcaccagtgatttcaccgagtaaatcccagcaacgggtcatatcgatctggacaagatctaccggcataccgaccgcaattcccatctgcacatcgttcagagcgtcactggcctgatgtaacagcccgatgtgtcgcgcattcgtgaccatcacgctgttttggttactctcaatcccctcttcaaagaagagatggttaatcttgtctgccagctggtccatccccgcattatgcacgatcgatgtttcaatcacatgatcatcatcgacatatgtccggagttgatcgcggtctaattgcatcggtaaatccgttttgttcaacaatacaatccgttgactcgcatcagtttcttgcaacagatccagatcctcttgttgcaatggttcactactattaagaaggaggagcactaaatcggccgtttcaattgcttgatggctccgttcaacgccaatttgctcaatttgatcggttgttttacgaataccggccgtatcgatcaatttcaatgggacaccgttcacgttcacgtattcttcgatcacgtcacgcgtcgtaccagcaatgttcgtgacaatcgccttatcttcgtgtagtaaattattaagcaggcttgatttacccacgttgggccggccgataatcgccgttgccagaccatcccggaggaccttgccctgcttagccgtcttaagcaactgatcgatttgttgcttgagttcggcacttttttcttttaataatttggtggtcatttcttcgaccgcatcgtattcgggatagtcaatattgacttcaacttgagccagcacgtccaaaatatcctgacgaagcgccttaattaatcgcgataaatcaccatcaagctgatttaaagccaccttcattgaacgatccgtcttagcccgaatcaggtccatcaccgcttcagcctgtgacagatcgatacggccattcaagaaggcccgtttggtaaattcacccggttcggccagccgtgccccgtaacttagggccagttgtaaaattttgttggtggccacaagaccaccatgacagttgatttcaataatatcttcacgcgtatacgttttcggggcccgcatcacggataccattacttcatcgacttctttttgcgtcgttggatcaatgatatggccgtagttaatcgtgtgactcgcgacctgggtgaggtccttaccatggtagatttcactagccacggtcagggcgtcatcaccgctaatgcgaataatcgaaataccgccttcccccaccggggtcgaaatcgccgcaatcgtatcaaactctgaatttgccacgttagctctcctttcaaaatacatacaccaaataaaaaaagcgccactccacgcctgccaaaaaagccagcgtggtcaaagcactttcactactttacccgtattaacatttaaacgtccattattttagaaaactttggcaagattgtcaatcattattgtctcccgccatgatattcactagctcaattcgctggccggggcaacgacaacactccgccgtgggtcgcgaccgtgcgaataagtccgcacaaatttattttctgctaaaatttggtgcacctgcttccgttcattggccggcatcggatctaaataaaccgccgtgccgctcgcaatgacttccgtggccgcctttttggctaccccgatcagtactgtttcccgctttttacggtaatcattagtgtccagcacgacggtgacctttgcaacaccgtgtaggttcataaaggtctgtcccatcgattgtaacgcgttaatggtcataccatgacggccaatcaccttggccggctggtccgttgctaactcaatcgtcaccgttcggcggtccaccgttacggttgtttcaactggtaactgcatgccatctaaaatatcacccaggtaataccccgccatttcggccacctggtttagtttttgctggttcgccacttcacgacggtgaatttcggccggactaatttgctgatcgtcggtcgcttcttcactttcgtcttcggtcggtgcttcttccacgccgccaaatccttccgtggcctctttttggtgctgctgcacattgacttcttcagcaaggtccggatgaaggagtgccccacccgtatgttggggtaaaatcgccttcacttcgacttgcgcttctcgccgatgcaagcctaagaatcccttcttaggcgactcaatcaagttaatttcaacttcgtgtcggcttaatttaagggtgcgcaacccattttgaatcgcctcggcaactgttttacctgtaaaaatcgccatttcgcgacctcctcatgttcttatcgtcaacgattataccatacatgggcatgaaacctggcacaacgtttctggccatccgatcgtataaaaaaaggccccgcctcacgacgatgaccttaatcaagttcagcttattttcgacgaccctttacggcccgccgcttggctttttctagtttcttacgcttggctttttcagcggcttccttctcagcccgttcgcgattaatcttgaatgggttttgaatagcgagtgtttgaccagcttggaagacgttcgttaccacccagtaaagggagatggctgacgaaatattcatcgccatgaagaaaataaagattggcattaaccatgtcatactggtcgtcatcgcgtttttctctggcattgaggccattgataaccacgagctaacaaacgtaaacagtgccgcaaggagtggcaagatgaagtatggatctcggtgacccaactgtaaccacataaacgacccggcccgcaaaacatccgtccgccagattgcttgatacagcgcatagatgactggcaattgaacaatcattggtaacatggatgcgaatgggtttacgcccgcttccgcatacagcttcttttgttcagcctgcatcttctgaacggtttccatatccttagaagaatacttcttttgtagtgccttcagtttaggttgcagttcctgcgtcttacgcattgatttcgtttggtaaatcatcaacggcaggataatgatccggataatgatcgtgaagatgatgatccccatgccataaccgccgaagctgtttgacaaccaaatgatggcccgtgagaagttgtaaacaatccaatgatcccacaaaccagtgctgtgactattaatgggcttattcgagcacgctgccaaaaatagccctagtgacaaaacacttgccaacgtcaggtactttttgatgtgttttttcaagccttattcctcactttgtttttcgtctaagagttgagccagttttaatgcatgcattaaatgctttttagtctcgaccatactcatctgatcagcggctggacgagcaatcaccaagaaatcacaatcggctttcaattggggctttacttccagcaacgtttgccgaatccgccgtttaacccagttgcgatgaaccgcattaccaattttcttgccgactgagattccaacacgaaaatgcttttgtcccggtttctccattgtatagatgatgaatttacggttagcaaccgagttatgggtctcaaatacgcgctgaaactcgctttcctttttcacccgatacgattttctcataattaattttctccaaaacttttcagaaaaaaagaccactatagtctagtggcctttttatgcagataatacttttctgccttttgaacgtctacgtgctaatactttacggccgttacttgtactcatgcgtttacggaaaccgtgaacacgtgaacgatgccgtttctttggttgaaatgtgcgcttcatatatatagcacctcctatttagcaattgatttatttttatagtcgaaaagtccgttctttccaaacaatacctatcgattttagcacactcattcctaataataaaggataaaaaataaataaaatttttttagttatccacaatttagccaaataatccacagcgttgtttttgcacagctttgtctcaaattctttccacaggtattttccgcgtttttgcacatgtaaacaccctgttaataaagttatccacagacattttatttgctgtgaataactctcgcaagtcccgctatcatcacgttggtttcgaacacctttttgtggaaaactctattctggtccagttcgtctttgttttacacatccctgtggattatttccacacagcgttgtgcaatttgttatttctttttttaacaccctgtggaaaactccttgtcaacatgctaaactaactaaagtatttctttaaattaggaggagtcactgtgaatgatctagaagcactttggcaaatgatcaaaaaatccttcaaaacggaagcatcgcccgtcacctactcaaccctgattgagccggctaaggctatctcgctagccaataaccaaatgactatcgaactccccacccgttttcacaaggactactggaatgattcgcttgcagataagtttcgcttgtacgcttatgaggccacttcgacgaaaattgaacctcattttatcgttgaatcggaagagccggccgaacagccccaagcaactgtcgttaagccatcgttcaaggtcaacactgcccttaatccgcgttacaccttcgatacctttgtgattggtaagggtaatcaaatggctcacgcggctgctttagtggtttcagaagaacccggcaatatgtacaacccgctcttcttctatgggggcgtgggacttgggaagacccacttgatgcacgccattggcaataaaatgatggctaccaaccccgaaacccgtgttaaatacgtcaccagcgaggcattcacgaacgacttcattaatgccattcaaaccgggacgcaggaacaatttcgacaagaataccgtaatcttgacctcttattagtcgacgatattcaattcttcgcagataaggaaggaacgcaggaagaattcttccatactttcaacgccttatatgaagaaaacaagcaaatcgtgctcacttccgaccgtttgccaaacgaaatccctaagctgcaggatcgcttggtctcccggtttaagtgggggttgtccgtcgatattacgcctcccgacttagaaacccggattgcgatcttgagaagcaaagctcaggctgaccacatcgacatccccaacgacaccctgacctacatcgctggccaaatcgattccaacgtccgtgaattagagggcgcgctttcccgtgttcaggcctatgcccacctcagtaaagccattatcacaaccagcttggcctccgacgccttgaagggcttaaagttgtccggctcaacagttttgacaatcgccctcattcaagaaaaagtcgccagctactaccacatttcgcaagcggatctgaaaggaaagaagcgggtcaagcaaatcgtcgttccccggcaaattgcgatgtatctgtcacgagagctcacggataattcgctccctaaaattggggccgagtttggtgggaaagatcatacgaccgtgttacattccatcgacaaaatcgaagaagccctgcaaaccgatcaaagtttgcaagaagatgtgcaaaaccttaaaatggaactgaaaccttagcttgtggaaaacacaggaatgaattggtcagttatccacaagatatccacaggtggaaaactaactggtcattacgttcaccgtccttttcaacattatccacaggccctactactacgactttctttttaattaataatatataaatcccgttaggagcttatcagatgaaatttacaattaatcgttctgcgtttaccgcaaaattaaatgatgtgctacgtgctatttcttccaaaaccacgattcccattttgactggtcttaagatggttgtctcaccacaggatgttaccttgacggggagcgatgctgacatcaccatccaaaccgttatgacgaccgaagatgatgcctttggtctgaccgttgatcaagccgggtcaattgttctaccagcgcgattcttcagtgaaattgtgaagaaactacctgatcaacaggtaacgattgaagttagcgatggttttcaggcccaaatcacatctggttcagcctcatttactattaatgggcaggatgctgaaaattatccgcgattaccagaaatcgaaacaaccgacaccgtgaaactagcgggtgacttgtttaaagaaatcattgggcaaaccgtcattgctgtttccaatcaggaaagccggccaattttgactggggtgcacttcgttttagagggcacgcaattaatggccgtcgccacggatagtcaccgattggcgcagcgtaaggtgcaactccccgaggcgattgcccaacgctatgatgtgattattcccggaaagagcttaacggaactgtcacgaatgattagtgacggcagtgaaaccgtggaattacgaattgctgaaaaccaagtgctctttattctcggcgaaacttggttctactctcgtttgttggaagggaactaccctgaaactagtcgtttgattccagaatcatccgaaacaaccgttgaattgaacgcgtcgagtttcttagcttcaatcgaacgggcctcgttgctctctcacgaaagtcgcaacaacgtggttaaattgaccctcggaccagatgctaacttggcaaagattagcggtaattcgccagacgtcggaaatgttgaagaagacattcaggcttctaatctggaaggtgcgggtcttgaaatctcgtttaatcccgattacatgaaggacgcgctgcggtcatttggccaaagtgaaatcaaaattgcctttacgtcggcactgcgaccatttacactggttccaacagaagacgaagataatttcatccaactaattacacccgttagaacctactagtcataaataacggcaactcaaaataaacgttcccacgctatgtggtgaacgtttttttttttttgaaaatgttcgtttttcccctcataatcactaaaaatgatggtcaaatgttctcattattctatgaaaacgccatcatcttagctgacgaccctcaaatgaccaaaatggacgctaaaccggctgattttaattttaaggcgttttttattgtttttgataaaaatgccaaaatacataaaacaggctataaagtgggtaaataagcgtgattcatttgtttttcgccatttttaaaggtataatagatgggtaagtgagagtaggtgatgagatgcaagaatccaaaattgttcagattgagggcccctttattaccctcggacaactgttgaaagaagagtcaattattgcctctggtggtgccgctaaatggttcctcagagaaaatgaagtgttagtcaatgatgaaattgatcaacgtcgtggccggaaactttatcccaatgaccatgtgacggtccccgaggccggtagttttgtcattcaaagtaagtaggtagcacaatgattttaaagcaacttcatttgcacaattttcgcaactacgatgatttgaccgtggactttgcccccggagtgaacgtcttaattggtgaaaatgcgcaggggaagaccaacctattggaggcggtctacgccctagcattaacccgcagtcatcgcacttcaaatgaccgagagctgattaattggcaggcgcacgaagccgtgttatcaggatcggttgaaaaacgaactgatacggtaccactagaactccatttttcagcgaagggaaaaaaagccaaggtcaatcatttggaacaaagccggctatcccagtatgtgggccagctgaatgtgatcgtgtttgctcccgaagatctatcccttgttaaggccgggccagctgttcggcggcactttatggatcttgaatttgggcagatgagtaataagtacctttacaactctggtcagtataaaacggcgctccggcagcgaaacgaatacctcaagcaattacgatcgcgccgccagtcggatcgggtctttttgcaggtcctgtctgatcaggttgcagccctaggagcagaaatcattgttgcgcgcgcagcctttctcaagcaactagagaagtgggctcaggtgattcacggagatatttcacttcaaaaagaacagttacggtttcagtatgcgacgcaggtgacgttgaacgatgacctcaaggtagaagatgtttaccaggcgttattagagctgttaactaaaaatgaagatcgagaaattgaccatggatcaacgctttatggaccacatcgcgacgatcttatttttttggtcaatgataagaatgttcagacctacggatcacaaggccagcaacggacgacagctttgtcggttaaactggctgaaattgatctcatgaaggaacagactggcgaatatccggtcttgttgctcgacgatgtgctgtcagaattggatgatgatcgccaaacacatctgttaacggccattcaaaataaggtgcaaacttttttaaccaccacgagtttgagcgggattgcgcggcagttaattaatgccccgacgatcttcagaattgcgcatggcacgttggaaaaggaaacagaagagacaaacgaaacaaaaacggacgagcaagcagactcgtcatcggagacggagtgactcagggaaccattgcgcaacgcgtggatggtgtaattcaactaaggaggaaacaaagtgagcgaggaaaacgaaaccaaagcagaacgtgcgagagaatataatgccagtcaaatccaagttctagaaggactagaggccgtacggaaacgtcccggaatgtacattgggaccaccacgtctcaaggactgcatcatttggtgtgggaaatcgtcgataacggcattgacgaagcccttgccggcttttgcgacgagatcaacgtgatcgttgaaaaggacaatagcgtgaccgttactgataacggccggggaattccggtcgatattcaagctaaaacagggaagcccgccctagaaacggtcttcacgattctgcatgccggtggtaagtttggcggcggcggatataaggtttccggtggtttgcacggtgtgggagcctctgtcgtgaatgctttgtcaaccgaattagacgttcgtgtgattcggggtggcaaggaatactacatggacttcaaccgggggcatgtgaagacgccgatgaaggtcattggtgatcgtcctgaagatcagcacggaacaatcgtgcacttcacgccagatccggatattttccaagaaacgacgacctatgacatcaaggtactcaccacccggattcgggaattatccttcttgaacaagggcctaaagatcacaattgaagacaaacggcctgcagagccgactaaagagtcattccactatgaaggcggaatccggcactacgtggaataccttaaccaaaacaaagacgttctatttgacgaacccgtctatgttgaagggcaggaaaagggtattacggttgaagtatcgctgcaatatacggacgattttcacagtaacctcttaactttcaccaacaacattcatacctacgaaggtgggacccacgaaacgggctttaagactgctttgacgcgggtcatcaacgactatgccaagaaaaatgggcagattaaggcgaatgaggatgccctttcgggggatgatgtgcgtgaaggcatgacggccgttgtgtcaatcaagcatcccgatccacagttcgaaggacaaacaaagacgaaactgggtaattcagatgcacggaccgttacggatcatttatttgctgaaacgtttagccgattcatgatggaaaatcccgacgtcgccaaaaagattgtcgacaaaggtattttagcgtctaaggcacgaatcgcggctaaacgggcgcgtgaagttacccgaaaaaagagtggactagaaattagtaacctccctgggaaactggccgataataccagtaaggatccagcgatttctgaattattcattgtcgagggtgattcggccggtggatctgctaagcaggggcggtcacgactgacacaagcaatcttgccaattcgggggaagattttgaacgttgaaaaggccagcatcgataagattctggctaacgaagaaattcggtccctctttacggcacttggcaccggctttggttcggattttgatgtgacgaaggcgaagtaccacaaactcatcatcatgaccgatgcagatgtcgatggggcgcatattcggacactactgctgacgttgttctaccgcttcatgcggccaatgatcgaatccgggtacgtttatattgcccagccaccactgtatcaagtgcgtcaagggaagtatattcgctacatcgattcagacgaagaattggatcaagtattgagttccttacaaccaagtcctaagcccgctatccaacggtataaaggactgggtgaaatggatgccgaacaactttgggaaaccacaatggatccagaaaaacgccgcttattgcgggttaacttagacgatgcgatcgaagccgatcaagtattctcaatgctgatgggtgataaggtgctgccacggcggaactttatcgaagaaaacgcaacgttcgttgaaaacttggacttgtaaactgactaattacgaaatggaggaatcactgtggctgaacaagacttgccaagtcgcattaccgatgtcaatttaagcaaacaaatgcggacatcatttttggactacgccatgagtgtcatcgtttcacgggcgttgcctgacgtgcgtgatggcctaaagccggtgcaccgccggattttatacgggatgaacgaattaggtgtgacacctgaaaagccgtacaagaagtctgccagaattgtgggggacgtcatggggaagtttcatccccatggggattctgccatctatgaatcaatggtgcggatggcgcaggactttagttaccgctacatgcttgttgatggtcacggaaactttggctctgtcgatggtgacggtgccgctgccatgcggtacaccgaagcccggatgagtaagatcgcggttgaaatgttgcgcgatatcaacaaggataccgttgattttacggataactacgatggtaccgaaaaagaaccgagcgttttacctgcccgattcccgaacctgcttgtcaacggggcgtcaggaattgcggtcggaatggcaaccagtattcccacccacaacctagctgaagtgattagcgggatccatattttgatggataatccagaagcgacaacggccgatttgatggaggccattcccggccccgatttcccaactggcggcattgtccttggtaagtcagggattcggaaggcttatgaaactggtcgaggatcaatcatcgtccgcgcaaaagtggatattgaggaattgaagaacggcaagcaacggattgtcgcaaccgaaattccttacatggtcaacaaggctaagttaatcgaacgaattgcagaattggcgcgtgataagcggatcgaaggcattaccgacgttaatgatgaatccgatcgtgatgggatgcgaatcgtcatcgacgttcggcgtgatgccagtgccgaagtgatcttgaataacctgtacaagatgacgctgatgcagacatcgtttggttttaacatgctggcgatcgtcaacggaacgccacgcgtattgagtctgaaggaaattctgcagtactaccttgaacaccaagaaaaggttgtgcggcgacggactgagtttgacttaaagaaggcccaagcacgggcccatatcttggaagggttacggattgccttggatcacattgatgcgatcatcagtattatccgtaattcccagacgagtgaaattgcaaagaaccagttgatcgaaaactacggtctttctgatcgtcaggctcaagcaattttggatatgcggttggtccggctgaccggtttggaacgtgaaaagattgaaaatgaataccagggattgatgaattcaatcgctgattacaaggatatcttggcgcacaccgaacgaattcaccaaatcatttacgatgaattactcgaaattcaaaataaatttggtgacgaacggcggaccgagctacaagtcggagatgtgacaagcattgaagacgaagacctgatcgaagaagaagacgtgattgtttcactgacccataatggctacatcaaacggttgcctgtcgatgaatttaagacgcaacaccgtggtggtcgtggtgtgcaggggatgggtgttcatgatgatgacttcattgaacaaatgatttcaacttccacccatgatcgtctactcttcttcaccaatgccggtaaggtttactcgatgaagggctacgaagttcccgaatacgggcggacggccaaggggatcccagtaattaacttgctgggcgtggattcgaaggaaaagatttcggcggttattaacgtgcaacacgacgtgaattacgacgacaagtatctcttcttcaccacgcttcacggaaccgttaagcgaacggccgtcagtgaattcacaaatattcggagcaacggtctcaaggccgttacactgaaggatgatgatcagctgattggggtttcaattgtcgatgaagatcagaacatgattatcgggacccacttggggtatgccgttagtttcaaagcagccgatgtccgttcgatgggccgttcagcttctggagtacggggaattcgtctgcgtgataatgattatgttatcggtgttgacttactgaatgctgatagtaaggtctttgtcattagcgaacatggttttggtaagcaaacagcggctgccgagtacccaattaagggccgtggtggtaaaggaatcaagacggttaatgtgaccgaaaagaatggaccactagttggtttaaccaccgttgatggtgacgaagacatcatgttggttactaaccggggcgttatcattcgctttggcattgagacggtgtcccagactggtcgtgccactgttggggttcatctaattaagatggatgaccaaacaaaggttgcaacgatggcgaaggtggacaaggaggccgaggcagatgaagaaactgatcaatctgctgacactgacacgcccgcaccggtaacggacacgccatccgctgataaaccacaagaataagcgacttaatttcgcattaataaaaaataagtcaaatcctaaattgcgtatttataatgtgtatcgcaatttaggatttttttatttgtttgttttgattgttttattgaaaagggcatgctataattttaagctgtgagtatacgtaaaaggtgtgctctccttgctcttttcaattgggaaaaagggccaaagtccataaggaggtgtaacagttaatggaaccaacaaaatatgaaatcacatacatcattcgtcccgacctcgacgaagctgctaagactgctttagtagaacgttttgataagatcgtatctgacaatggtgctaccatcgttgattcaaaagactggtcgactcgtcgttttgcatacgaaatcggtaactacaatgaaggtacttaccatatcatcaatgcaactgctaacgacgacgcagctttaaacgaatttgatcgtttagctaagatcagtgacgacattcttcgtcacatgatcatcaagcgcgaagactaattttttgaaattacttgtcagaagggagttttagtctatgattaatcgtacaattcttgttggacgtttaactagggatcctgagttgcgatacacaactagtggagctgcagttgcgacattttcgttagccgtcaatcgccagtttactaatcagcagggcgaacgcgaagctgattttatcaactgtgtgatttggcgtaaggcagctgaaaatttcagtaacttcactcataaagggtctttggttgggattgatggtcgtattcagaccagaaattatgaaaaccaacagggacaacgggtctatgtgactgaagtggttgtcgagaacttctcgttactcgaaccacggtcacataatcaaaaccaaggcggttcataccagaaccaaaacgctggtgcgcctagctttgataacaatcagacgactcctcaaaactcatcaatgaataataatccatttggttcacctgctgcatcagccggcaataataatgcgggtaacagtgcctcaagtgcaaatgatccatttgcaagcaatggcgaatcaattgatatttccgatgatgacttaccgttctaatctctaaacgaggagggaaatacaatggctcaacaaagaagaggcggacgtcgtcgccgtaaggttgacttcatcgctgctaaccatatcgaatacatcgattataaagacactgatttattgaagcggttcatctcagaacgcggcaagattttgccacgtcgagtaactggtacgagtgccaagaaccaacgtcgtttgacaattgcgatcaaacgcgcacggatcatgggtcttctaccattcgttgctgaagactaatcagtaaaaaacgagtctggcttttgccaggctcgttttttgtatcaactgttctttttttcgagaatcatatattattggattgctgactaaacacgttctgtggtgcgtggcaatcaagtaccctatggcccacgagattcaagtaggaatcatctatgtggtgagcagaagtgtgataaaatacaggtatatgtaaaaaaatagggagtagcaaaatgaaattatttgaacgcgaaaatttaccttttttctttcgtaattcgcgtgtaagttggattgcgctatttttatttgtggtctcggccgcgggaatcatttttgcattcatcaccaatgttattttgggcgtgattgtgctaattttgattgctttcggactgtattttgtgatggtcgccttacaacggctggtgctagataccaatcagtacctaactgacttggcttatcacatcaagcgcgggcaacaagaggcctttttgcagatgccaattggaatgattattttcaatgagcagcgtgaagttgaatgggtgaatccatatatggtgaagtattttgatcagcaagaggtcattgggaaggcccttgatgagatcgatgaacacctcgctaaaaaggtcgatgaaaatagtgatcaggatacgccggtaaccattaaatgggggaatcggcggtttacgatgctggtacagccagctttgcacacgatttacttgatggaaattaccaagtatgccaagattgacgaacggtatcaaaatgaaaaggtggttattggcaatatctacctcgataattacgctgaagtaacccaaggcatgaatgactcggaggaatccaatctccgcaactatgtcacgtctgagctcaacgactgggcgcacaagtacggggtcttcatgaaggttattgatactgatgattacctgattttggggcatcagcaaacgttgcgtcaaattgaagccgataaattcagcattctggatacgattcgggaaaatacgtcgaaacaaaatgcgcctgtcacgctgagtgtgggggttgcctacggggacgatgatctcaacaagcttgccgatctcgcgcaaagtaaccttgatttagcgcttggtcggggtggtgatcaggtcgttgtgaaggccgacgggcaacaagctcggttctacggtggtaagacgaatccaatggagaaacggacgcgggttcgagcccggatgattagtcaggcactgcaagaattgatgtcggaatccgatcagatctttgtccaaggccatcggggaccggacatggattcactgggagcctgtctcgggattcggcggattgcgaaaatgaacggccgtgagtgctggattgtgctcgacgacgaccacattcattctgacattaagcgcctaatgcatgaaattgatggctatcaagatattaaggatcacattattacgattcgtgaggccgaagaaaaggccaccgatcaaagcttgctgatcatggtggaccactcgaagccaagcatgtcgatgtctgaacaggtctttaatcgcctacaaaatcgggtgatgatcattgaccatcaccggcggggggaagaattccctgaaaatccaattctggtttacattgaaccgtatgcttcttccacgtgtgagttgattaccgaaatgttggaatatcaaccacgtgaaagtgagtcgctcaataagctggaagccacggccatgttgacggggattcaggtcgatacgaagtcgtttacgtcccgtgctggaacgcgaacgttcgatgccgcaagctacctgcgttcagcgggagcagatggaatgttgatccaagaatttatgaaggaaaatgtgtcaagttacctagatcgtaaccacttaatttccctcgtgcaaattctggatgacaagattgcgatctgtaccggtgaggatacgcagtcgtatggatcagtaaccaccgctcaggccgcggattcattactccaaatggaggggatcgatgcctcgtttgtcattacccgccgttccgacgatcaggtcggtatttctgcgcggtcgatgggtgattacaacgtgcaggtaatcatggagaagatgggtggcgggggtcacctatcgaatgctgcaacccaaattagtgggaagcaggtctccgaagtagagcaggaattggttgccattttacatggtgatgatgaatcagaagaaaatgaagaggagtgaccaacatgaaggttatttttttagaagatgttaaaggacgcggtaagcgcggtgaagttaaagaggtaccagatggttacgcacaaaatttcctaatcaaaaaaggaaaggccaaggaagctactaaatcagcaatgagtgccttgaagggccaacaacacgccgaagaaaagaaacaggcggaacttttggctgacgcccaagaactcaagaagttgctggaagctgatgaaacggtgattgaaatcaaggccaaggctgggacggatagccgtctgttcggttcgatcccaagcaaacaaattgcacaggcgttgaatagccagtacaatgtcaagttggataagcgcaagatcgagcttaacgaaccgatcaaagtgctaggttacacgaacgtccccgtcaagctttacccacaggtaagtgctaagattcgggtgcatgtcgtcgaaaagtagtgtctcacaagggtgtaaaaggacgaaaccaatatgaacaatgatgttttaggggaccaaacgccgccacaaaacgtcgaagccgaaaaagcagttcttggagctgtttttttgagcggggacgctttagtggaatcgatggagtacgtcggtccagatgatttttaccggcgggctcaccagatcatttttgaaaaaatgatggcgattaacgatcaggataaaccgattgatccgttaaccatggccgaagaattgaataaaacaaatcagcttgatgatattggtggaatcagctacattgcagagttagcctctgcggtgccgacggccgccaatgtggtctactatgctaaaatcgtgcatgaaaagtctgttacccggcgcttgattaagaccgccacggaaatcgttaccaagagttacgcgggcgacgaggacgtgagcgacttgctggatgaggctgagcgctcgattttgaacgtttccgaggatcaaaaccaagaagggtttaaggatatcaaagatgtcttgaagggcaccttcgaggaaattgatcgtttatcgcaacaggagtcaaccgtaactggtctttcaacggggtatccggaactcgataagatgacgaccggactacattccgatgaacttgtcatcttagcggcccgaccggccgttgggaagacggcgtttgcgctgaatattgcccaaaatgtcgggacaaagaccgataaaaccgtggcactgtttagtttggaaatgagtgcggagtcgctggttaaccggatgctgtgcgcggaaggcagtatcaatgccaaccaccttcgaaccggacaactagacgaagaagagtggcgaaacctcgttgttgcgatggggagcctgtctaaaaccagcatctttattgacgatacggccggaattaaggtcgctgaaattcgagctaaatgtcggcggttggccaaagaaaaagggaatttagggctcatcgtgatcgattatttgcaactgatcgaaggtacgaaccacgaaaaccggcaacaggaagtgtctgaaatttcgcggcaactgaaaaagctcgccaaagaactgagctgtccggttattgcactatcgcaactttcccgtggtgtggaacaacggcaagataaacggcctgttctatccgatattcgtgaatcgggatcaattgaacaagacgccgatatcgttgcatttttataccgtgacgattattatgaacgagataatgatgacgaggatagcccacaagatccccgcgataatgaggatgaaaatgtcggtgaagttgaagttatcattgaaaagaaccggagtggtccacgggggaccgttaaactgctctttgtgaaatcgtataataaattttcttcgattgcctacacgcaagagggatagacacttaatctgggaccaagacggtgaccgtcgttggtctcttatttttttaagtcgattgggtaccgttagcaaggagagataacgtgaaacaaacactgaaactaaaatggctcatcgtgggcgccttcctgagcagtattgggaccagctttatttggcccctcacgacgatttatttgcataatgagttacaccgctcactgacggtgattggagtggtgctcctgctatattctggcacgaacgtggtgggtagttacctcggagggattttatttgatcgttttaatccgcagtggttaatccttgctggcctcctagtagatatcgctgcgatggttgcgctagtgtttcatagcggttggccgcagtacccggcgctactggcagtcattggattctttaacggttggctgacaacccttgtaaattcgatggggacgctgattcgtaataaagatgggcgctacatctttaatatgctctactttgcggtaaacctgggaattgtgctcggtacgtcggtggtggggtttatgtatcacggaagcgtggccccgatgttcatggttacggcaagcttatatgtggtctttttggtgattgtggtgcgattttaccgaattaaacgggaaaagggacaccaaaagcagcaacaggcggcccaacgtgtgcggatcaagccagccaacctcaagattatgtggacgttttttatttcgctaaccattatttgggtaatgtacgaacaatgggtcagcaatatgtcggtctacattaccgatcaggggatttcaatgccgctgtatagcatgttatggacgattaacgcgagtttaattgtggtcatgcaactctttatgagctgggccaatcaacgcattaaaaacgtttatttgcccgtttacgtcggggccttattttgcggcgcttcgttcattattttaatctgggcgcaccagtattggatgtttttggtggcgatgattatcctgacggtgggggaagcaaccgcctttccggcaatcccagcgatcgtcaatgatctatctccgatggcggtgaaagggaagtaccaagggctgaccaatgccttctcgtcggcaggtaaggcgctcggaccgttatttggcggtttaattattgaaaatgcctcctaccggatgttgtttgttgtctgtgccatcgcaatttttatggtcacggcgatcatttacgcaattgtgcaagtgtaccggcaacgagttgaatattatagatagcaaaagcgtgtcatgaaatttattgtgaatttcgtggcacgcttttattcgtgattagcatggttcataatttcaagaatttgagtatcaaccgcctgccactgctcgcacagcttcagggcgttgaaataggattgtcgttgagtctcagcctcaggcccgcattcgggggctaaggtgctgatgtgttgccaaataacggggatgtagtcgccagccgtgtcaaaatgaccgaattcggctagctcttcttgcatgtagcgttggagcgcctgatgaatcagcctcgcgcgggagagggtaatcggaatttcaaaggtttggttgtactcgttgaagtgcttgatgaatcggttaacgctgataaacggaatatctaggtaacggctaatttctttggcggttttaccaccaaagtacaggtctaaaatgcgtaatttaactaagggttcaatagtagcggacttttgtttccccacggagctcacatcctcgatttggtacctgaagcaactgattagatattagtaagtataacgccaccacacaaattgaggggtaaaaacgccttatcaatttgagcgcaaaaaagccccccgaggtgatggctcggaggaccctcaattagaactagtcaaacaaatgcgcattggagagcgctaaatatttgctagcaagaacatcataaacgaaatgggagttggtggcaattattaaggcttctatccgatgaaaaacgataatttacattggtattggctgtaaaatggccggtgttagttacggatagcggtccaaagaggagaataatcgggatcaggaagtagtttttgagcgtaatatctggaaatcaacaccgaaaataatgataatgtgattatcaggattgtagcaacgaaaggaagaacgcaaagatgacatggataagtaattttttagtgctcgtagtagcggcagaggcgctctttattatggtacttgaactgtttttaacgcagacaaagcttgctcggcaagcctttgcgctttcaaaaaaatatctggttcaaaaagaggcgcaagtcagcatggcaaatcagggcctctataatgggtttattggcgttgggattttgatggtgcagtttgtatttccagcaaatgctcgcttaatgggcctctacttgtttatcggctttgtggttgtggcggcaattttcggcgcactgacggccaacaaaaagattattgtgacacaggggttgccagcatttctggcgctagtggccctgtggttgactaattagatcggctagttggcccccgcttcaattaatttggtatagacactatgttatgcatagaggtgaaactgataattgtaaatcaggtgctactatcaagtataagtaatgagacataatcaaaggataagtgtagaaaaaggcccgccagtatggaaactactagtagggctctttggcggtaatgcacatataattggctacgtatttggcttacttttccgcctctaaggatgaaaagtggctctagctcatgaaatagaaatattcaaaaaaacctgcaaccacggcgattgaacgcttcgtgattacaggttaatgttgattgatgggcagtcaggggatcgaaccctggacccgataaaccgtgatatagcagtttttatgatcattagtgatcgtttttgagtagattggctacgtatttggctacgtttgctattaaattaccgttgtgaggggtcaaaagttgagataactagcaagcttgataacagcttctttattttgatctttggtaacatgagtgtaaatatttaacgttgtttgagcgtcttgatgacccaagcggtcttgaacctctttgatggatgcacctccggcaaacaaggcggaagcgtgtgtgtgtcggaacccatgcacagtgataggttttagactagttccatcaattagtgcatgtaaccacttagagggacagttaagaactttatgacggttataacgattggcaaacatcagttgatcattattaatcgtgttaattccaagtttaaggtatcgttgctgttgaattaatcgccagtgttttaggatattcatcgtccttgaatcgaggataatctttctacggcttttatgcgtctttgggggttgaacgatctgctttcccttccgtccttgagtgagtgttcgctgaatacttacagtgcattcagttgtatttaggtcactccattttagagcaagaatttctccgcggcgtaagccaccgaatgctagcaatctaaacaatgcatattgttcaggttgtttttctttatcaatgagattgaagaacgtttcaagttcctgcttactccaaaagttctcaggcttatcatcgaaatcatcgtgctttttgggcattacgatcatcctagcggggttaggctcccatcggttgatatatccacgacgttttccaaagtcgagtactgatgcagtgtagttataccaacgcttatagttataggtggtctgtttataccacttgtttactgctttctgtatttgatctgcagtgatcgtacgaattcgtttgttgccaaactcaggtagaatatgattatcgaacattccctcagtacgagcaaaggtactttcacgcaccgtatgaatgtattgaacataccattctttgtatacctcgctaaaggggatattattggctttttcaggatgttcagagcgagttaactggagtcttaacttagatagagctatattggcttctttcttagtcttgaagccacgtcgccgtgtacgttcctgttttcctgtttgtgaattagtacccgtgtaaagctgaaattcataacgtttttgtccgttactggtttgataacccttaatatttaccatggtatattctcctttatcaataatagtttccgctaaaagcgtgcttaatgaaactatttatgaacgagaactttaatcattaggagacaatgatttaagttcattgaatgcacgagaatatacatcaagtaatttatcagcgcggtttcgttcagtagtattactgataggtagaccggctttataagaaactatcctgagaatttcagtctgtaaaaaattcacactagagcctaaaaggtttgaaggatcatcgttgctaatggatttatcagcaatttttcgagcatgggattcaattgcaaagagactggcgtttgcgtcaagtcgaggatcattataatcaccgtctctaactagtttaacagctatgcttgctagcttcttagcacggtccattgagtcgtcgatatacggttcattttcaagaatttcctccagaaagtactggtagagaaatttatcgagtggaccataagtgaaatcagccatgctttctccagataatgcaacaagttgacttaaatttctaatgttcggtgaactttttccgtgttcccaaccataaacaaggcctttactgactggcggagtgagttgctgtccaaactgttctaaagtcatccctagtttcaagcgtagttccttgatgtttaaactaagagtatctttgttcttgtttagattcttgtgcaccgtagatgccaagttatcaccttctttctattcgtttaagttgtaagatggattcttacttgcattaatattacaatagctttacaataattgcaataagttagaacaaattagaacttattatagaatattttaattacgtcaaaggagataatctgaatgaaacgtgaaagtaatggctaccagagcttgattgtgttatcagagaatttgtcagaacatatgaaatcgacggatgaccgtgattcaccggcagataaagtagagaaagcaatggatattagggaagcaggtttaggaagcgaggttcaaagtgagtatatgaacctgaaggagtcagctaagtacataggagtgtcctttaatacactgaagaagcttattagagaggaaggacttagtgtgatcatggtaggtgggttaaagcgcatgagtaaaaaggacattgatgcgtttatggatgttcataaggtttaatagacaaacgtaattctattaccccttacaagaagtatgtattatttaagcttttaaagttcttgtagggggcaatagaaaggacgttgaaaggagcctaataatgactgatgacttagtagtgagtctaggaacttacagtgtttcaaagaaaccagttaaagaggataagacaacctttgctatcattagatcggatttaaaagatagtacgcgtaaggtgccggtaagtgaatttgttcaagcactaactcaaccaaacgggaaagccttttgtaaccccttaaacggccaagggaccggtaaacggaacgttcagtacattagcatcattggattggattttgacaataaagagcaagatccaaacttgcttaatagaattttagcgtgtgaattcactaaaagcaatgcactgatggtatacgagaccttaagtagtaccaaagaactaccaagggtccgtgtactgtttatggttcagggaggtagaattgaaaaacagcgctttagcagttatatcgatgtgcttgaaaaaatttaccatgagttcatcttggataaacattccgaagaaccatcaaggctttttctaccaagcaagaatacttttgaagagttaccttactgtaacttttccaatcgtgttgactttgatgaggctaggactcaacagcgtttacaaactcatactagtaaagtagttaatgcggctaaccagcgcgatcaagatgatgttcatgatcaagaatgctatcccattgcaaataacgtcatgcaacaggtcttgatcgatcgagatgttgaaaagctgaaggtcttgtggcaagaaaatgatgttattcagggagtacccaaggctgattggagtcatttggatctgatggacaagcttcaaatattgaacttaaagtacttgttaggcttatttgtaagggacggtgaaccgatacaggactgtttaggatcatccccaaaggatgtagatacacagcctagtgccgctataatacgctctgaaaaggatcggcggtggctgtattactcattcagattgaatcggacttttaattcagcacagctactgatgatactaggtggttttcatcaggtgcagacattagaaacatttttgaatagaattacgggattcaacttcaactatcaggaaagctattttgaacatttagacaagtatgaggagacagtaaagagctttgaaggtgatgcgggcccatatgggaaggttattaggcttttggaacggcacaacataggtacattacttagactactacttgaatatgctagaaagtatgcgcccaaaagcccaattgcaacgaccggagggggaatctctttctttttaggagctaataagctgttgaatgagctaaccgatcggaatgttcgagggctccgtagttctacaagtgtgaagactaaacttaacttgttagttgaattggggctaattgaaaaggtgcctgagaaagaacttaaattgagcatagtaaagaagcttaaggataataatcaaacgaatcatggtattgctatcagattgcctgatgatcttgaacggaatgtgttgattggttggtgtcgttacaatggaaaacggcataatagtagcaatgggataaatagttataacgtcgattcagcactaactaaccaaattgcttctcagggaaccgataaatacatactgacgcttgctatgaagagggcatatgcatgtttgttatttataggtgaggttaaattcgctagttcgcctgagttggggagaatgctattttatttcaataagggaattgatcatgaattgcccacgaagaatcagctgaagaagtcgattgaattattgaacaaactagatacgtggttatcagggttagagacaagtacagctactaatgaatttaaacagactgtgaagaaagtgtacggtattgatcttaattatcatccgaggacgatggtttattgcgtaccttttcgaggagactatcagcaactagaagaacatgaacttcaaagaaagtggagcatacagaactgtgagaaaggcttatctgacgacgtattaaacgacgtgaggaagtttattcaggaatactgtgaaaattattaacccctacccaggtgctaaacccctacgcgtagctgagatgaggcagattggtgttcctattactaggggttcacttggaaggctgataaaagagaagggacatctgttgaagttgtgtgaaacggtacatttaggcggtattaagtcgtttcatcagggtacctatgctaaaatcctaaaatagtcagtcccatagaaacgctaatagaatagcctaaaaaggcacaatactggcttaatcagcggtattgtgcctttgtttttaatacgaattgggtcaatttatgcatcaacaagtgttacctatttgtagtctccatcgaacttgtttggatcataactcttctcaagagctttattctttgcttcaaggtatgcaatcttattgagatcaatttgaagaaaatctgctagcacccacaggttgattaacggaatgacagtagcaccgttttcataccttgagatcatgctagaactgatggttacatcgtatttattcgccaatgcgtcagatacatctcgcatcgtcagatgtttgtttagccgtttgcttttcaattccaaagcgaatgatattgccattttcaataacctctctgtctaattagtcccgttgagatagattataccttgaaaatatggcaaattcgccatatttgtggcttaaggattgaaaaagtggcgaatatgtattatgatccatttatggaacaacgacgagtaagggggtggcgaaaatggcaatgaatagctattctaaaggaaacttaaagttgctgggttatttaagagagcatcaaatcaagcaagatagactagctttgattttaaatcggaatttgacgacgataaaccgaaagctaaacggatatagtgaattcactgtcagcgaagttaagatcatccacgatgagttaggtattccatacgaggtactaattaattagttccattaatggaataatcggaggggcttgaatgaacagattagaaaacgtcgcttttaagcatttaagcattaacgaaacttacaattaaggcactttacgtgtgtaaggtgcttttgctagttatatgggaattaataatgatatcggaggaataatttatgggaccaaagtattgcccaaaatgcggtgcacttaatagaggtgacgcacaattttgtaataagtgtggtgcgcaattggtaatgagtaccacggctagtaaatctaccagtgagcaactagaaagaccaaagaagacaacgtctaatcgatccattatattgctagtatttgggtggataagtgcggctgtagcactattctttgtgccattaatctttggtggtattggaatagcgcttggctttgcagagcgtagggtaaatcgaacacaagggactattctaattgttgcttctattatctgtggaatagctggaataattgttggcgcaatcgttggatcacagggtggaatttaaggaaaaggggaagatgatgaagtattgtccgtactgcggtactgaaaatgaagacagtgcccaattttgtgtgaaatgtggtaaaccctttgaagatggttcccctgtaaacgaagcgaatggcgagaatacagataaagaaaatcctaatgattttaatgatgatatcagcgatgacggtggaagtatcagtattgctaaggtagtggtgatcatcttagggtgcatattaatcattgtgggactattcattggtggacacagattttatatgaatcatagatcagatcaagcgactgcaaacattgcacagaccattgcgaatgaagattttggggatgatgaggttcaagtctattattcgaaaagtgataatacgcttaccattaaaacggagtcagactcgaagatacgcaagaatcttaaagaatatgttatttatggcgataatcaggatgatatgaatgatgttattagtcagtataaggacttcattaacgatatgtacgatcatatgggtacgaaatacaagaaatactatacgtgcatagagaatccctggaataacgataaagtatatattgacagtcgaggaactaaagttgattttgatggattagatgattaacaagctcgaaggggcgcgatagaatgaaatttactagagaacaatacaagcaactaaaagccttagacgggcaacacattgacgagctggatgacttgccatatctcacgggctttacttttacaagtcaggaagatactaacagtgctctaacgtggtttcgctatagctctttcaattatgagggcctatcaaatgccatctttaaattgaaccccgtacgggtagaagtggaaggctttaagtttccacttaagccagccactgaaagggaacagacccgggtgttaactaaagaactaccagaagcaaccagcaacggccattatcagcgcttgcatgctacgctaagggactaccaacgggaactatcagcagatcggattgagaaccgcgttccagaagttacagcgcctcaagtggatactgatgattacttctttgactttgttggtgggtactttattgctagttcacagcgaaatagctagataactttaaattggaggataagggcatggataaggttgaatacaagttatgtccaaaatgtggaaccgaaagtggtggggatgccagcttttgcattaaatgtggattcaatttagagcatgaaccagttaaaattcacgttgaaaatggactgtattttaaacgagatgaggatagtaaggtaatgacctttgatcgggtaccggctaactttaccgctgtaggtcctgtatttggtcgagtcacattcaataatcgaataaacgaggactacagcttgcatttggaagctttgatgaacaaacttcaggaggtaattaatacaaacgatcttgacggtgtcgcaaatattaaggtagaagctttcaatactgttgtaagtgatgttgtgagtgttacgatgattgcgagtggggacggaattaaggttaggaggtaacgaatgggtgatcagatcaagtgcccaaaatgcggtacattaaacaatgctgatgcatcattttgcgtccattgtggcaataagttggagaatgtaactaatgattctcataggcctggggatgggcatagacggtcgcataaagtcttgtggactatagtggctatagcttgcgcacttctaattgtgggcggtggtgcatttgcttggaagatgcaccaacagcaagcaaatgataagacacccaataaagtagtaccaacggtgaaaacggtgagctacgagaaactatcgagcacggatcgcaaaaaggtgcactttacgtttaaggccaaaagggcgactgattcaaaggctgaaacagcattcaataatggtggaggaattctctataacatcaacgtgcagatcaagaataacaccgataagaatataagctttgacgaaagccaatttaagcttcatgggttagatgaatcgcaaaacgctaacagcaagttatcggacggcgttaccattaagaccaatacgtcaaaaacaattgaaactatgtttaagcatgtaggtgatcaacaagtagtaccgggctacgcttactttgaatatctcgggaagtacaagttggcatatatagacagtaaattaacggccagtggctctaaatcagataatgtggacaaccagaagttaattgacacttttaatggaagtagttcagatgatgcttcaagcagtagtgaaagtacgactactagcaccaatgatgaaacaacagacagtacaagtagtgactttacgattatagatacccaaagttccggtcaaacagtgacatcagctgatgatgcggtgaatgtcgcaaaaaatttctatgatagtgatgacattatggaatggaagctagatagtagcctacaaagttcgtgtaatggtgaactcaatggtcaacaaggctactatgtatggggtgttggtgaagtgaaagataacgatgttcaagttttcgtcactaatagcggcgttgcagaagaaattacaccataaactaaaagctaatcaaggaagtattccatgcggggatgcttccttttatttggcataaataaaaagggccctcctagtatggaggcccttttagcacgcttttaggcagaaattttggctacgtaattggctacgttttactgaaatactatgaagttatatgacatttgaagatataaaaaaacccgcaaccacggtggtttgacactgcgtgatcacgagttaatgttgattgatgggcagtcaggggatcgaaccctggacccacggattaagagtccgttgctctgccagctgagctaactgcccatgtcatatcttatcgactagaatatagtagcatgttagacagtcatcggtcaacactatttttgaaaaaagttttaaaatgagagaattctaatataaacgagtttggcagcccatgattcaaaggtgacatgtggtataatgaaactacttgtgaagagctgaagaaaatgaattgattgatttcaaaaaaattagtgaattaattgtggaggaacctagccgatgaagaaagttttagtagttgatgatgaaaaaccgatttctgatattatcaaattcaaccttgctaaggaagggtttgacgtcgtcgtcgcgtacgatggtgaagaagcccttgaaaaggttgaaagtgaaaacccagatttaatcgttctagatttaatgctaccaaaaattgatggccttgaagtggccaaacgtgtgcgggctaatcacactacaccaattattatggtaactgctaaggattccgagttagataaagtccttggtcttgaattaggggccgatgattatgtaactaagccattctcaaaccgcgaactggtggcacgagtaaaggccaacttgcgacggcaagagaccgttgaatcagcagaacctgatgaaaatgcggatattacggttggtgatttgacgattcatccggaagcgtacaccgtttccaaacggggtgagaatatcgaattaacccaccgtgaatttgaattgcttcactatctagcccagcatatcgggcaggttatgacgcgtgaacatttattacaaactgtatggggctacgactactttggtgacgttcgaaccgtggatgttaccgtccgtcgtctccgtgaaaagattgaggataaccccagtcacccaacttggttgatcacacggcgtggggtgggttattacttgaataatcctgaaaatgattaggagtaccacgaaccttgaatagcaagattaaattttttcaatcgatccactttaaaatcgccctcgtctttgcgttaatgcttattttaacgctggaagtcgttggggcggtttttgtgcgttcattggagcggcaaaacctgagtacctttaaacagcagattgaattaccgtcatatgtcgataattcattatcagaacagttaatgaagagtagcaccaaatcagccaacaaagaaattcaacagattttgtcggacgttaataatacgaacatcactgaaattcgggttgtcgacagtaaagggattattcggggaacgagtaatgtaaataatcaatcgattgttggcgaaaaaacaacggatgagaacgttaaaaatgcgatttacaataaccgttcgtataatcaaaatgtgtatgacgattcaaacaataatcgatactacgtttccgttgtcccattgttaaatacctcgagtagcaataataacgttgttggggtgctctatattcgggccaatcttgagagcgtctacgccaatattaataacattaccgtgattttcctatcggcgtcgttagtggcgattattttaggactcttgatggcaattgttatttcccgggcaataacgcggccaattgatgaaatgaaaaagcagaccatccgcatcgcacggggagatttctctgggcaggttcatgtgtatggaaatgacgagttgggccaactggctggcgcggtcaataacctctcggtgcgggttgaagaagcccaagactcgacagaggctgaacgtcggcggctagacggagttttgacacacatgtcagatggggtgttagccactgaccggcgcggaaacgtgacgattatcaatgaaacagcggccgatttattatcgacgaatgccgatgaagtcacgggtaagtcaattttggacgtgcttaatattcgtaagagttacacaattcgtgaattacttgataatcaggatgaagttattattgacctatcaacgcagcaacaggaactgattttacatgcttatttctcactgattcaacgagaatctggatttattagcggtttagtgtgtgtgctacacgacattactgaacaacaaaaagtggagcgcgagcgcaaacaatttgtttccaatgtgtcgcacgagttacggacgccgctgaccagcgttaagagttatgtggaagctttgacggacggtgcttggcaagatccagaggtcgcgccgggcttcttacacgtggtgcaagatgaaaccgaccggatgattcggatgattaatgatcttctcagcctgtcacgaatggattctgggacgtcaaagcttgatttggagtacgtaaacctcaatgaactcttcaactatattttgaaccgttttgatatgatcttgaaaaatgaggaagagcctagcaaaaagtactcaatcgatcgcgttttcacgaaaaaggatctttgggttgaaatcgataccgataaatttacacaggtggtcgataacctcatgaataatgccgtgaagtattcgcctgatggtggtgtgattacggcccgattacttgaaacacataatcatgtgattttgagtatttctgatcagggcttgggaattccacgggcagatattccacacgtctttgatcggttcttccgagtcgataaggcgcggtctcgtaagcaaggcggaacggggcttggcctagcgatctccaaggaagtcattaacttcttaggggggcagatttgggtcgatagtgttgaaggccgcggttcgaccttctatatttcgctaccatatgtaccgtatgaaggagatgaatgggacgatgattcggaaaattcgtaataactggctaccgatcgttttaacgatcgcggtcttggtcagtctcggactttccgggttgatctggaccaatccatcacgctatgatcgtggacatgaggcaagtacgtctagtggacaaagtcaattatccaacaagacgattgcggacgtctttttgcctaaccaggcggtgtggacaaacaaaaagggcgatcaaaaattattgtataccaagaagagtagtctgacgaaagccatcaagaccaaggtaagtggctggaatttcggccacatctctaaggttgccagcaaagataaccaaagctatctcggctacctgaatcaacgagatgccctagtcttgaactacccagatagtgtcacgacggcgatctttaatgagaccttcaagcaatccctcaatcaaaagaaaattagtaaaatcgaccgaattgtcattccgcttgaaaatgcgcggcatatctacttgctccatgatagtgatgcatcggtgtactccgtaacggtcaaaaatcacagtagcctcgaaaatattcggaaattgatgcaagaagatgcggatcaggttcaggtgagtgaacaattcttgaacaatcgaatcatcttggcgtttgataaccaaacgacactgccgatttacagctacttgatgacgaaacaaagtgatagcagctttacaaattcgctattgaattcagatagttcgtataatattgcggttcacaaaaaggatcacattacgacctacacggatggcacggataagcgaatgacgattaacagtaagaacggcaaggccgcttacgaggactttcttgatgaaaatgaccgggttgccgatagtcagttactgactaagagtttccagcaattatcagaaattggggtcaatttagaaagtatgcactacgacaatattaacctggcaaagaatcgggttacttatcgcacgtacgtcgaatgcttccccattttcaatcaggatggctatggaactgtatcgctcacgtacgcgaaaaatggtaagcaaacttataatttctcattgtatggactagaagtgccggttccaaacagtgccactcaaagtgttccggcgactaaggatgtgattgcatccctcaaccgggtgggaatcaagacgaaggatattagtgatatgcggattgaatatgaatggaattcaacgcgtaaatcgaataccgtggtgaatttgaagcccgcgtactacgtcaagtacaacggtaaatggcaaaattatcaggatttaattaaccgctaaattttaacgaaaagggggcctaaatcatgaactttcggcggattcaatggatttttttggtggcgtttatcgccattgatatctttttaggagtatcgttagcgtcggacaagccgtttacggtcaccaataaatcggcaagtcaggaagaaacgattcttaaggaaatgaatgatgattcgatttcaattggaacgttgtcgaccaagcacgcgtcgggatattacatcgccagttcgggaagtggtatcttgcagacgaaaatgtcacagttgaagaaccaaacgacgagctacagcgatggcgaactcaatagtacgttcaactcgacgattaaaattgatccgaagaatccacaaaaggtcctcgataaagtggtgaaaaatcaaaatcgcgtcctgtttgggacccactacgtttatgatgaacggttaagtgccgaaaaggataattcggtggtttatgtccaaaagggccctgatttacacgtcttgtctgatgatggtcaattgcgttttaaggttcgtaaccataatttggtcacgggatacacgcagacctacttgaacgggattcaaacattgcgtgaagaggagacgaccattagccagaagaaggcggttatttggttgtaccagcataatgagattcccaataactctaagattaagtgggctaagctcgggtacgtcaaattgctttcagctaaggggagcaacgtctacattccaacgtgggtgattggcattcagaccaagaacacagagggaactcaaattcgccagattaacgcctttacgggaacgttaattaaggcgaactcgaacttgttgaatgaatcttcggctaaataacataacaagaggtaacagatttgcagatgatagatgatcaattacactatagtattttagcgagtggcagtaccggcaacgtcacctacttggaaacgccggaacataagattttaatcgatgccggtctaagtgggaaaaaaattagtggtctcatggctaaaattggtcgggacttaagcgatgttgatgcgttatttgtcacgcatgaacacagtgaccatattcaaggtgtcggtgtgttggcgcgcaagtacggcatggatgtgtacgccaatgaaggtacctgggatgccatgagccgcaagattgggaaggtcgacgtgggacaaaaacatatcctggcacctggggatacattaagcatgggtgatatggacgttgaaagctttgcggtgtcacacgatgcggctgaaccccaattttatcaagttcatcacgacggcaaagcgttttgtgtgctcacggataccggctatgtgtcggaccgggttgaacaaacgattaaggatgcggatgcctacctgattgaatgtaatcacgatatggaaatgttgcgcatgggaccctatgcttgggcgctcaaacaacggattctcggtgatgagggccatttgtccaatgaggatggggctaacacgatgatgagtgtgattggtcggcaaacgaagcaaatctttctcggacaccggagtcaggaaaataacatgcggtcgttagcacatttgacggtttcaacggttctagagcagcatgattttggcgttgaacatgatttttacctacacgatacggaaccggatgaaccaacaaagttatttacgctgtaattagcgtcatactttcacaaaattttcacaaaaattttgtatgcttgtgttaatcaagtcagttgaggagggtcggcgtttagccaaacatgatggataatcaacagaaaacacctaagaagaaacgcggtttcaatttgtggtggaaggttggcgtggtggcactatttgccggattagttggtggcggtattgcctacggcgtgggatatttgatcgataacgggtatgcgacaagctcgagtaccgcagtccccaagggctctaataagtcgggaggaacaaaggtgaacgaaaacaaggtcaccggttccacccagtcaacgaaggcgttcaagtctgtaaaggcggccgttgtttcagtggttaacttgcaggcgcaatcgagtagtacgggttcgcttggcatctacggcaccaccgattcatcatcgtcgagttcatcgtcatccagtagttcactggaggcttccagtgaaggctctggtgtgatttataagaaagacggtaacacggcgtacatcgtgacgaataatcacgtggtttctgggtcgtcggccctcgaagttattttaagtaatggtaagaaactcagcgcaacgattgttgggacggattcgacgaccgacttggccgttatcaagattaactcatccgatgtcaccacgattgccagctttgggaactctaaccaaattgaagccggacaagatgtgttggcgatagggtcgccgcttggttcggaatatgcgacctctgtgacgaagggaattatttccgccaagaagcggaccgtgcaagtgcaggataatagtggaaatacaaccgctaacgcgtccgtcattcaaacggatgcagccattaaccccggtaattctggtggaccgctggtcaacatggcggggcaagttattgggattaattccatgaagctgtcgagtgatgatgatggtaccagtgtcgaggggatgggcttctcgatcccaagtaacgaggttgtcagcgtgattaaccaacttgttaagaacgggaaaatcacccgccccgccctcggaattgagctagtcagccttgataacgtctccgcagcccaacaaaaatcaattttgaagctgccaactagcgtgaataaagggatcgttgtcatgaagatcttgtcaccatcatcagccggtaacgccggactgcaaaagtacgatgtgattactgaaatggatggtacgaagattacctctgaagcgacgctaaaggatgttttgtataagcataaggttggcgattcagtttccgtgaagtactatcgagacggtcaactaaagagcgctacgattaagcttagtgaatcaacggcctcgttgagtagcgacagtagtagtgaataataatgtaaaaaatgaagcacatcgtcaaacgctggcggtgtgctttttaggtacaatggataaaatgtgcgagtctatttagatagtatgcctgatgtttctgaaggaaccggccagtatactaagactattgaatcattagtggtaggtgacagccagtgtgtgggcagcaataatggatctggatggctcaaaccactaaatgaagccaaggagcctttcggaaacgggaggctttttggcgtgaaatcggaaaaaacgaaccattgttttcaatgttcggttttaatacgatttcaatgcaaatttattgataaattgcgaacaaaagtaattggtcatattgaagaagttcaggtcagtaaaaacaagtgattggtgagaaaaatttaattgtggaaaactatgtggaaaaaatttggtatactaacacacaggtggaaaaagctgatatatcaataacaaaatccgttggaaaagttatccacaggcagggtgtgaatttgtggataagttgaaaactttaaaaagtagaacggttaaacgttgatatatcaacgtttttaattagacggcacgaacggatgttgctgtgcaaaactgtggataaaaaattatcatcaaaatcttaaaaagacaaaattcagggattttgatgatcagaattggaaaaaatacccacagcctgtggaaaactctgtggataacatgttgaaaggttgttagttatgaacatcaaaattattggcgttggaaaattaaaggaaaagtattttaaggcgggcatcgctgaatatgcaaaacgacttggtcgcttctgcaaatttcaaattattgaagtaccagatgaaaaagcaccggagtcgttgagtcaatccgaaatggatgacgtgatggcaaaagagggccagcgcattctagacaagatcaaagatcgagaatatgtctatgcgctggcgattaagggaaaggaacgctcatcagaagaattcgcgaaagaaattgcgaatttgacgacgtacgggcattctgatattacgtttgtgatcgggggctcattaggactcgcgccggaagtattaaagcgtgcggacacgcagatttcgtttggccgctttacattgccgcatcaattgatgagattggtgctgacggagcaggtttatcgggcgtttatgattaatgaggggagtccctatcataagtgatgaggttttttaggctgggagtaaaatgcaactaatggttggtagtgctgatatccagaatatctgataattaatggggggagcgcaatgttattaattggtccaagacaagttttgtgtcataccttgtcttggcttttttaacacttatctgtatgctgtgattagtaaatagtggaggttgaaaaatgaaactaggtgaaaaactgaaactggcgcgcgagcgagtaaaattaacacagcaaaatgtcgctgattaattacacgtaacgcgggcggcaatttccaactgggaaactaaccggagtaaaccagatatcgaattattgacgcaacttagccaattatatggacagtcactcgatgcttggtccgaattaggacaaaatgaaacaaatgtatccgttgtatggtatagacggcccaaaacaattaaactgattgtggtattaattgtgttaacaattggcactggttttatcaatcaaatttatgatattgggtatgcggtcggtaaagctttggcgtattggatagatgcacgatgagatgaagtatttacaagtcgagttgcaaagatgatcacttaacataagtgataaggttgcttcaattaaatattgatattatttttaggcacgtttattgtgcaggacagaaaggaaattatgagttattttttgaatcggttagatgatgaacagattacttttcgggtgattaagcataagccagtttggcatttggatgaaggcttagaaatccaaaagcaatgtatggtagtgaagaatatgttacttaaagatcacaaacatgcgcactactatttggtattgactaaaggtgatacgcggttgaattttaagaaactggcaagccagtttaatacaagccgtagtcagctgaaatttgccgatccaagcgagcttgaagtggcaatgcatgtgatttcgggcatggtatcgcccctaattcttgaaacaggattgccactgacaattgtggttgaatcgagtttaaaacaagctgaggacttaggttttcacgccggaacaaacactgaaacagtggtattagcttataacgggctggctcaattagtgaccacattaggatatccaatcattaccttagaagactgatcaaaaatttatgtatcactatggtttctaccaatcatgatgtatttactgcagctgatttactgaatagtattggtgaaagatgtttgaaattcattgagaaaattagtcacttttttgaataagcttattggctagtttgataaaccactttaaggtagcaaaagaccataaccgggtaagatcggttatggtcatttttgtgacgtacgaagaacaccattaaaaagtagaaataaaaattaacgagctttagcaagtttaagctcattatgatttgtgtgataggtggtagttatgagtagtcaaaaatttgataacaataaattaacaaacatgcctgagagtaaaacttttgatcgaaaaagtatcaaatacgatattaataagctagctaatattttaatagcgacgccttagcattgtgtacttaaaaaatcgacaaattcctcatttacgagaaatttgccgatttattttcatgatgcagcatttcttggatttcgtaccattaaagccagaataaagccaatggttgccagtaagccaataaaccaaaatccggagtggacaccggcaataaactgagtttgcatggcaatcaaacttgttgcgatcgcagtggcgatggctccgacaatttgttgtccggtatttagaagcgcactgccatctgcagataacgcgcttgaaaggctgttgagactatatgtttgggctggggatgacacgagctgggcaccgatcaggatcgtgatatgaccgatgatcacttgaatgacggtgctgtgcatatttgtcgagattagagtaaatacgccgactaatattatcaaaaagccacaacgtgttagccattttgctccatgggtgtcataaagtcgtccggcaatcgcagcagtgatggcgttggctgcaccaccgggaagcatgattaagccagtgatagcgacgggaaatcctaacccgttgcgtaaatacaacggcagcaagtacatcgttgcaagaatcacgccaaagtcgagcatcactaatatggtaccaattgtgaattgacggttggcaaagatgcgcaggtctagcatgggagtggatgactgaagttgtctgtaagcgtagattcctagcatgcaaacaccgatgatcaacgccgttaaaactttgctagaaagccatccgtagctggcggctaatgatgagctaatcacaatgccactaaatccaatgaccgaagcgaggatagaccaccaatcgatcgaaatgtgattttgttcataaatattttccactgtaaaagcacacagtaacaatgcaatcacgagtatcggaataaatagccagaaaatgagtcgccaagaggcaattgagagaatcaaaccagtcacagttgggcctaacacgggggccaacatgatcaccagtgaggccaagcccatgacagtacctaatttaggtgttggaaagatcagcatcacaattgaaaacatcatcggtaaaatcaagccggtaccgatgccttgaatcatacgaccaatcaaaaccgtagcaaagtttgagccaacagctgaaatcagtgatcctataatgaaggtgctgagagcaaagataatcatttgttttgtctttacccagtgcgtcaacaaactggtcaaaggcatacagattccgatgatgagcatataaccggtgacgagccactgaacggtattttgtgaaattgaaaaagcttgcattaatgacggtaaggcaatgttgagcgccgtttctgaaaacataccgacaaatgagcccagcatcaaacccaataaaattaacctgggatgtgatacatgaacccttgcggtaagtaaaatttgtctagatttcatggtttctcctatttcaatgtaatcaaaaataatgacatacctgagcgcccgaggttgtcgttattgcttgattagcgtaacagaaaaaattttaaaatgtcagcacaaatttaaaaatcttttttatcattgccataattggtgttgagttatagtagctgcgatgaatgcgtagagccagattaatcatggacctatttgttagtagtttagggtaacgatccctagcaaattcggctatttttgtaatcaaaaacaggtgtagtctattattgggactcacctgttttaattcgcgatttaattatgcggcaacaaattactcaatagatctagtagaccaacggtagcacttggaaaagcgaaaatttgttgttgtaacatggtagcagtgtaatgaccattgatgattaaggtcagtaagttgatcaaatcatcgctatcatcggcatataggctagcaccaactaaatagccggcctgatcaaagactaaggtagcttcagcgtcaagggcccgtttgtactgaaaagcaagctgtttaccgaatggtaagacttgagtgtgataagtgtctggatgtgcttgagcctcagttactgtaactccaacttcggctaaacgtggcattgtgaaaacaacgcttggaattaccggatatgaaataggcgcggcgttaccgagaatagtttgagcgatgtagtttgattcaaacgtggctgttggtgtcaatttagcctgtggcttgtcgatcacatcaccgctggcgtaaatatttggtacggtcgtttgtaggtgatcgttaacaacgataccgcgtttagaggcttggatgcctaatgattcaagtccgagatcttctatgttggctacgcggccggtagcgcctaggatgtagtcacaatctagtactaggcccttagccgtcgtaacggtgatccctttttcacttttgaccacctcattaactgcttcgttgaagtgaaactgcacgccttgtgcttgaagtttggtccgtaagcgcgcaacgtaggtttgattgaatggggctaacgctttatcgctgaattctacaatgtgaacggttttgcccatggtagcggccatagcagcgaattccattgcgataataccggcaccaatgaagactaaacgttcgggcatatctggcaagtcaaggaattcacggctatcatgaatgtattcagcgcctggaatatccaaggtcgcgggtcgttgaccagtacctaacacaatatagtcgctggtgtatgtgtggtcgtcaacggtgacggtatgggtatctaccaattttgccgtaccggtgagcatggtgacaccaagctggctaaggagagttgtcattgttggtgcaaggggatcgatcacttggtgtttgtaggtcattaagtctgaccagtgaatatctggcgccttgtcaacgccagcaccagtgaaacgttcgagctgttcgatcaattggaatgggccatctagagcgatcttggcgtcacagccatagtttgtacaggtgccaccgacaagatctttttcaatgatcgcgacatgtttgccttgttgagccaaggctacggccccgtgccaagttgcatggccagagccaatcatcattacatcataatccatatccttacctccatgtgttttttaatcgtgcacgactaataaggtgaaagaaaaccgctcatccttccatagcggcgattaacttctgattcaacgtgagggcctgttcgtagtcctctgcggtaagatgatattttcctaggcattcggccagtgcggactggatcgatgtttcactgtccttggcgtgggtggtcaggctgacaattaaacgacgcttatcgtctgcgggatggattcgttgcacccagccgcgttcttctaggcgcttgaccaacggtgtcagggtgttggagttgagtttcaattctgagcctagttcgcgtaattcttggtgatcatggttccataacacagtgagtagtaagtattgtggataggttaaaccgtaagatgctaaggcatcttgatagaatttattgaataagcggttaacattatagacgctaaaacatagctggtttgctagattaacatgtgtggtcatagatttctccttattagtcgtgcacgattaaagcgagtataacgcattgaatggctaattggcaaggggtgcgtgatcagataggaatagtcaaaaaaagacgttgcacgatttaaatggtgattttaacaggatcagggagaattgtatgacttattattatgagaatacaagaattacaataaaatgataatactgagaaaaatcgtagagctaaatgaggttacaatagaaaaaatggaaatcatgccagaccatgttcacacgttgataagtttcacttcctactaatatcgtgaaagcattcaagggtgcctctgcacacattttttcgaaaagcatccagaactaaagtaacaaaaattctggaaaggctatctatgatctcatagttactacgtaaatactttaggtagtaacataaacaaagaggttgtgaatcatatatccaaaatcaaaataaaaacgccttatggcgttaatacatgagaattcatctacctgattaaaatcaggagatttctgccatatttcctattaaattgaacagtgggattgctgaatgagttgctgcttcgtcgataattttaaacgaaccaattgacaggtaccgatagagatggtttaatggtttaaaataacgaacggagatggttaaatggctgacttatcaaaaattaaagctgaatttgcggcttccagtaactttttggtggcactgggggatgaaaagcgtcaggcaattctggtggctttgatggcggatcgagcgtgtcagggcgtgcgtgttagtgaactgacggaggcaactcagttatcacgccccgccatttcacatcatttaaaaattttgcgggatgcgaaactgattgattatcgcagtgaaggaaccaagaatttttactacattgtccatgagacaacggagattaatcaattacagcagttgctgggtgacgtggtgcaagctatgacgacggaggatcaaaatgactaaggtcttaattgttgaaactaacgtgacacggtatggtgataccgatgatccgacgggcttatggctgggagaagcggctgaattcgtggaagaaatgcaacaaactgggatcgacgtcgattatgtaagtcctaagggtggctttgtgccactcgatccacgaagcatgaagtacacagatgacgccatcctgaaggtctacgagaaccctgatttcatcgaacgggggttaacacacaccatgcggccaagtcagatcgatccagcgaactatgctgcgatttattataccggtgggcacggggtcatgtgggacttccccgataatgaggaattgcaacaaatcgcacggcaaattatgcagcagggtggttacgtgacctcggtgtgccatggtattgcggggctgctcaatattaaggatgatcaaggacagtatgtaattgcgggaaaaaagattaccggttttacgacggccgaagaaataattgccggtaaaaagtcagtggtgccgtttttaaatcgaaccgttgccgaggcacatggggcacatttcacgaaaaaaaggttttacagtgagtatgcggttcaagatggccagttgattactggtcaaaatcccttctcggttcgtgcagtggccaaaattttaataagagaattaacgcactaatcaatcaagccagctttccaaactcggaaaactggcttgattgattagttatgggttaacaagtaaaacttagcggtgctctgaattgtaatagctaccccgatgacaaagccgaagagtaatgtggtgactgagtcgggtgtttggtgactaagcatggatgaaattaggataatgggaagcatgacttgccagaaaacggctgcatgataggcgaatcccttgaggagagggaccagattgatggcagtggtgccttggatttttgcgagatgggtgccgagaatgcgaatggccaaaactacagcgagaaacatcagtagccagacgagccatgtaatgaccgttaaatttggcagaacttggcgtaattgccagataacattggtggctaggacgccagtactagtagtggccagaatttcgctgataagttgtccttgggtagcctgttgactggcaacagagcgtgcaagggccgtccatagtagtcctatacaaaggagaattactgaaagtagcatcattaggcccccatttctgctgggtctgcgatttgtaagataattttgccagtgactttgccagaatgcgagtaacgaagggcctcttgaagctggttgaaaggaatcacgcgatcaatggtcggtttgagcgtatcgttttcaaataatggtgttaaacttgcgagctgtggaccactaggattcatgaaaagaaaggtatacgtggcttggctgcttttttcaagggcggttaagcgacgagtgacaaactgaaaggcgagtcgtttccaaaggggtaatccatatgcttgagcaaagcgcgcgttggggagaccagcaatactgacaacttggccgccgggtttgataattttaaatgcatcttctagtgtttgaccaccacgggtatcaaagaccgcatcgtagtcatgtaggatatcttgaaacttttctgtccggtaatcgatgattttgtcagcgccgagggagcgaacgaggtcgaagtttctggaactggtggtcgtggcaacgtacgcacctaaccatttggcaatttgaatggcgatggtgccaatcccaccggaaccgccttgaattaagaccttttgcccagcttggagattcataacatcgtgtaaggcctgataactcgtcagcccgacaaggggaatcgaagctgcttctacaaaggataggtgattgggcttgagggcgatagcaccttgatcaacggcaatgtattccgcaaaggtgccaattcggttcttttgaacgcgcccataaaccgcatcacccgctttgaattgggtgacagcagccccagttttgacgatgattccggcaaaatcactaccgagtgtcagtggcatttgataggacagcaacattttgaggccgccatcctttgttttaagatcgatcggattgatactggcggtcacgattttaaccagtacgtcgtcagtttcaacgtggggaatgggaacttgattaatggttggtatgtcctgcttgtagtgcgtaatttgtgctgcttgcatggtagatttcatgggacctactccttagttagtttaatcgtttaatttgttaaacgaatgatggctcaatattaattgaatggtttaaaaatgtcaaccattgaaactgacttttgattgattcgctcgtatgaccttcaaacactgatgatgtggtccggtttgcaaacatgggtgttattcacatttggtttcgtgctataatcgacaaaaagttaaccgatggggagagagcaatatggcaaatgcagtaatggcaattcaggtattacccgaagcagattcaacggaagaattagttcggttggttgatgtcgcaatcgcagaaatcgatgccagtaacctttcgtatgaagttggggcgtttgaaacgacggttgaaggcgacttggacgatctgattaagttattacatcaaatccaaatctctgtgactgaaggtggcacggccagaattagcaactacatcaagctgtcatatgcacctgagaaacatattttaacgaccaacgaaaaattagctaagtatcgggaacacaatcaagaacatgaaggttaatgccgacaaaaaagtcgctgatgcgtaaaatcatcagcgactttttctgaccatattgagtgaaatcaatttgaggtggtcacaaagtttcacgtgaaactttgtggtaaacattattgtccgtttttatataattccattaaacgagcacgtaaatcgtcgtcgtaggccgtgaggtagaggccgtacttgccgcgcttcattagtacgttgagcacattggcgatgaattccttgtattcttcacgagaaaatttgatatcttttcgttttttgaaaatttccttgtgggagtatttttctggaatgatggtcatggtgtccgtttgtttatcgtagccaaacgatgggccaataatcatccccacgtagttcagatcaaatccttgcagggtgtaaatggttcccacttgggtaattgatccctcgcgcttcgcccagtgtgtccgctggggatcccattcgtcccaggggagactgaacgtatccatttcaacgttgtgtcggccatcaattcgtgggaagcccgatgtggcgaccacacgactcataccgacctctttattgcgttgtttgattttttcaaacagggcccccgccgtattgaacatttcaaattcaaagtcgctgttttcggggaaggcttgcattggcttttcggccgttaaattatccatccaagcgacctgttcatcactagcaaccatccggtactggaagttcatgtcaaaagatttgtggggatgagtgccaatggtatcgtaaaggagctttttattccagtacattttggattggaatacttgatcaaagtcgtagacggcaacgacgaccttggctaagcccatcagatcggtcagttggttctgaccgcggtaatgcgcgtaaggttctgacttcgagtagagcaggtgcgcttcatcgacaaagatcacgtcgtagcgcttgtgatttttttgcgcatagttgatcagtgaggttgggcgacgaatagcattaaccttcatgtttggaattgattcggcaatatcctggtaggctttgtacaattcggggtggttgaccaccagtgaggtcttgtagtgcttgtctgtcatgtactgccgcacgagttccattagcactacggatttaccggttccggcagctccttgaataatggcgacggagtgtgagtcgctattgaggctttgctgaatatagtcgttgatatctgtgatcacagttttttggtcgtctgacaaatcatcgacaaagaactgcgcctttaaaatttcattcattatgtggactcctaaattattagttagcgttagttattttagcacagttggtgcttgattgttggaaacaaaacaaaagcatgcgtcagtcaaattccgacacatgcttgtttcaagtattctagttagccgataatgttgccttcagcgtccaattgatgaatcattcgggctggattgcccgcaatgaccacgttatcgccaaacgacttagtaaccacggcaccggcaccgacaatgacgttgtcgcccagggtgacaccaggaacgatcacggcatcgccaccgatccagcaattatcaccgatcttgacggcttttcctgtgccaatccaagatgtgcgcattttgacgttcaatgggtgactagccgtgtaaattttaacgtgtggggctaggagcgcatttttcccgatcgtgatatcgcacgtatcgagtaagatacagtcgaagttggcaaagaattgttcaccaacgtgaatgttgtagccatagtcgcacttgaaactagggcggacagtgacgtgctcaccagtcgaaccgaacagttgcttgacgagcttggttttagtggcttcgtcttcgaagtcggtattgttcagttgcgtgtataggcgccgtgccacgatccgatcgtgcaatagtttgggatcgtttacgtcgtagggctcttcgttcatcatatggttatattcaatgttttcgttttccattatcagttcactcctaaagtatatgtatgaaagggacggtaccgttccctttgcacagccagtaaaaatttgaaagcaagctcgaaaggagaaacggacgaggtacgtttcaaattagtacaagctaaagatagcgcaaaaatggtaggggtttcaataaggttcatcttttgctcgttagttaagcttagtttagtaattttggcccatatcaaagggagcgtcgtttgatgagggtcgtcgtgattaatgatttttggggcaaccaatcggggtgggcaaactggttgacgagttgctgcaagccttgtgttgccatttgttggatattgacgtgaatggtcgtcaactcgggtgtaatgatggttccggcgaagaggtcgtcgaagcccatgatggcaacgtcttcggggacacgaatgtgggcttgactggcagctttaattaaacgcaaggcaatgtagtcgtcctcgcaaaagatggcgggcggtaagtcgcggttgacgagttcttgaaaattgatgccggtcggattggtttcgattggggaaatgaagtagaaatcgcgattgtcaatcttgagctgagcctcttcgagtgcggagcgaaagcctcgccggcggccgtaaaagttagccattggtttgtcggaggcgaagtaaccaattcggtgatacccctgagcaatgatgtgctgggcggctaaacgcgcgccttggtagttatccatggtgataaaatcagcgttgatgtcgtcgtaggtggtgtctaggaatacgacgtgcttaattttttggttgataaacatgacttgatcatgggtcagatccgtccctagaacgatgactttgttcaagctcgtcctgagttgggggagcttctttttgagatcgctggcctcgatggtaatggtggtaagttcaccttggagacggtcgacttcctgacttagctcgtaaatgaggctactgaaaaaaggtagggcttggtagttatcgctcactacgccggtcgtcgtgatagctaataatgtgacttcgccaaagttgtttgtctgcatccgtcgacttttgcgcagtggtgaataatggagatctgccataatttttttgattcgctgacgtgttgattcactgacacccggttgctcgttaagaacgagtgagacggtggccttcgaaacgtgggcaatccgtgcaatatcactcattttgagactcatgtaagactcctccaatctagtaacggttagttaagcttagtttagcttattattgaagatttaggtcaaaataaaaccagttttcgttaaatttctcgaaaactggtttaaattgcaaaatcggccgcaatgaccattttatgtggaatgccgaagtagtagccttgaacgatgttgggctggtagtcacggataaacggcagatcagcacggccttcgaacccctccagggcaaatgatttatgttgctccaacgctaggttgcgccagaaccgaacctgttcttgcatctgacttagcgattctgttccacggatattttgcagcgcaaatttatactcggaaacgtagggggctagttgttggatcagcgcaatttgattagtaccggtgccgacgtcatccagacaaacagggataccagcatcgtggaaccgccgtgctgcagtcactaactgttcggtggtgacaagggtcgtccccgagccaagtcgttcggtgagttcaacgcacagttgagcgtgggtctgatccttgatggtggcgaggagctcacagtattgtgcttcaacaaactggcgttgatcgagattgaatgaaataatttttaagtcagcaggcattgtttgaacggtggcgttcaatagggtcgtgattttaaccggatcaaagcggctgaagtcggcagggacgacccactgatcgtcaacttgctcacgaatgaatagttcatagccgcatagttttatgttgtcggttgaaaattttgcttgtccccagcatctgatcataatttttccccacttaattcgatttaaatgatttttcaatattaattaatatttatgcattattatgtaatacgataaaaacccttgagtgcatttttaatagacgttttaaagcacaccttaaaaataacgtgtgctgattgaactttattagttatagaaagattaattgaccattacttatttgagcgatataacgattaaacagacgttggccgctaattatagaatacgattattaattgaattgacggtattttttgaaaaattatttatcgaaagttattcctgtgacaacgttgaaaaccaaaaataataatgatattcttaggttaatattttcaagctgattttagacgctttcaggtgtaccctaaggcgcctatttttttgattttaaattgccagtagtgctcgcaaaaatagttctattatgaataattattaatcaggaaaaatatggatcttgtataactgcggtttgaatcgtatgatgagactcaaatgcgatcgcgcggcgacatgccttagtcgcgattaagatttttgatggagaggatagcgatgagtttgaaaattacagtgattggtgcgggggcaatgggattacggtacggtgtgttgctacaagaggcgggaaacgacgtcgatttcgtggaaccatggcggccgagttacgaggcgattaaacaacaaaatggagtttatgtttcccgtgatggcaacgatcgacaccttgttcctatcagtatttatacgcccgatgactatcaaacgacgcctgatttagccatcctgtttgtaaaacagatggcatcagagcgggcaatggcggcttgtcgacattttcttggcgctgatacctatgtcctgacgaaccaaaatggaattggctcggtggatgtgattgagcaatatgtgccaaaacaacatattattgcggggactgcctttgtggcgacggtattgaatgctcctggcgatgttaatttcatggggaagaagggcgctggtcatacgcacctcgtcaatgtcaccgaaacaccggatgaagtgacgcaccgggtggttaccgaatttgagaaggcgggcctgaatcccacattgatgacgaattacatggggaccctgtgggacaagatgatgctcaatgcggttatcaatacgatttgtaccatgatggatattacaatgggacagtatgcgacgtacagtcaggcacaggcgttatccgaagaattgatcgcagaggggaccaaagttgctgaagctgacggtgtgaaaatgctaaagacgcctgaagagatggcggcggttattcagcgggaaagttctgccgttaacccgcttcatcggccctcaatgtatcaagatatggtcaataatcggccaacggaagttgaatatattaatggttatattttaaaacgggccaaagcgcacggattaaccgcccctaaacatgaactactggtgaagctggtgcatcttacggaagaaatgcggcagtatcgttaaattaaacgctgattggttgccgtaaacaacagtgctaggtaaatgagaaatagtattttttacagaactgccgtgttacttaccaaaatggcccttactatcaaaaagatcaatattcgatgatcaaaaaagtattgtattataagatgacgaccgtgtgatctagagcaagattggatcagcgaggcgatttttttgaagggacagttaggctagtaaaatggaatctggaataaaattaaccacgattgaaaaaattcagcaggggatcgtctttacggtcgccaagctgattcaaattttgccactaatggctttaacgatgatctatacgaccaaccagtcggccgaaagctacatgccgtacattctattttatacggcggtgaaaacaggcctcctgctgatcaatgggttcgggcacgtgcaaaatacgtttaggctaatgcagctgagcttgattatgagtctagcgaccttattggtactgatcttgtcgccttgggagtatctcaccgacgtggcggccttcctattaggattaagtgccagcgttattttacccacgtatgagggggtgtactaccacgagcgggtggtgtggaagtggtttttgcaaggagttgaaatcctaacattatttgttacgagtgcagttattctgacgcttattgccatcgccagtcatttttcatatcgaagtgtctttgcgatcattaccggttttgtgttggtgggactcgtgacaatgatgcaatttaaaccatttgctaagcaagtgggtgaaccgctttttgtaccacacacgcaatctcttcgtaatttagagcttttcacttggacaaccgtgatggtgtttgggttacgatatctacgcttctttgatcagtcatttgcgtggacgatcatccttgtagcggcggtgggactcgtagcgctcgtcagtcgggttttgatttggcgatcaaaagtaccgggactgccgtcgtggacggtggtcagtgcggtgcttaatggggcttatgaaacctttttgatgttgtatatttttcttgcagctcacggacaaaccgtgatgattagtgcttacgtggcctatggattaggcatgatgctagctcagattgttcgacggccacttcagcgttcgtttcgggggatgtcgaaccttaaattgcagttgttgtttttcggcctcggtgcgtggttgacgatttggccaaatacgctattgttgggggcctttgtcattagctttttcggcagtgctaatagtattttacttaatcacgacgtttacctgaccgaagtatcgacaccggcgcatcggttggtggtcaagtatcgcagcacataccttggaagtatcctcatgcaatttgttttcatcggtggcatgatgggcctatcggttgtgagagacgcaaatctggcccagattatgtggcaaattaatgatgcaactatctcaccggcgacgagccagtttgtgcggttagtcgggatggcaacggcattagttctcacggttttgacggcatgggcctgctggcgactgccggacattgatgagagaccactgcagtaaattaatttttaatcaatatcaatcaagtaaagggcgcgtcatcgattctagtcgatgacgcgcccttgtttgtgagttagaaaaataggtagtaaataccggccacaccaatgaaacggtagacccactttcggaaggtggcgtcgtctagcctagtcgcgatacgcgccgcgatgatggtgccaatgctcgccgcgaccagtccaaccagaatgtaggggatgtcgtgggaaacgaggattccgttagcgacccggacgctattgatgtaaaatacatcgattaagaaaaagccttggatactggcggtgtattcggcaatcgagtgtgagcgggatagaaagtagacggccattaagggtcccccgatcccgagaagtccgttgaaaaagccggaaatgatcatgaagcatagggcgatataccacgggtattgccggtcactggcgttttttacaaacgtgaagtagaggtagagtgctgcgagcaagacccctaagaagacccgcatgatgtgagtatcgaggacgtgactgagatgaaccgaccacgttgcgaccgttgcgtagacaatgaatgggacgatgattttcttaagatgaaaatcatgacggtaacgaaatgttagaccaatcatactggcgagcatgctgacaccgccgatgccggccgcttggtcaattgggagaatcgaggggaagaaaatcatcatgatgatcactgccccaaagccagttagcccctgtaccaaaccacccagtaatgcgggaaaaaagattaatagccaagtcacgagttggagctcctttattatgaattagtggtgcgtctagacctagtgtggcggatgaagctggtgaggtcaatgcttagcgtgttaatcgggaaaaaacgaccccgcgaagctggaatttagctgattcgtcattaattatgatcaaattggagtaaaataactgtataaagcgcataaaaatataataaatgagggacaactatggcgatcaagatcataatgatcacattttggacagtttttgcggcactgggatttgcgaccatgtttaatctactagagcatgtgggccggcagtacgcgaaccggaatcacctattaggtacgtttcaacaagaaattccgctcacgatagttatcagcgccctgatgttgttaatgcgggtgatgaataagagcattcacgcgcaggatatgacgcagtattggctactggtcagcgtacagatggtatttgtgatttatacagatttaatggttgaaagtatttggacgtttctgacggttaaagttttcgcggcgatatcatttgcaggaactggtgccatgacggtcttagcctgggggatttttgtgttggcgggcttatccattttctgggaatcacggtatacccaaaaatggtcccagagtaggccctttctctttgcgatcccgccgatgctgcttgacgctgttttctggggattaatgtatgttgggtggcatccgacgccgctcaccattatggccaactatattggcttcacttgtgcaatggtggccctgtttgcgaatagtcgtaatcaacgggcagatcaacaaattgtggcgcggctaacgcatgaaattcagttcgatgggctgacgggcgttcgcaactggaccatgttccagcaagactttaaccaagcctacgccagcgtcaaggtgtcgtggccgttagcgattttagcgatggatttagataattttaaggggatcaatgatacatacggccacctaacgggaaatgaagtcctcattacggccgcaaccaccctagaaaagttgatccaatcgatcgatgccgactaccatctctatcggactggtggcgaggaatttgcggtcattttgccgcacaccgatcccatgaccgctaaaaaaattgggcaacgttgccagcaagccattcgggagctgacaattactacaaaaattggcccgttaaacttaacggcctcattcggaatgactcaggcgctcgataaggaccgcgatgcaacggccgttttcaaacgggcggatcaggccctgtaccgttctaagcgtgcgggacgggatcgactaaccatcaatcaagaaaccttggtgggctaaagcagctagttaaaatttgtgttaataaaacggtcacaaccagatagcggttgtgaccgttttgctatggtaataataatttgagccaattcatgtgtggcgcgaggtagcggcgaattaaaaataatccggcggttaggccgagactgatgccgaggagactgggtggtagaaacatgatgctcattacgccacccgcaatgaggggagattctaggatgacggtgcccatgctaatcgcaaagatgccaatcaaaaagatgggatcgatctgcggtagaagctgactgagggcaattccctgagcagtggcgcaaaataggaccggaaaaatttcacccccgagccagccggtattgagacaaattgtgaggagggctaatttaagcaacgattgaagtagtaaaaaggcgatcgattggtgttgccagctagtcgccagtaaatgaaagttaatcatcccggaaaaattaatggccggagcaaataaggtggctaggtaaattgcgattcccccgagcgcaatcaagccgatatcgcgggtgattctgtccagtacgacgttgcgcaaaagcaccatgagccagagccagcaccgcccgacaatcagaccggaaataacgaggggtagtaaccattttaggtcattgagctgccaattggagtggccgaggtaaacgatgaccgaccgttcaccacctaatttgcaagttagatagaaactgacaatgccaatcgctaagtagcttatggtccgtggtgaccaccaggattcagagcggcgtgctttttcccgagccagtaggtagcggtgtgggagactcatggccttaatggtcgcccaccaaccgtcgtgccagtgggcatctaggtagcgacacttatctagaatccagacgccgtagagaactgtggagctgacaagggtcgcttcagggcccaagctggttccactggtgagaatgaaggcggggatgatcatctggagcaggacgtagcggtagtcggcggtgccggtatcgtggagttcgattttgataaacccgagtttctttggtaggtaaccggtggtgcgctgggtggcatagatgagggtcccgatgatgagtaaccagccggcgttaaatagtggtcgaaacgtgggacccggccagattttttcaatcaaccatccctgaaagaggtagaaggcccccaataaacagcccgcaatgaggctacaaattagtccgtaaatgtaaatgatgatttttttgatgatgagggcccctttacgataataaaagtataaacgatcgatattccaattttatatcgtacacggatgtgatttagtttgtcaaataagggaccgctatcaaccaaaaaaacggtcacttctgataagtcattagaagtgaccgtggtatgaaaggtgattttaatccgcgaggttgaagcgtaatttcattttggtggcacttaaggcggtcattttacccaacagtaagttagcctgttcaaagtagaagtcagccatttgttgattttgctgttcgaggaaggcaggtacatccgccgtggtggcgagttgttgattgttggtgcgctgacggtgccggcaagttgccatgatggtctgctcaaaggcgtctgcgagttcgctaaagagcgcatagttagtatcaccgagaatcgcagttgttcggctcagccagtaaattttttgaaggtcaaatgtggtgctggtatcgcggtaacaagcaggtgtatcggtaaccgtcgtgtagaaaggtacgagcgcgttaaaggtgttgggaccgaacgctagccaatgaatcccggcaacgctagccggaacgttgggccgaatttggagaatatgcgtttcctgattgcgattaatcccgattggtcggaacttggtgcgttcgcttgtgggaccattaccatatggatcgtagggtgtatcttggtaatgggaactcagcagccatttaacgtcctcaatggtaattttacgctcagcacgcatgataaaaggtaggtcttggtccgcgggttcgcggggttgagaggggttaaggtaacgctgtccgaaccaggtccgggggttattgtagtgggcatctttaatggtcgcactgccgaaaatatgccgtagattgatgtcatcagtgtcgggattaagattattttgggtgattacatctggtaaatcggccgcaaacaatgtgttattgctagcgaagtcgtaatgatcgatgttgaatcgattaggggcgataacgtaggcgtcgtcaggaatgcgaatggcggcccagtgatggcccccgatagattcaaaataccagacttcatcctgatccgaaaaggcgaccccgttggattcgtaggtcccgtattgttcaattagctggccaagtcgctgaacaccgtcgcgtgcggaatgaatgtaggggagggtgatggtgagaaaatcttcttcgccaatgccgttttctacgaggggatcaatcccgagaatgcgagtgttcgtggtgctagtttcagtggccgtcatggcgacgttagcgctgttaatgccggattcgccccaaataccaaactgggtatcggcatccggtgtggacgtatagcggagcggattagcgggcaatgggaagtgaacagtactttgaatggcgtggtaatcacgcggttgatcggccggattgatcacaacgaagcgttggggattagaagcatcgctaccactatcttcatttcgagcaatcatggtggaaccgtcgatcgacgcttttttaccgactaaaatggtagtacaggaaccggtttttcttgggtgcatgtaggtcatctccgaggtttttaatttatactgcccattttaaattaaaaattgaataaatacgaatattaaagtgctgcagccgttttgcagagctctttcggtaagtaaggttttggctacgccgtaatcaataatgtgcgaaaccgctgtggggaaacgccggcgaagtttttaaagattcgctggaagtagttaacgttggtaatgccgaccattaacgaaacttgggtgagcgataaatcaggttggttgatcagtaatcgttgtgcctcacccacccgccgagacgtgaggtatttgatcggtttgatagccatattttcttggaattgtttatctagataagtatgactaatcgcgagttcctgacaaacctttgtaatgttgatggcgtcatgaaagtgctgatcgatgtaatttttcgcgcgttgcacgataaacggtgtggtcgtggtcatagttttgccagttacggctttttcttgaaagtagggtacgagactggtcagaattaaattactggcaagttgatgggcagcaaggtcctcttgttgaagtagttcaaaggccagttgaccgattcgagtcattgtactaaattcggttgccgtaaattggaagacggggtaggtggtaccagcgatgaggttgggcgttcgaatgccaatacaaattgacggtagaattgcgccttcggaatgaagacgaccagcgttaatcacaacggcatcttgatgagtcacgttaaagtaactatcgcgaatgaagtactgaccgctcccatccatgacgagcgatatttcggtgacctggtcgtgttgatgcaggccacgaatatagatttcatcgtaggtttcgacttttgagatgtaggcgagcgatggctgatgagccgcctgtcgctgccagtggcagaaaaattgacgcatgttttggtcacccctctcaattaaaatttgaaaaatgaaagttttaccgttcttcacgggacggtcccttgctagatcgccatttatagttgcaacttatgaataaccgctttcattttacagtatatactaggaacatcattaaaagaaatcaggtttttaaacgaaaatgaaagcggttttgcgtacttaattaatatagcacgtaaaatgggcgaggtgggcgtatggcacttttaattggtttgattccagcccttttttgggggatttatccagtatggctgaagcggttgacgggtggtaatttcttggagcaggttttaggaaccgggactgggatttttctgtcagccgtcgtcatcgaagtagtatttcggctgccaatttcacctcatgattttttactatacttcctatcgggatttctttggaatattggacaggttggtcaatgctggagctttatgcggttaggtgtgagcgcagttatgcccgttactacggccttgcaagtgattggtaattcgttgattggcgcgtggctatttggagaatggcacgggtgggcagataatttgattggtctgggcggactactcgtggtcattgccggcgtcttcgtttccaacggtctcgtgcagatgaaaaagagtgatttgagcgtttatgtcgtcttgttgctcacctcggtggggtactggagctattcggggtttccccactttgtgcattcaaccaatggtttggccggctttttcccgcaggcgttaggcatgttttgtgggggactacttgcctatctcgtgggacgtaaacggctgccggtcagtgatcggtgggggctgcgtaatattacggccggaatcgtctttgcagtcgcgtcgtcaacctatctgatttcactgcgaatgaacggattggtgagtgcgtttgtactcacacaactgaacgtggtcattgcgacgatcgttggggcaatcgtgcttcacgaaaaaacagggcgacaattaattattacaagtatcggattagttgtgctgattgcaggtgtttttatcatggtcagtgtttgattcaatgggttgtcacgcaacggtacccctagcaccgtatcgttgaatggcaggtgagcatcgtgtttggttggggatgttcacacactatcgggcctctggatctggcagtatgcttaggctgctggtgaacgggcactcaggaaactcactttgcaatgactacctaataccgatagcaactaacagcaaaggcaatgcagccggataactgcattgcctttttgagtatgtttcacgtgaaactaagctaggtgagaatgatgggtaagaatgtgtttgcctaattcaatgatcccgatgaaaatgaataaaaagataaaaatggtgaagagcaggcggtttgatcccgtccccatcatgagtttatcaatataggggcacgaaaatgttgcggcattagtgctcatcatcattatcgtggtggcatcgttgccgtattttttagggacaaacgaaagaccaatggagaagatgaacgggataaaaaagccaaaactgacaccaacaacgagggcaccaatcatgcaggccagcgcgctttgggcggtggctaatagaagtgctcccagtaactcgatgacgatagccagcaagagtgtgtttttttgtaatcgatggtagattcgaccgtacagggtgccggcaacaattgtgccaagggacataatgacaacggcgctcgaaccggtcgacagtgaaccaaaatgattttcaagaacgtaagttgtgattttcacggtaaccgtaacgtagaaaatcatcattataaacaggatgagccagtagtatgaaaagctggcaacgtctttggtctgtaatcgatgcttaggcgtttcttgctcagtcatttcctgagcaggggtaccatattgaacctcgggaacaaacaaaaaataaaggacgaaaataatgatgctgacaaagtagattaagtaggccattcgccagttagcaaccattaatagaacagtaacgatgagagatcctccggcagcgccgagaccctgaaaagtattttgataccctaataatttttcgcgttcacggccgttgtaaaagtaaccaatgagactgacgcagagggcgttaaacaggccaattcccgttccaaggatgatgcgtgaatagaatagggcggtaatattcgtggcaaaaactgctagaagtgttgagattgcgacaagcgcaagaccggtcaaaacgattttgcgggtgccccattttttgactaaaaaactactaatgataatgaacagtgccattgtaaatgaagttgcggtgatggtagattcagccaccgattgtgtggtccctggaaaggactgtagaatgccggggacggtggctgcaacagcgccgggcgccatggtgagcaacgaaagactaagaattgagaccgcggttaattgattagtacgaggtgtcatagcaaagactcctattctaaaaaaataatatattaattagtttataccttgaactgcgcttcaagtaaaggcttaggaaaaatttgtccggataaatttgataagctatgatttgtgattgatcgttttcgtctgtggctgttagagttaaaagtgagctatggtataattctggtgatttattctgacgaacaacgatcagagggaggattgtatgcaaacgaacgaagaaatttttgaagcaattcggcgggatccagataatgctcagtttacggagcagggaattgatccgttataccattttgaaaaggaagccagtattttgattgtcagtcaggcccctagtcggtcggcgcaggcaacgaaaacgtactggcgagatgcatccggcaaccggttgcgagagtggatgggtgtgacagaagatgagttttaccattcaggtaaaattgcggtggtcccactagatttttactatccgggcaaggggaagagtggcgatttaccgccacgaaagggatttgcagaaaaatggcatcaaccactcttggagttgatgcccaacgttcagttaacactactaattgggatgtacgcacaaaaatattacctaccaaatcgcaaaaaaacgctcaccgaaacggttgcacactattcggagtatgccccttactttccgattgtgcacccatcaccgttaaactacggttggatgaaccaacatccgtggtttacgacggatgtgctaccagatttgcaagcccaagttcgtgccttgttataaagttggctgtctggtgtcctaatatgcaatgacgaaggtcgtaaattgcggtaggatagaacagttgaaacaaatccaattaactcattacaaggaggttcccatgtaccgaggaattgtctttttcgatcttgatcggacactgctaaataatgaaacgcaggttgaaccagaagtagcgtctgctatgacgcagctccggcaaaatcaaattttacctgtcattgccacgggacggaacctgtacgaaatcaaagatattttacaggtgactcaaatcaatacgattgtttctggcaatggtgctaacgtgcaccttgagggacgtgatatttaccggcatccaatcgacgagctggtagtgcggcggttgattgcgcgagcagatcaactagatgacgcagtatcggtcatgaatgatcatgcttacagtattagtcggcataatgaagtcgcggtccaaaactatcattacattaatacgccacttcccgctgcggatgcggctcgatttgtgaccgaagaggatgttttgatgatggtcattagtaccgttggtcatgatgaggcatatgcttcatttgagcgggagtttaatatttgccgcaatacgccttacagcgttgatgtggtggctaaggagatttcgaagcaatctggaattaagcgcctattgcaggaatttgaaccagaaataccaacctatgcctttggtgatgggttgaatgatctccccatgcttcaatttgttgatcatccagtcgcaatgggaaatgggcttccagaagtgaagcaaacggctgaatttgtgacgacggataatattgatcatggtattgtaaacggattgcgacactttaacttaatataattgatgtgtttcacgtgaaacatacaaaaatgggcacccaaactaaattgggtgtccattttaattacgtcaaagttgctttaacgcatcgttaagccagtcatagtactctgtttcacggctgactgcgtgactaagaatcaggtagtgaccaaagttgactggatcaccaccgtcgggaaatttctttgatagttgatttttaaggtgggttaatttctcggcgtggtattggagttgttcttctaacatggttgtcagccgcggatcagtttgatcgtgaataaaatatagttttaaaacaaattcgtctttaccgttagtttgattaatggttggttcagcaatccaggccgtcaacaagtgttggccggccggcgtaatcgagtaccgtttgcgttctaacttctcaccgctaacttccatggtgtgcgtgagatactgtttttcttccagtgttttaagttggggatagatttgactgtgcttagccgaccaaaactcaccaatatcattatcaaatgacttggtaagctcgtagccggtctgggggcggtcattgatcaacccgaggatgatgaactgtaaaatatttttttgtgccattttgaaacttcccccttgacgttttggtgaaatcattatatcataatcacgttaacaaaaacatgtaattaattacatgtttataattaaagaggaacccaatatggcagatatgaataacatgaataaaacgtttaagacacttgatgattttttaggaactcacttcatttatacgtacgataatggctgggaatatgaatggtacgctaagaatgatcatacggttgattaccgcattcatggcggcatggtagctggccgttgggtaactgaccaaaaggcagacatcgttatgttgacggaaggaatctataaaatttcatggacggaaccaaccggaacggatgttgcgctagactttttgccaaacgggggtaagatgcacggaacgattttctttcctaagtgggtagaagaacatccagaaattacagttacctatcaaaatgaacatatcgacgtgatgcatgacgcgcgtgaaaagtacgccacctatccaaaactagttgtgccagaatttgcgaagatcacctacatgggtgaagctgggcaaaacaacgatgatgtcattagtgaagaaccatacgacgcaatgccagacgacattcgtaatggcaagtactacgatgaaaactacaagcgtttgaaccgttaattttttcaattaaaggccgcaatcgaaattggattgcgaccttttttgtgtgctagttaagatttctgtttactaaatcagtaaacacgcgtataatgtttattaatttagtaaacatagtggacggtgagaaaatggatttactagcgatgacgttagcggaattgaaacagggctggcacgttgaaacagacgactattgctgcaactgctgtaattatcggtgtcggctactgtcggatattcagcaacacgttgctgaccagcatcaaggagcagacttggttcacaatacgacccggtacaatacactgacggataagcaacaacgactttttacactttttgcggcgggaaaacgagataaggagattgcagaagaactacagctaagtccgtctactattcgacaccaaaaatttacgtttcgtgaacgagctaaacaggctaagtactatttggcgacctttgagaaaactttttttgcggataatagtgcagatcgattgctgccaattccaccgactactgagattattgatgatcgattcgcaattactgaggctgagtatgcagcgatcacaaaaaagtatttcaggtttacgactggtaccttgcagttaaatcaatggccgaatggtgagaaaaagatcgtggcaattctacatcgaattattgaagaagtggcccgcgattatcgatattccgaagcagaaattgaccaattgattcaaccaatttactttgattatgcaattgtcagacggtacttggttgattatggattcatggcacggacatcagatggtacgcaatattggcgaattttttaggagattacatgatggatgcacagcgaaaaaaagaattgatgcaagcttataaagtggctccaacatattatggggtgattcaaattacaaaccgacaaaacggtaagatttttattgatacggttcccaatattaaaaatcggtggtttttttaccagacaaatttgaacaaaaatttttatcgaaacacacccttgcaacgtgattggaatgaactgggagcagaccagttctcgtttcaaattttatggaaaaaagaaaacgatgatgtcatgaatatgcatgatgaactgaagcaattaaagcgggaatggttgctaaaattacaaccatttggtgaacgaggctataataaacgaccgcttgaaaggaattaaaatggataattttaaggtgcttgatctcaatacctggaatcgacatgattatttttattatttcactaaaatgatgccaactgcatactcaattacgattgacatcgatgttaccaatacctatcaatatttaaaaaaccgtcatttaaaattttttcccagttatctatatatcacaacccgattactcaaggatcaaccagaatttttgattggcgagcgagatggtcaagttgtacagtacgagcaactacatcccagttttagcctttttcatgccgacgatcatagcatttccaatctatgggtaatgtttagtgatcagtatcaaacgttttacgatcgctatatggcgacaacggatcagtatcatgaccagcatggcgcgatggtgcagtctgatccaacgccagttaatagttttatgatcgggacaattccgtggctttcgtttaacagctatacaccgttacctttacagccactaaagacttacttcccgattattcaatcgggacagtttaaggaaatcaatggtcgcaaaatgatgccattatcgtttacgatccatcatgccgtcgcagatggctatcatgtgagtcaatatttgaatcgattgaagacggcctttgcgcaacctgagcagtggatcacgatagaaggttaaagaaaactatttcatatccgtgtctaggtgaatcatttccattattatagtgataaatttctgtgacacataaaattgaagttaccaagtaatcctaccaagcccacgatcatttcgttgattgtgggcttggttttgcctagaatggtgatataaccaagacggaggcataaaaatgaaacatatcacagttgggattgtggcccatgtcgatgccggtaaaacgacattgtcggaagcgatgctgtatcattcgggacaattgcgaaaactgggacgagttgataagggcgacgcttttctagatccagatgatttagagaagcaacggggcattacgatcttttcccatcaagcaagcttacaatacgatgatctcgatctaaccatgttagatacgccgggacacgtggattttgcggctcaaacagagtcagtccttagtgtcttagattatgccattttagtcatttccgcgacggatggtattcaaggctatacaaggacgctttggcggttactggcacgctatcaagttcctaccatgatttttgttaataaaatggatgccaacggggccgacgcagttcaagttatgacccaattacaaacggagctttcgactggttgcattagctttaacaccactgaacaggaatcgacaatttcggccgcgtcgtatgaagaaatggcgctacaagatgaaacggtgttagaagctttcttggaaactgggacgctggccgacaatgtgattcaagcactgattcgaaagcgacaggtatttccatgttactttggttcagcacttaaactctcaggggtgaaggcgttgatgacgggactggctgattggacaacagaaatgccgacgacggcaacatttggtgcccgtgtttttaaaatttcacacgatgataagggagaacgacttacatgggtacgagtgactggtgggacgctacacaataaggcagttctgctggatgatcaaaaggccaatcaactgcgagtatacaatggcgcaaaatatattatttcccaggaaataccggcaggtggtgtttgtgcaattaccggcctgacggatacatatccgggacagggaataggtgctgaaaccgatgcagcacggccgatgatgcagccagttttaaactatgcggtagatcctaaggactatgatattcatgcctgcttagatgcactacgccaattagaggatgaagacccacaactacacgtttcttggtcgagtcacttacaggagattcgagttcagattatgggaaccgtgcagttagagattctacaacaacgattacgggatcgctttaatctggagatcggttttggggaaggcagcattctgtataaagaaaccattactgcggcggtcgaaggcgtaggacactttgaaccgttacgtcattattcagaagttcatctattgctggagccacagccagcgaatagcggggtttctttcgcaaccaattgtagcgtcgatgtactgggtaaaaactggcaacaccaagttttgactagtctaaaggctaaagagcatattggggtgttaacgggagcaccgattaccgatatgaagatgacgttggtgacggggcgatcacatatcaaacactccgagggtggtgattttcgtgaggccacatggcgtgcggttcgtcaggggttgatgatgcggcgtgccagtgatcagtgccaactgttggaaccctggtaccagttccggctagaaattggtgccgatcaagttggacgagccatgaatgatattcaaaaaatgactgggacttttgaaacaccagctgctggagtcaccaatcaggccatggtggtattgacggggacggcaccagtggcagaaatgcaagattatgcgcaagaagttcatgcttatacgcacggtcaaggccagttagaatgtttggttgatgggtaccgaccctgccataatgcggctgatgtgattgcagccgcggactaccagcccgtatccgaccttgaaaatacaccagattcagttttttgtgcccatggcgctggctatccggtggcgtgggatcaagtaccagcggcggctcatctaccctatgtttatacggccgatcaattggcacatatgaattaggcgtaaatgtccgcttgtacttcgggttaggaagcgtaccattgattaagaacttatattttatcaaaggacttgatgattagtgaaaattgaagaaggctacatgccgtttcacggctttcagacatactaccggattgttggtgaaccgaatcctgataaggcacctctgttactgattcatggtggcccaggatcgtcacataactactttgaattaatggatgactatgctgaaacgggccggcaactgattatgtatgatcaggttggctgcggtaaatcgtcactacccgacgatccagccgtttatgtaaaggaaacctgggcagatgaattgattgcattgcgccaatatttacacctagatgaggttcatatgttggggcagtcttggggtggaatgctggaaatgtattacctgaccgaatttgatccacagggaatcaagagcgtgatgattgatggttccccggcttcaatcaagctatggacgcaggaacagcatcgactaatttcgtatctaagctacgaggatcgagaagcgatcgcggaagctgagcggacgggtaactttagtggtcccaagtacttggctgctaacgaccggtacatggaacggtactgctgggatgatccagatgaaaattcaccagaaccattgcggcggcccacgaatggcaagcgggccagcctgattgcggaagggccaaatgaatttactgaaaatggaacaattagtgactttgacgtgacggatcaattgcacaagattcacgtcccaacattggtcacaagtgggactgatgatttgtgtacaccactggttgcgaaatctgtatatgatcatattccaggcgctaagtggcacctatttgctaatagtcgtcacttggcgttacttgatcaacatgatgagttcattggtgtgcttgatcagtggctccatgataatgattaaaaaaaacctcagaatcggttgattctgaggttttactatttgatggattggccttcaatggtgatgcagtctcgaccgtgatgcttagactggtataaataatggtcagcgcgtttgaagacggcagttgagctaccgtctttactacgagcgactgccatcccaaaggaagcggtaattcgaataacggtatcgtcttgttgaacctgagtatcacgaatgaccttttgacaaccaaagagaatttcttccgcccgtatccgtttggtatctggcaagatgatggcaaattcttcaccacccgttcgataaaattgatagtttaaatttttactttgaaggtagtgctggacttttgtcgagatggttatgagcacttgattaccagctaggtggccgtattgatcgttaattgatttgaagtggtcaatatctagtgtgatgagaaccaggttgggagatttagctaaccgagcataatgctcattgaaatcgtattgaaacatgggccaattacgagcttgggtgaggccgtcatattggacctcatgatttagcttagcaagtattcgctgatctttttgttggtattgatcgtaatcaagcaatgcgagataggaccaaatgaaggcaagtaagttaacacaggtaccgctaattgataatacatgttggccggccatgtggtaggcgactgtccaaaacagggcaccaacgataatcggaagtcctaagtagaaaaaggggtgtttttttaggtagctttggtaccagcgaatattataaacaataatcatggttagtagatagatcggggtcgttatccaggtcattgcaccatctgagatgaacatgagggtgccaaagagttgcacgacaataaatcctgcgagggtgggcacaaggatggtactgtacaccataatgataacttgcaggttaataaagacccagaaagtatcgacgggggcgttggaatgcaggattcggagcagcagtaatatgaggcaaatataaataatttgcggggtattacgacgaacggcacttaaacttttcttctccgccatatttttgcgcgttcccgcatcaatttggttgtacaccgtcataaagcctaaagtgctgataatcgttaaaaaaatatcactcataaaatttataattataggaaacgccccctttgttatcgccagctaaacatgattagtatcagctagtttatacgtatcgtcaaccaccacggcatcattaatgatgaaatgctataaatgagtgcacaatgagaatgaacagaagtatataaaattagtattattaattgtcaaatcaagttttaaagcgttataatttaatctaattctaataaattaatagactataagattggaggatggcgtccaataagttaactagcgagtttaaaataatctttttcattacatattaaattaagttctgcgcgtacatattttgtgactgtcacagatcacgaaaggaattgtgaaaaaatgactgaattaaaggaaattttagatgatcgcccatatgagtttgggtttcatgatgatattgacccagtttttaccaccaatcggggacttaccgaagacgtggttcgtcaaatttctcgcgaaaaagacgagcccgaatggatgctggagtaccgattagcagcttttcacgtttacgaaaagatgccgatgccgtcgtacggtccggacctaaatggactcgaccttgaaaacatgaagtactatcaaaaaatgaccgacaaaacatatggagactgggatgaggtgcccgatgatgtgcgggaaacctttgatcgaattggcattccagaaaccgaacgccaatatctgagtgggtcggccgtgcagtacgaatctgaagttgtgtatcatcatatgcgagaaatgtttgaagaaaagggcattatttttactgacatcgattcggcgctaaaggagtatccagatcttttcaaacagtggtttggcaagttggtaaagcccacgaataataaatttgcggcgttaaacgcggccgtgtggtcgggaggaagctttatctacgtgcctaagggtgtgacgcttgatcgaccgttgcagtcttattaccggatgaataccgaaggatcggggcagttcgaacgaacactaatcatcgtcgacgaaggggcccatatcgagtatgttgaaggttgtagcgcatcgatctatagtcgcgataatctgcacgcggccgtggttgaagtgaacgttttgcccaatgcctactgccggtacacgacgattcaaaattggtcaaataacgtttatagtttggagactaagcgtgcccaggcactagaaaatggggttatggaatgggtcgacggtaattttgggtcgaaagtcacgatgaagtacccatctgtttacctgaacggacagggggcccggggcactatgctgtcgattgccgtggctggtaagaacattgattccgatactgggggtcagatgattcataatgccaagaacacgtcgtcatcggtggtttcaaaatcgatttcgaaggatggcggtgcggtggactatcgcggtaaggtccgttttaataagggatcggacggctcgtttgcccacgttgagtgcgacacgatcatcatggatgaccaatcgtcgagtgatacggtaccgtttaacgagattaagagtgataatgtttcgctggaacatgaggcgaaggtttcaaaaatctcggaagagcaactatactatctgatgagccggggcatttcggaagcgaaagccacggaaatgatcgtcatgagcttcattgaaccctttacgaaggagttgccaatggagtatgccatcgaattgaaccgtttgattgggtatgaaatggaaggatcaattggataagacaactaaaatggaccacgcagagatgcgtggcccattttagttactgaattcctaatattaatttaatttcatcgtccgttagtgagcccttattttcggtaccactgagaacttgatcgacgaaatcacgtttcttttcctgtaatttgtaaatttgttcttcaatagttcccttagtgatcagccgataaacatcaacttgattcttctgtccgatccggtgtgcacgcgccgtggcttggtcttccactgcgggattccaccagagatcgactaaaattacgaggtcggcgccggttaaatttagtcccgtgccaccagcttttagcgaaattaagaagatatttttctgccctgcattaaaggcatccaccatttgcaaccgatccttgggcttggtatcgccctttaaaacgtaagcggagaggtcgttttggtgaaggtgctgttcgataatatcgagcatgctggtaaactgcgagaaaattagcacgtgccgctcactatcgaccgcctgccggagaatttcatcgagttgctccagcttaccagaggtttcttggtagtcgtccatgtagagggcgggggtgtcacaaatttgccgcagacgtgtaagccccgctaaaatttcaatcttgtttttgacaaacccgtcgtttgagaggccgcggactttaacctgcatctgtttcaattgtgccaaatacaccgtcttctgttccttggtcatctcgtttgtgaggttcgtttcaacctttggtggcagatcgtgaaggacggtttgcttttcacgccgcaggataaatggtttgacccgcaccgcaatttcggcgggggataattttttaaaggcctttttactttgtaagagtccgggcatcactaaggcaaaaattgaccacagttcttccgcccgattttcaatgggagtcccagaaagggcaaatgtatttttaggggttaacttacgaagactttggttggttttcgtacccccgtttttgacgaactgggcctcgtctagcaccatgtaattcagatcccggtgttcgtatagatcgatatcacgacgagcactgttatagctggtaataaggacctcgatcgtggggtcttgaatccgttgccggcggtcttccttagtaccgtcgacgaccgcaacccgaatggcgggggcgaattttttgaactcttcgagccagttataaattagcgaagccggtgaaataatcaggtcaacacgctggtcgctaagatgattattcaagaaagtaatcatctggagcgtttttcccagtcccatttcgtcagccaaaataccaccaaaaccgtgtgaatcaagcatttcaagccattttaccccggtaatctgatacggccggagcgtcgcgttgacagggcgttcatgacggatgtcgaatgcttcgggatgggcgagatcatgggtaagcttttgaaattgagcgtcaaattctgccgtctcattcagtgcagcctgaacggcaagcgcttgggcggcgtgaaggtgtacctgaccgtggctaatttgaccctgagcacgaatattagtgagggctttgctgactttttgaagccgatcgtcgagtaagacgagtgagccatcagcacgggtaacgtatggccgattcgtgtcgagttggttcaaaatctgatcaacttcggtttcatcaatcccggtaaacgagaagttaaccgatagcaggcccccattttcactcacgttaatttgtggtgtgagcgctgctccgtcttggagcaactggtcgagttcgtctgaagtggttaccaccccgttgagccggagattgggtaactcggcaacgaaaaattggtagagtgtttcgggatccgcaaaggctttgcgccattcccgaccgacctgtatgaatcccagagattcgaggtactgtcgggcctgttgttctttatcaatattgcgttgttggctatcgagttgatccgcgtcatagctcggcaccagtttgccatcgtaatcgtaagccagcttgagcacgatcgtttgatcgtctttatcgaggtcaaaatggggttccatggtggcttccgccatttccgcgggggcattaatccggccaatttgagcgaaatatttgagaaaatgatgcagactgccgatttccagatttgtgaagtggagatgggtattttcgagttgactgtcatattcgtagcccagagcgcccattgaactaccatgaagtagcagattgctgatgatcccaaattgaagtgcggttgcttggtagaactgattgccgacgatgatgattcgatcggcaggaacaacggtatcgtattcttggcggaacgaaagatcaaatccgtcatcggtttgatcaacggtggcttcaaaaatagagttatcgggcttgaacgggacgatctggacgtcactaaatgaatgctcgtcgtataacgaactaaattcaaaggtggttagcttaggaatgagttgtgccaaccgtgctagcgttcccggattgagaagcagatgtttacggcgctcgttttcggagccgttaaatttttgcggttcgatttcctgactcgctgtcagcactgagagaagttgctgctccgcttccggaaataccttgggtgaaagacgaaagcgccgtttacccgacgtctggtaagtttcttcgcgggcgtaactctgcaaaaattcggtggcgttcgcgaccatgtaaaacttatggtcggtttgatcggccacgcgcaaacgcataaagaagcgattttcctggtttccccatgcctcgccatatgcgctaatggtcaaggtcacttcgagttctagtggccgaagactccagccgtcgaggggctggaagtattgtacttcagggagatcaagctgttctaaaaattgaatgccgcttgatttttgttcccggtggcgagctatcttaggggccgcgaatccaacgtcaggcgtgtcgtcgaccagtttgatgttggctggattggtgaaataagccggccatgcgtctgggtcagcacggagccggttgtagtcttctttgtgtcggtagaggtactgagcaaattcgggatgtgccaaaagttgttgttcaaactgccgactggtgtcgacgtagtcactgggaaatttttcttgaaagttatcaaatagatcgacttcttgaaagagtttttcgattgggcggtgctgtgatttgagtagccggacaactgccgcgatgtgcttacagtagccatgatcgggaaaatagggacactcacaaaaatcattgtcggcatccacgccaaccgtgacaccgtaagggctagtgccgaacacggttgcctcaaccgcccgactttggttattaatgtaatcaatgcggacgttgccctcttgcgcgatcttttttccccgtgtccacatgatgcttggcataattcttttcgccattatgattgattccccgcttgttagttaataggaaaagtttaacacatttgggaagctcaagggtacggatggacactagtaatggtgtttcacgtgaaacatttgtggttggtgaaacacaaacggaccgtgagtgagcccaccgtccgttaaaattagtgcgttttacgatctcgaataagaatcgcgctggctgcagcaccgataatcattaagatggcgattgtcataagcgtatcttgcatgccgactttaaaggctgtgtaaaccacgtatttcacgtcaccaaagatgggaagctgtttaaagacgagcgcttgtttactatcaaaaatttggtttccggcatacgcaccggcctttttgaaaagatgtaatagttggtgaccgtactgtgcaggaagaccgttaattttcaataaatgggtcgaaagatgctggttatagccggcggtcaatcgaagccctaaaatgacgaccccaaaagaaataccgacctgacggaaaacgtttaaaattcccgatgccatccccgtatcttcggcagccaccgcacccatgacggcattggaaatgggaggactgacaagggcgttactaattccaagcagaacaaaaccgatgatcaaagccgtccacttgaagggaacctgaacgaggtgatcgatagtaagcactcccgcggccccgattagcatggcaatggtgatcagccaccgattgccaaacttgccggcgagaattcctgccaccggtccgacgacaagggcaaagccactaatccacagcatgcgcactccggtttcaaacgcggaatagcccatgtagttttgcatcaaaatgatgaggtaggtgaagcctccgtaaaggccggctcccagcgtaaaagctgcaatgttggcaccgacaaatgaaggcgaccggaacagttttaatttcatcattggctgttgcgtgcgcgtttcaacgatgataaataggatgagggccaccacggcgaggataaataagctggtgatatgccaattggtccagtcgtacgaggtgtgattttccttagtaatcagtgcaaaaattgcgccaaagatcatgatgatgctcagcagcatgccccaccagtcgagcttttcatttttttggtgctgcgtgtcagtgatcacgaaaataccacagattactgctagagctccaattggaaggttaactaggaaaatggaacgccaaccaaacgcggcgaccagtgatccgccaattagtgggccagctgcaacggctaacccgactgcactactccagatgccaagggccacgccccgttgcttagcaggaaaggctgccgtcacaatggtgagagagagcgacatcattgcggcgcccccgatcccttgaaagccccgaaaaatattaagccaaaggccatctgtggcaaggccactggctagagagccaaccgcaaaaatgagcaggccaataatgaaaaccaatttacgcccccaaatatcaccaagctttgaaattgggaggagcatgacggcgtaaacgagggtgtaggcgttgagaacccactgaagggtggtgaatttgacattcaaatcgctttgaatatccggcagggcgacattgacgatggtgatatcgagcatcgccatgaagacggcgagactgacagttcccagtacccaccatttttttgaagttgattgcataggtaagactcctttgtattctttagtgcgtccgaatgcacatatggtccaagaaaagagcactcatttccggttgagggacatcagtgctttcatgttatcggcggtcaccgaaaatttatccgcaacgaattcgacgttgacttgatagtaaacttcgcggccgtctttgcgccgctcaactgccccaaagcgatggagcatatcgagatgacgagaaataacggatcgattttgcggaaaattttcggcaatcgcgccaatggtcatttcgccattgctggctaaaaagacgattaaattacttcgaaccggatcaaaaacagcacggaaaaagggaatatcaattttttcctcgatgagtttttgacagtccgctggattatattgtggtttcatctgcatcacctgtgagtattatatgtgcttttacatgcatatgtcaatttgaaatcgacgttatttgcgtatttttgataacctatattgaaaaatatctaaataggtttgccgccacgaccaataacatgctataatctatttagaaaatattctaaataggaggggtaaccgtatggcaatgggaacgacgctcaaggcaattgcggatccggtgcgacgacgaattttggaactattgaagacgcggagttattcggcgggggagcttgcgacacagtttgatctcaagcaggcgaccgtttcctaccatttaaaactcctgaaggaagccggactgatcacggaacagcacgagaaaaattttatttactacgatttaaatacgagtgtgtttgaagaggtactcggttggatttatagcttaggagggcatgacgatgagagcaaataaatggcgtgtactaaccatcaccagtgtgattattttagctcctattttgtacgggctcagtctgtatgatgagttacctgccagaatggcgattcattttaatatcaataatcaacccgaccagtgggcggccaagccgtttgtcctgtttgggctcccgattttactgcttgcgttgcaatggatttgtgttctcattacggccgctaaaaccaaaacgcagcccccggccccacgattggaacgcgtcgtttatagtatcgtccccgtgatcagcgtggtggtgtacatcgtgacgattcagtttagtctcggtgccgtaaccgatattcggcgcattatcttgttactgattgggctggtgtttattgcccttgggaattattttccaacggttccagtggaaagtcagtggtatgttagtcatccccatccccggatcaacgatcgtgatctctggcgcaaaatgagccgccaactcggatacgcctttgtggttggtggtattttaatgattgtgaccctcttttttgcgccactggtttcggccatttgtctggtgctcgtgattggctggattttgggtctttccttatatagttggtacaagagtcgccgaatttcgtcgtaattattaaacggacgtccccgatattatgggggcgtccgttttttgtaaacacaattagttacagttgtgttgatatatcgcccacggtctggttaaaaaattgtgcaatgtgggtgaaagaggcacttatccgttgttgctgagttgctgtgagggggtgccaggggaaaagggtgaaattaatcttgcgacccttaaactgagatttccaggtaccagcaacttgcccgttgataatcatgatggggttgagaatgccattcagggtccataaatcagactggtgctcgggcgttacgagccactgtttgtccacgtagccggtcatggtggcatcataaccacttgttaggagcagttgatccgtactttgatcgaccaactcggcgaggtgggtggctgagactggttcggtcatgtagaggcggtgtccgtggtagtcaattggcacccactgcgatttcaaccgctcccagacaggacgtacgagggcggcgcgaatgccggcccatttgacaaaatcggccatttcaacgggaccaaatccgacgacgtagcgtggaatcagttgttcaagtgcggcagcgggtgatagcccacttggcgtagccgcgtgaatgacatacttcgtggtgctggaagccggatcaaagtaggcgccgccccggttcataatcgtttgtaagatggcgtagcggagctgattggctagtggttccttggttgcgtcgtctaaaaaggcgttaacctccgccttggtgagcggtgtctgttgcgaaaggtaggcttggaggtccgtggctaggtcgagaatcaactgtttttgtccaaggtagtaggcagtcggtagctgttcgtgtgaccgtgcggcaatgaccatttcccagtccgtgtagatcaagagttggtgggtccaacgttgcgcccagctccggacaacgggttggcgttggtaaacctgttgtaggtcggccacggtggcgtgctgggtacgtaaggcgataccaacctctgtttgacggggttgttgcgcctgcattccgatcgttgtggttaggagttgggcgatgtgatcggttggctgaaacttaccttgatgatctaggcgcagtaagaagagttcagatggtgtcatggaggtgtcctttcgggagaattagtgctcatagtatagcacggccgttgatggtgacggggacgatcatagataaaagttgagccaactgatccattcgagtgggagttctggtacacttgacctaattgacaatcaaaggggggagcactatgagactgagtcggagacagcaactcgcgattgtgggtggcattctgggtgttgtgctactgggactgctagtatggcactacattccggcgttgcgcttaattggaagcgaacagtttagccgtcggcattttattcaactatttcgcggtcggggatgggtcgctgtggtgcccattacgctattagtgacagtggtcaccatgattcccggcgcacccagttcggtggtcgcgattctcagcggcgtgtgtctcggagcccccttgggatttgcggccaatgtggtcggcattagtctcggcaattccattggttccctcttcattcaccgtcttgaagatttacggaagaaacaaaaacaatcccgtattttggacgatctactgaaaatgcgacatccgcggattggcgtcatgctgggctacgccgtcccgtttattcccaatgtattggtgcactttgcggccggtaaactccagattgaacggcgctcgtgggagttgctcattttgattgggagtgttccgacggccttcttctacgcgtttggcggggatgcggttttgcacctaaagctcagccgtatcattatcgcggccgttgtgattggtgcttctgccggtcttatctggcttatccaccgcgatcgaaaaataacaacgcaatagactcatcagttagctagttcaatgagctaattgatgagtttttttatggtttgcgttgactttgacggtgaagttgcgtatattatgggtatacaaatgaacgactgctcatatgtgcaaaagtgaatgtaagggggttcatgaaatgagaaaatacgcaccactttggctatactttgtcggtctcgggctgtttttaatcgccttgttgttgccgacatcgctaaacctggttcaaatcattttaatggttttaacaactttcgtggccggttaccatgtggcttgggaaggcatcgaagaaaccattgaatgtaccaagcaacgtcatcgcgtgaccctcaatattcacgtcttgatgtttgcggcggcccttggtgccatggtaattgggagtttcacggaagcggcccttttgatcttaatttttgcaggtgctcattttttggaggagtacgcggagaacaagagtcgcaaggaaattacatcgttactcaagatggcccctgttgaggcccgtcggtttaacgcacagggtgaaattgaagtcgttggtgttagtcagcttgaaattggggatcgactccaaattctgaatggcgctcaggtaccgacggacggaacgattagtcagggaattgccagtattgatgaatcatcaatcaacggagaaagtattccccgtgaaaaacaggtgggggacccagtctttggtagtacgattaacggtaattccacgtttgagatgaccgtaacgaagaccagcgacgagacagtatttgcgaagattatcacgatggtggaagccgcgcaggcctcaccaacgaagacggccacgatgatccaaaagttcgaaccgatttacgttaatattgtgattgctttactgccagttgtcttgctagccggtccgtatctgttgcactggagctggacgaccagcttttatcgaatgatcgtcttcctcgtttccgcttcaccatgcgcgttggcagctagtgctgtccctgccacgttgtcgggaatttcgaacctagcccgtaacggcgttcttttcaagggtggtgccttcctatcaaatctggcacaactcaaggcgatcgcgtttgataagacgggcacactcacacagggaacgccggccgtgaccgatcattatttcagtgacgcggtcgaccaacttgcattaacgcaggttatcgtagcaatggaacagcaaagtaaccatccgctggctgaagcgattgtggccggattcagtgaagtgaccgatctcccaacactgacgtcagaaaatgaggttggccgtgggttaacggcgcactttgaggggcacacctatgtgattggaaagccggggcggtttactgacgtggcaccggaatttctcagtcggtttgaaacgcttggaaagcaagggaagaccgtggtgtttgtcgcggtagatgatcaagtggtcgggctaatcgcgatgatggatctgccaaaagaaagtgccaaggaggcgattgcctacttcaaccgccaccaagtagaaacggtgatgattaccggcgacgctcagcatacgggtgaggcggtggcgcaaacactgtcgattaagcgagcgattactaatgtgttacccgaacaaaaggttgatgtcattcaacagatgcgtcagacggcccagccgatcgcaatggtcggcgatggagtcaacgatgcgcctgccttagcaacggccgatgtcgggatcgcgatgggttcgggaactgacgtggcgattgatgtcgcagacgtggtccttgttgaaaatgatctttcgcgactcacatacgctcaccgactttcgaacaagatgaaccgaatcgttattgaaaacattgtcattgcaatgtcgattgttgcgttattgatcgtactcaacgtcttgcagattacggacattgcttggggcgttgcggtgcacgaagggagtaccctggttgttattttaaatgggctgcggctcctgctggtccggcgaaaataatttttccaaatgagacgaagtttggtaaactatggctagtgcaaatgaggagaacggcctaatgaacgatgataaccaaaaaaagaatacagaaattgaaattcctgacgatacggaattacaaacgattctcaatgttttcaaaacgatgagtgatcctacccgcatgaaaattattttaaccattgctaaaaaaccgatcacagtcaccgagattgccaaagcattatcgctagagcaatcaacggtatcgcaccaattacggcaacttaaacaggagcgactggtcattggtgatcgatctggtaagcaaatcttttaccggttggctgatgatcatgttttacaaatctacgcgctcacgaaaacccatattgaagaaaaacacgaactagggcattagtgtttcacgtgaaacaaaaaaatcccggcagactaactgagttagtccgtcgggatttttgattacagcttaccagagatattcaacgggatttttaatatatttatcgtaaacgtcacgcacgatggccatttggtcatcggtgagcgctggtaattcagcagcagacgtgttgcgctcgatttgtgaagccttgctggctcccggaatcacagcgctcacggcatcatacattaagatgtaacgtagtgcgatgccggccagattgtcagtgtgcaagcgttctttgagttcctgagcggcggtaacaccggtatggtagtcaacgccggagaaagtttcacccttgtcaaaggcggcaccatcccggttgaagtttcggtggtcgtctttttcgaagtgggtgtcgtcggtaaatttaccggttaagaggccgctagcaagcggtacccgagctaaaattccgacattgtttttctttgcgaggtcgaagaagaggttggcgggacgaagacggaacatattgaagatgatttcaacagatgaaatgtcgtagtccatggctttgatggcttcttccacgcgttccacgctcacaccgtagttgagaattttgccttcttttttcaagtcatcgagggcttggaatgtttcgggcgcatagtaggtcatgatgggtgggcagtgtagcaatacttgatcgagactatcgagtcccatgttcgttaagctttcttcaacataccgccgtaagaatttgggactgaaatgttctgccgaaagcggcatttctttgcgtccaattttcgtggtgaagtggacgtcgggatgctttttaacgaaggcgcccacggttttttcactgtgaccgtcttggtaaccgtcggcggtatcaaaaaagttaacgccatgatcgtaggcggcttcgagggtttcctcggcgtctttaggatcaaatggggcgccccatttgcctccaagttgccaagtgccgagtgagacttcactaatattaaatccggtttttcctaattgacgaaattccattataaaaactcctttatgggtaatttgactggttaattgtagcgcttgcatttagtatatacgttgaagtatgcttcaagtaaagtaattaatcaagaaaaacggagaattaaagaatggaaacttatacgattaccgaagtcgctaaaatgtacgacttggcgccctcaacgctacgctattacgaacggattggcttgttacgagatgtggatcaggagaataatcatcgaatctacaatcggcaacatctggataagctgaacagtattttgtgtttcaaaaattcgggaatgtcgatgaaagagctacaagtgctgttgcagtacaaagagaccggtgatgatctcaatcaaattttagacctgttgaacgagcataaggaaaaagtggaaacccaattggcacagttacaaaaatatcaacaacacattacgcaaaaggtggccttctattccgatattaaagcggcggaagaacaccacacgacgttaccggactggaacgattataagccagattatgaggtttaatgattatatataactaatagtcgacggaattatgagaacatcatgagatccgccgataaattgtgttcacccataatgaagattgctaaaataacgaagttaggattgcatgttcaatccagtttagttatgggtgggaataaaaatgatgaataaaaaattaagcggccgcgacatgctgtttattggtatgatgcttttcggcatgtttttcggtgccggaaatttaatctttccggcctttgttgggcaggaagccggtactaattattggccggcactaattgggtttctaatctcaggcgtggggttaccacttttaggggtggcggctattgggatcacgaaaaccaacggggtctttagcctggcacataaggtcaatcgagcctacgcctacgcgtttacgatccttttatatctttgtattggcccgctcttcgcgctaccgcgattggcatcaatctcatattcggtgggtctaaccccctttgtgtcggtacatcatcagagtggcggactgttactctactcggtaattttctttgcggtggcctggtggtttgcccgtaaaccatcaaaaattatggtatacgtcggcaaggtactcacacctgcatttcttgtattattaggcattttattgctgatggtcctgatcaagccgttggggcatggtcaggcagcagctgggagctatgcgagcgtcccactggtggccggatttacggctggctactcaacgatggatgcgctagccgcactagcatttggcattattgttgtgaacgccattaagggcctcggtgtgacgcagcccacacaaattgcccgcgatacgattcgggccggtggcttagcagtcctactgatggcggtcatctatggcctgttagccctactaggacgcaacgctctgggaccctttgcccgcgctgaaaacggcggccctattttagccaacgtggcgcacgcatactttggtgatttcggtaacgggctgttagcggtgattgtgattattgcctgtctcaaaacggcaatcgggttgattacagcgtttggggatacattcaaggaactattcccacgggtgccgtatcaattgctgattggaattgccagtgtggtaccgctgatctttgcgaatgtcgggctggagcggttattggtaatttcgacaccgattttatattttatctatccgttagcaatcacattaattttgctcggactactgtcgccaattcttggtgagtcgcggtggttattcggaaccgtgaccttattcaccatttttccagcgatctttgacggcctgaacgccatgccagctagtttgcacactggttgggtagcgacactattgcacattggcaattggttacccggattcagtatggggctaggttggacagtcccggctttgattgggttagtactgggactcggattacaacgggtctaccgtcaaacaagataattaatatttagcacgatcaacgaggagtttgttgatcgtgctttttcgttattctaatcgttatatgctgctgatgttaataggatgaacagtaaatgatgttgaataaacgttgatataacaatacgtaaaagggtttacttttttattgacacaccgatataaaacgcttacatttaaattgctgctgagtgattcaaatcaaaaaaggggagtatttagatgttgaatttggtgaacaagcattttggaattaagatcgtcacgacgtttgctggcttattagctggtggtgtaattttcggaagtcaggcaccgacgactcaggcgagttcgaacaaaacggtgacgatttacctgacccgccatggagaaacgactgggaatgtgatgagccgggtccagggatctagtgattttccactgactaaaaatgggattgaagtggctaacgacttgggtaatggcctcaagggggttcatttcaagagtgcgtatactggcaatctgacgcgtcaggaagtcactgccgatcatgcgctagatcattctggcaacgatcaggttaaaatccatacaactaaaaaccttcgtgaagggggttacggaagttttgaaggcgatagtattcaagccgataacaataaaattgccggtgtttacggttatgcgaacggcgatgaattcatgaagcaaacgggtaaggattactggaataagcttcagaacgcatactataaactggatcaagaaaactcacaaaatacaaaattagccaagagcgatcgggctgaaagttcaacccaagttcaaaatcgaatgcaaaaagaactgacacatattgccaagacaacccaaaaagatgggggtggtaacgtgttggtggtaagttcgggaatgtcgattaacgaatacctatcgacattgaataccaaaaagtacacgggagcaccattgaaaaatgcagccgttacgaagctagtttacaagaatggtcattttaccattcacggcgccattggttctttgcactacgtgaacaagggtgccgacgaaaccaagtaaatcgcaattattcagctcagcggcatatctgtgaaacgtcgttaccacggttgtctgctcgacaaaccggcaatcaacctgcgacatttctaaaagctcatcgcttaggtgatggggaatttaaatttacacacaacacaaaagcgtctgatcgtttgatcggatgctttttaatgacgatatttttgaacggtatcataaataccgtggtcaataacggaacgcagcaagattagtgtttcggtgaggttaatatcatctgtgccaagaacccaggttttgagggtgtgaatcaccattgtaatgaggagatcactgagaatagttaattcagtgttgggtgtttcatgctggagaaaaagctgctgaaagtgtgaactcatttctcgtttgaggtgttgctcgaaagatggcatgccgtgtggaccaagtaagatactgagaatggggcggttagtctcaaaaaaatgggctgcctgtgccaatacctcgtcattgagttgagcactgcttggcggggctggccgggaggtgatggctgatagtacctgttgttcaatttgatcgagaaggtcgtatttgtcatcgaaataacggtaaaaagtacttcgatcgagaaagatcggcgtcaccaggtcgttcacggtaatcttttcaaaatcggttgtcgccatattatcaagtagcgagtcaataatttgctggcgagtatgatccgttttacgagtatatttcatcaaaatgctcctttttgttacttatcatacagcaaaatcatatattgtgttgaattttcaacatttcgttttattttgtgctggggtctttctcaaaaaccgattagaataaattctcgttatctatatacgaggagggaaagtaatgaacacaactaatcattatgatgtcaacgggaaaccctatcatcgtggactaatgttagccttgtcgctgtttgcaacttttgctgcagcactaatgcagacatcactcggcacggccttaccacggttgatgacggtgtttgacatcaatttatcaaccgcacaacaagctacaacttggttcattctggcaagcgccattatggtacccatttcatcatttttaattaagaaattttcggttaatcagttatccataatggcctatatctgcttagcgttgggagtcgcaatttcagcgtttacaccggcacagcatgatatgtggctactctttgtatttggtcgaatcattgctgccttggccgtaggggtgatgatgccactactacaaattattattgtcaatatttacgacgcacaagagcgcggcactgcgatggggctgatgggactcgttgttgggatggcaccggcactcggcccaactttgacagggtggattttggatcaaaatcacgtcattttcggcttaacgatttctaactcatggcggacgatattttatctgccactggccgttattgtgattgcagtggtgttatctccatttttaatcaaagatgtgatcaaaaaagaggatgtgtcgctcgactggctatcactcgttttatccagcgtcgggtttgggctcttcttactgggattcacgaatgtttcgtcagatggttggggagatcttgcaacggttgtcagcccaatcattgggggtgttttactcattggtctgcttgtttggcgccagttaagattagaagacccatttttagatgtacgggtttttaagtctaagcgtttcacattgaccaccctcgcgatggtgctttcgacaatggcgatgatgggggtagaaatgatgcttcccacctacctacaaaatgttcacggattatcggcattagattccggtctcaccttattgccgggtgccttattgatgggcctgttttcgccaattgcgggcaagctctacgaaaaggccggcattcagaggctaacaattgcgggatttagcatcttagcaattgggacgattccgtttgccttcatcgatatttcgacaacgacgtttacaattgtggtgatgtacgcactacggatgattggtattgcgttggtattgatgccactgacgactgaagcgatggctgctttacccattgaaaaggcaacggatggtacggcggtcaataatactgcacggcaagtggcttcttccgtgggaactgcaattttgacctcgattacgcaaaacgtcatcaatcaaaatgaaccggcaaaacatttgaaaacattaaatccactcaaatatgcggatcaatatttgaatgcgtcgatggacggatttagagtggcctttattgttggtcttggttttgcgatttgcgggttaatattagccttttggttgaaaagccattcacaacgagtaactgatggggagggagcagcatgattatttgggttattatcgcgctggcattgatcttaattggaacgataacgctgattaatgcgcgagcgttgcgttggattagcagtctcattgtcgctggtctactgctactagccgttggcgcggttagtgcgaatatgtcatcgcactggggcatgcgtgttgaaacaattacgcataccaaaagaatttactcggctggcagcaagcagtcgcccatgagcctcctcatcacaaagcaggttgggacgaattcaggccggtatgtcatgatgtataaaacccatgctgccgacgctaaagccgccgcacactttgtacccgatacggatgatacggttaatgctgttaaacagaaggcaacgtatcgacggcgtaacgttaagcaagcaacggtgacgacaacaaccaaaaaatgggtttggcaatccaaagcagctcaattttggttgcaggtgggtgacagccacaaccaactaattagtcgacgttctgttgtaactgtgccacgggagacgtggttagtattgacaacttcccaggcaaaacgcttgggcgctgtgcaagcaaaaatgacgacgaatcaagcgcaaacggcacaattgaaagttgtaattgggcaaaaggttgcccagtatcaacaacagcatccaaccgcgagccagcggcaaattgaacaatacacaaaccagcaaaccgccaaagtaacgatccaacaacttaaaaagttactcgactaggagattagtgaccatgccaagattctcagccagcctatttcccgggaaatagactggcaaccgttctgagctagtataatgaaattaaccttgatacggtacagttagggatggtgatagaaatgaaaattggagatcaattagttttggcacggaaacgccagcagttaactcaacaacaggtggccaatcaaattcatgttgcacggcagacaatttcgagttgggaaaccggtcgaagttatccggacattgcgagtttaattaccttaagtgaactctatcatacggcccttgatggtttgttgaagggggatcaggcaatgattgaggatctgaagaaaaaagaagcagaattaaagcagtcgcggcaaatttactgggcgtcactaatggtggatattctgctcgtgattgtactcggaatggcagtgttaaaaacgcgattttttgagttggggtccggccagattttaatgattagcatgattactctcgctaatttagtggttttgataaatgcgacgagtcggtatcgtcagttgactaaacggcaaccggtcgcggcaagccactatggcatcacgctactaatcatcctaattttggtgaatggcgtcgcgatatattggcgaggattggatgcatggacggctggggtccttaccggcactagtgtggcggccgtggtcgtatggctatccgcgttgctcgggcgaaattcaaaataattttgggctcgttagttcttgttaaagacaggaattaacgagtttttttaatgatctcgtaaatagtgacgaacctcttgtgtcacggttagtgaacaggtagtattttattatgtaaaaatcgggttaatgagggatatgaccctgataattgcggacactaaacgttactattgggaggacgacacatgttagacgaagaaagtaaggtaaccccagccgagattcgtgggtggaactggggcgcctttatgtacaatattttttggggtattggtaataaatcgtatctgcccctgctgtgcttaattccagtttttaatttgatttggatttttgtatgtggttttaaaggtaacgaatgggcttggcaaaagggcaattatcgtgatgttgaaacgttcaaagcggttcaggcaacgtggaatcgcgcagggctgtttcaattcttactggccattgtcggtgtgttattatatgttttcgtgtttgcagcagcgattgcttcactttcaagtacttattaaaaaagacatattagttggtttgaataccggctaatacgtctttttttgtcgcaaaggtgggagtctttgcaaggagtttagttgagaaactattgacgaaataaaaaagtgagtatatactcactttaaaaggtgagtgattaatcacttatattaaaaatggaggaagagcaatggcaaatgcaattattgaattaactcatttggtgaaaaagtttgggaaacaaaccgtgctggaagacattaatttgactgttcagtccggtgagattgtgggcctgattgggccatcgggtgctggtaaatcaacggttattaaaacaacgttggggatggaagtcgctgacggtgggagcgccaaagttttcaatgaggtaatgccgaatcggggattactgagtcgaattggctacatggcccaaacggacgcgttgtacgagtcactttcagcgcgggaaaatttaaagttttatgcccaaatgaagggaattgcgaaggatgagatcaaaacatcgatcgcccatgttgcgcaggttgtcgatttgacagaggacttggataagcgggtcacgaactattctggtgggatgatgcgccgtttatcattagccatcgcgttgcttggtaatccagaactattaattttagacgaacccacggtcggcattgatcccgccctgcggcgtcaaatttggaaagagctcaatcacattcgtgacgagggccgttcaattttgatcacgactcacgtgatggatgaagcggaactggtcgataaggtcgcgctactactaggcggtaaggtgatggcgtttgatcaaccagacgtgttgaaagcacagtatgaagctaagtcgattgaagacgtctttttgaaggcggagggggtcttataatgcgtacaattgcaattatgaagcgggtactgaaagagctattccgcgataaaagaacgttagcgttgatgtttgttgcaccgatttttgtattatggctgatgagcgttatttttacggccaattcaacgaccagtgttgatattgcgacggtcaacgtttccagcagtttgaatacaacgctaggggatgtgaaacacgtcgacgtgcatacttatagcacgcaggccaaggccaagacggcactgaaggatgataaggtggacgccattattcacaaaaagggcagtgattatagcctgacatatgctaacacggactcgagcaaaacctcagccgtgaaaatggcctttaagacggcattgacggctactaatgtgaatggtatgaagcagcagttgattttggcgaaggcaaccattgctaaattacaaagtacgttaccggccagtgcccagacacaactggcaacgacgaccaatcagaccaaccaatcaacggccgcaacgcctaaaattaccaaccactacgtatacggggatgccgataccggcttctttgataagatgctgccaattttaatgggtttctttgttttcttctttgtcttccttatttcggggatggcgttgttaaaagaacggacgagtggaacgcttgatcgcctactagcaacccctgtcaaacggtctgaaattattttcggatacatggctagttacggtattttggcggtgattcagacgatcgtgatcgtattggcaacggtctggttactgggggtcgaagttgtcggtagtatgattggtattatcgtgattaatctgattttggcactggtcgccctctcatttgggatcttcctctcaacgtttgcgcggtccgagttccagatgatgcagtttattccaattgtggtcattccacaggttttcttctccggcattattccgatggattcaatggctagctggattcaagatatctcgtacgtgattccaattaagtactccggggatgcggtgacggccatcatgatgcaaggaaagagcatcctatcactaggattagatatcggagttctattgattttcttggtcgttttgaccatactgaatattaacggtctcaagcgttatcgaaaagtttaagggatgacaacacatgaaacaggaaatttttgcgagctataaggattggctcaacgaacaaaaaatgccaaagggcaaacgagctgcactgctggcggcactggatctatttgcgaagaacggttatgacggcacggcgacgatggagattgccaaacaagccggtgtcagtcaggcaactatttttaagtatttcaaaacaaaggatgatttgctaagggccatcatgattccgtttgtaaataatttgctgccggattataaggatgattttttggacgccattcctactgaaccgactattcgacaaatggttcattttttcatcaataaccggtacgaatttttaaagcaaaattcggaagccatcatgattttcttcaatgaaatcattactaatgcggaagtacggacgttgtttatccaatttgcccagcaaacggaaccacaatttctagaagtcatttatgctaagctgacacaaattggaactttacggtctggaatgacgccaatggcggtttttcgaaccattggggggcaattattgacctactttttccagcgagaaaagttactgccatttgtcgccgccgatgaggccgcagatctggctttgattgaaacgatcgttgtgcatgccatcagtactgaagaataaggtgtttcacgtgaaacattgtgcctcaaaaaagctcaccgtttatggtgagcttttttgagtgattactattttccaatttggaataggttgtaccaataactgaattgttccgacttaggtcgctctgtaaaattaatcgtattgagaaagaggaggaacaaagcatgccaattggtgtaattgtcaattcgttatcgatcttattcggaggaattttcggtgcgatcggtggaaaatatatgagcgacgactttaaaacgaatattaacatgatttttggtgcctgttcgatggcgatgggggtatacgcaattgccccaatgaaaaatctggcagccgtcatttttgcgaccattattgggaccgttttgggactggtcattcaccttggaaaacatgtcaataacggtgcgatggtgatgcaacgaggaatttcaaagatcatcaaaaatacgaatacgtcaatgtcagatatcgaattcagtgccgaactcgtaaccgtgattgttctattttgtgctagtggaacgggaatttacgggtcactaacggaaggaatgacgggtgatacatcgattttgatttcgaaatctgtgttagattttttcaccgcagcgatttttgcgactaatctaggatacgtggtgtccgttatcgcagtgccccagtttatcatttttggcgtcttgtttggcatcgcgggatacgtttacccactgacgactcccgcaatgattctagatttcaaagcggtcggtggattactgatgctcgcaaccggatttcgcatgattaaggttaaaatgtttccaactgcagatatgattccagcgatgattctgattatgcccattagttggatgtggacgacttggatcatgcccctgttataggattatcttgaggctgatgttgttggcaaaaatcccagaatagctgggtcgctgtcgtgtgatgatctttgcatttcacaaatgcaagggtgcttgtaacggtctcttcgagtggtcgcatgacaacggacgggaagtcgtaaagatccattgatttttccatcataatggaaacacccatgttgcgattgatcatatcgagaattaggtcaatccgctttcctttgtaactaattttcggcgaaaaaccggcctgttgggccatcgcaaggattggatcgtacaattgggtcagttcatcgagcagtaagaaaggatcattttttaactctgttatattaatggtttccttttgagctaggggatgcgttttgggaagaacgaccacaaactgatcggtggcactgagcagaacttcatattggtccggtagcggtgtgaacagacgcagaaaaataatgtcagctcgtttctgatcaagtgcgttgatgagtccttggccttcgtcttccgcaaaggtgaggttgattttaggataagccttttggaacgcgggcattaaattaaaaacttgataacgagagatggacggaatagcccgaatattcagggtgagctgttcatcttttttgtgttgttggagttgggtcaataattgttgctcatccgcaattattttctgagcgagtggtagtgcgagttgtccggcctcggtgagcgtaatttggcgatgttcacgcgaaaaaagttgggtgtcgagccccttttctaaggattgaatatgcttagaaacggttgcttgagtgataaacaaattttccgcggtttcggtatagttcagggtgtgggcgaggtcgataaatgttttgattttaccggtatcgataatgggtcacctccatatagcattcattataacctatttattttagtgaaaagtggtgttggcgtagaaggtatgcatcaagcttttctcggtaataattctaaatagcgggctgctttgggcatattaacgtcaatgtcatcattcggtcgccgtccgctgggccagtagtgccgccaacttgatggtcgtgttgcggttacgaatgctgacgagcttgtagtacggttccggtaacattttggcgtagagcgcgcgggagtaattgactttttgtggcgaactccagaagataacgtgcggggtgatggtaatctggtcgtacgccgtcgccttggcctggatcagcgcgtcgtactcgggctggtatcccggtagcttgaacagcgcgttgtggcgaatgtcaccgggggcaccccaccagttgggtgcggcggctacgagtgaccggtaggtggcactggggataacggtaaagctaacgggccagtcgtagttggcggtcagcacctgggcaacctgttgcatgacgtcggggtgggtgcttgtgaagagcacgttaccgctgttgatgtaactttgcacgttggtggctcccgccgccgcgagctgggcgcgcaggtcggccataacgacgcgactgttgccgccgacgtttaccccacgtagtaataataggtagtccatagcttgcctcgattccggtgaccgcagcagcggtcaccttaagttactgtaaattatagtcatattatgcgtgcacaacaatgagtatgtgtgttcatttagatagatagaacgggcgtgcttggaaaattgattctgtaacttaaaaaatgactaattatgctagaatccgtttacattttcatgcaaaacgcatatgctaatgactaatattgtgaaaatgcggaacaggagatgcctaatttgagtctactaatgttactattaccggcgctaggatgggggcttttaccaccaattgtgtcaaaaattggtggtcggcccgctaaccaaatttttggaacggccctcggactactaatcgctagtattggggtatttgcggttgtgcatccaacaacggatgctaaaagttttatcatggcgttactcgcaggggccttttggattatggggcaggtcggccagtatattggctatcaaaaaattggtatttcccgaactatgccgatttcaactggatttcaattaattggaacggcattaattggtgttttcatttttggtgaatggtcaacaacggtccaacgaattgccggagtttgtggcattataatgttaatcatcggtatctggttcacgtcaatcacagatcaatcggatggtaagggcagtcgcggtgttattttacgaacaatcatcatgttattgtttacgacgattggatattgcatttatgaatcaattcctaaagggttagaaaactcaggattggcgatttttttacctgaatctttggggatgtgtctgggcgttatcgtatatctaatttttagtcgtcaactcgatgcgtttaagcaaaaaacaagttacctgaatgcaatcggtggtcttgtattttcgattgcggccgtatcatatattttttcggtacgcgataatggcgtgaatactgcctttattgtctcgcaagtttctgtcgttatttcaacattgggtgggatgctcgtaatgcatgagcataagagtcaccgagagatggtcttgacggtgctgggattagtcttaattattgcaggagcatttacgacatcgctattctaagcgatagttccacgtgaaacatattttgaatttaaaggggttcaaccagtgattgaaaatcaaacgcttgccttcgatcaaatcgaagaaaatgaaacctatcaaaattgtcattttactttttcgaatcggccgattcgcttgatggacgtgacattaattaaatgtacctttgatcaacaagattttagtacgggagaatttgtcgattgccagtggattaactgcgaattagtgaataccaattttgccaactgtgtgttttacgacaaccggttcacaacgtgcttgctgacgggggttgattttagtaataatgactggaaacaggtcgtggtagaagcgtgcaaaaccgactattttaatgtttcgggttctcgattaactaactgtcaattcaaccatagtcacatgatcgcatcttattttcaagaagtgaccgtcaaaaaaggactcgtatttgatcactcggagatcgatcagaccgattttacgggaactgcaatgactggaattaatttggcagatagtcaatttagcgacttaatggttacgccggcgctcctacgggggtgcaagattaatgcttatcaggcagccttgtttgtggccctgattgggatggaagttgtggactagtaaaaaaactgccgtcatttcaaagcgaaatggcgacagttttttgattggtctcaaaattagcgattataagaacgatgtccgattagcatcagccatgcacatagtaaaattacggccggaactaggatactcaaaagatgtagccagggagcggtaagggcaattaaacaagccccgaggccaaaagttagcatgattgcaccggtggccttcaatttttgaagcgccttagaatcgtgatagacaagtgcatcaatgattgtttcagccaatgtccgcaggttgccggtcatcatcagtggcgtgaatggaccgccattgaggcgacgaaactcttgcagctctgccgccgcagcaaaggacaacaggacggtcactagtacgctaggcaccaagttggctaccagtgcggtcagaagtagcaggccactttcataggccagcacccactgttttcgaacgggatcgggttgcgtgaaacgaggctgcctttgccataggcgaatgaggatcgttcccacaaaaaaggctaaaatagaaataacataatgaagactggtacgaaagtcgccttggcccaagttaacgcccagcaaaattaagttcccggtttgtagtccggcaaagacttcaccatgaaagagatacgagtacgcatcaatgccgccagcggccatggtgagcagtgccccgaatgacgttttttcgtaagttggcatagattgattcatcagaattcctcctgaaacgttattgtaccactataacactggcatagttgggatgcactaaagcatgctcggggcaatgtgatctacgttacgggcgcattgagttgaataaggccggtggtggtacctagtttgcagtttcggatttagcgatgagagcttcgcaggcggtaatgatggcgtcgggggttggcattggattatgaaagacgagatcgtaggcgtcatcttttggcttaatgcggttgaccccgtatgctacgctgttggcggggacgtccttggtgatgatggcaccggcaccgatgacggaattagccccgataatgattggacccagtaccttcgcgccatccgagatgacgacgttggaaccaatgacgggattacccagattttcccattggttggtgatcttgttgaacttcatgttcgaaccgatggtgacgttttggtaaatcacggtgccggtatcgattttggcagccgcaatgatacaccccttcgcgtgatgcgcaaacatgacggatgggtcgatgtgaacgcagttgatttcacagccgtaatcgtgttctaagtgggtagcagcttgctggcgaacggcgggatcgggatcgaaacagttttggtggaacagtgtgttgaactctgacatataaatcatcctttcaaggttagtggttaaaagttaccagcacgcgaccacgactgtgtgaatcgtgtgcatagtgttgagcttccttagtttgagtgacgggaaaaatacgatcaattggtgcaatgaggtcatgggtagcgagttggcgaataaaagtttgataatgaacaggatcaaacttttcgtgaacgaattggaatggtgtgtggggatcataagtcatgagcgcgatggaaacgatactggcatgaccacagtgcgtggtgagggcgtctagcaacgcagaactaccagcgatgtcgatgattaaggggttgtcgagctgcggcaatgtttcaggcgtgtaacttgtgagcgctggtagttgttcatggaagtaagcttgactactaggcgagacaactgggtacagatgatacgtggttggacggagcatttgtagtaggtacaggccgataaccgaattggccccagtaataatgatgttggttgcagaatgttgcgcaatggcctctttaagagcgagggccgttccgggtccggcagttagtgccgccgcactttcatcacttacatcgtccggaagtggaaaaataaaagctggattttcggatagcagatatgcgctgtacgaaccagtgggattcatgactaggacgcgctggtgcagcaaggccgcatcacggtcgcgaccaacagcgacgacctggcccacggcaccgataccaatcgttcgtggcaggctggtgagttgttcgctggtggcatgggcgttggtttcacgtttccagtcagttggtacgacgggcaaagtcgttactttaattagtacgccgtggtttgtaagcttgggctgtgggatatcgcgatagactaagccgtcgataccgttaaaattggtttgcataatggcaagcataggggtctcctttggaaagtaaaaattgattagtttgtttctctggaaacaatattatcatataatgtttccgtgtcaacaaaaaaatacttaaaaaaataaccaggatgatcgaaattgatgatcctggttaccattattgaaggtgatgctgttcaatttcatgatcgagatgttggttataacggtctaaaaaggcgaggactgtctgtaactgaacgggatcggtttggtcgaaaacaggttgatctcgttgctgaaattcttgatcgagttgttcatgcgtcaggaacacgccccgtccctgaggggtaagccgaaaatagatttcttttttattatcgggtttctggtagcgttcgatgagttcgcgagccatcaatcgcttggtgagcttactgacggctccgcgcgttacaaacatggcatcggcaattttggtgacgttgacgtcctgatgtttcccgatgaattcgatggtgtgcacctcggcgggcttaaatcctttaagctgagtttcaagttgggacttactgagcagtgtgattttatcgaggagggtcgttaaactggcacgaaattgttgctgggcatccataataaatgagctccttttggtgtaatgactgaagctagcatagcagaggtttgtttccgattcaacattagtgtgcggccggtgcgtggcgtttaagaaattgaacgacctcgttagcggcaatggataattgcttgcgttggctgaaggcaattgaaatatggcgggttaatggtggatcaagggggaccgtttgaatatggtaattggtgcgtcgcgtgatcatttcgccgagaacgctgattccaaggtgattttcgaccatcgccatgatggtgtaatcgtcttgggtaatgtattgaatatcggcgtggatatggtgctgcttgaacagttccagtacacctcgtttttcgccctcggtgagcatgataacggggtgctcttcaaaccgtgtgagagggagactggtgtagtggctgagtggactatcactgggaacgatggcgagcatgtcatcatcaataaaggggatggtgatgagggcttttttggttggcagtgcgacaaagccaaagtcgacggtaccagcaagaatccacgattcaatctcggagtagtcaccagtgagtaattctaagctgatatggggataagcttgtttgagctgctgcatgaggggagccaaaacagcggttgagacgctggaaaaggtgccaatacggactaggccagttgtcaggccagttaggcgggcggcctgatcattgagttgctgaaaagcggtggcgagctgttggatataggggagtaattgggatccgtcggatgttagtgaaacaccgtggtggttgcgatttaagagggtcatccccatctctttttccaaggcgttgaccgcttggctgatggccgattgcgaatagtttagaaaggtggctgccttggagagacttcccagttcgatgatttttagaaaaatagcgtacttattcattagcgatccttccagtaatataagataatcttattttatagttcagtattttcatcttcacttatttaactgagtatagcatactgggaaatacataattattacttttagaaggagttcctacatatgtcattagcaaaagttacacactattttcagcagtttaatttgcaagatcgaattactaagtttgatgagtccacggccacggtcgatgaagcggcggccgttttgcacgtcaaagcacgacaaattgcaaaaacgatggcgtttaaattaaaacaacgcgctgtggtcgtggtaacggccggcaacgcacgggtttctaatccgaagtttaaggccatgtttggcgaaaaaccgcacatggttcagcgcgatgttctggaacagacaatcggtcatccagctggcggcgtgtgcccgtttgcgcttcaagaaggggtagacgtttatttggacgagagcttgaaagccgatgaaattgtttacccggctgccggcacggcgaatactgccattaaattgagtctgggagagcttgaacagtacgcccatccgcgtcagtgggtggatgtggtcaaggatcccgagggacagcaatgagccgcaagagtgctttctggctgatgttgatcgtgaccgcagcttggggcgcgtcgtacatgtggatgaaactagcactcaccggagtcggaccactatcgttagttgggtggcggtttggcacggcttttctggccacaatcatcgtcttttttcgggtcttacggtggccgacgaaggcagaatggcgggtcagtctcattatgggaacgatgctgtttagtatgtttgcccttattatgctggggctagaaaccacggatgcttcgaccgctgggtttttgatgagtacgacgacggtatttgtggccgtattagaagcgctcatccaccggacatggccgcggccgatgacgatcatgaccattctcgtcgtcatggtcggattgtacctgctggtgatgaacggtggcgggcttaagtttagcggtggggcgctattttgtttaggatgctcgattctctacgcagcctatattatgtattctggccgactggcccagcgccaattagcaacgctgactgtcagtgttttgcaactgggcgtggccggtgtggagggcctggcgttaggcgcgttgatcgatggtgtccagttaccgacgacggttggccaatggggagcaattttggcgcttggtctgatctgtagtgcctttggatttgtcgcccaaaccaaggtgcaacactatttaccaccggcaacggtgagtttgatttatacgctggaacctattttctcggcgttgtttgcgtacttgatgctgcacgaaattatgactactcgtcaatggctgggagccgcgttaattttcttcagtgtcatggtctccgaactggttaagattcatcggccggctatccatcaaaattaagcctttacttcaagcgcgctttaagcgttatgctaggacggtagcgtggtagcagatacttctgcgcttcatcgaactaggtctaatggctgtgatctggagaaattaattgggatttgaaaccgattattcggtttcaaatcccatttttaatggtggactggcacagtgacgagatactttgtattttatgggacattctgtttcaaattgattctaggcagtcagataattcgctgttatgctgggtgcaatcaatcagggaggaacgtcatattatgatatcaaactcaaaccaaatcaaaattcatgtgctgcatacagggctggttaaagttgaccgcgccctgccgtttcacggtcaatttcgtaatccgttggcctttaccggtcttctacgatccgaaaaaaatcaaattacggtgccggtatccagctatcttatcgaacatccacaaggtcttattttggtggataccggttggaataaggtcgtgcgtgacagtaattggcgtgagctgggactgcaggtccaaatcaacacggggtaccttccggctggctgggcaattgatgagcgactcgcaacgttgggctatcggccggcagacctcgactatgttttgatgagtcatctgcattgtgatcatgccagtggattaccgcttgtgcgcgaagctaaaaaaatcctcgtttccgaggatgaatggcgtagtgctaaccggctaccaatggtttatttaccgcgcgaatggcgggggatcgatgtggtcccctatgccttttcacaaacgtcggtgggaccatttggtaagagttttgatctatttggtgacggaagtgtcctccaagtctggacgccaggtcacgccaaggggatggttgctactttggtacgcggcagagatgggcgctatgtcttactggctgcggatactggatatgcaaaacgttcgtgggaagaaatgattaccccaggaatctgtctgaatcgtaaggacgccatcacgtcgttaggatgggtccatgaagcggcccatgacccgaagtgcattgagacacttgccaatcacgatccacaggttgaacaacacgtcatcacactgccctattaagcgcgatacttaataagcagtggcttcagtaaatcgttcataaaggtagcaatgtctgttacttggccgttttcaagtgaccaacgaatagcggtgagcgcgttggtggcgtaaagctccacgataaatgtggtcggaacggtaaaggaaaattgttgcaataagggttcaatgtggtgtttcaagctgttaaagaaagttgcgctaagatctgcttggggctcgtgaatggcaaacaaggtgagaatggtctggcggtcggcggtgaggtcttggtaaagggccactaatccggtatcgtattcaagggccgttaatcgctgggtgagtagatcatcaaaatgtcgggtttgggttgccacgattgcttctagtagggcgtacttatcaacgtagtggcgataataagtactccgacctacgagcgcagtttgacagatgtcgttgacggtaatttcgcgaaagggtttcgtttgtagcaggcccataaagccagtttgaatgtcgcgcttggatttaataatgcgcaaatcgatagtggtcatgatgttacctcgtattcataaaagtgcagaggagacacaaaaagcctggtgatttcaatttcaccaggccctctcttttcggtatcagctagttagccatccggtccgtagctgatgccttaagacaatttccatttgccaaaaagcatcacctccttttttgattggctcaaagatacaccggttgtcgggggatgtcaatcgaaagccattaagaaacttgaggcaggtggggcttgccaaaaaagtaaccctgaacgtacttaataccgagttcattaacggtttgcatatcctgttcagtttcgaccccttccaagataaagaagaggtcctgatcgaccgcgatgtcatgccagaaccggatccgttcgttcatttgttcagtatcgttgtccttacggagattttggatcgcgaatttgacgccggtcacgtacggcaaaatatccttaacgagttcgtacgaattgtcagaacccacgtcgtcgatttcgatgtagacgccgccgtcatgataaatttggctgatggcgcgcatggtggcgagattgggaacttcaatgatttcgacgacgagcacgttaggcccgtcagccgaccggttgaatgcgactaatttatgggcaatggcgggatcggcgaattgcgacatggtgaggttgatgctcagcttgtgctcgggattggtttgtagcacccgcttcatgaggtcaatttgggtatcgaccgaaatatcaaagctgggcgggaggacccaccgttcgtggctctggtcgtagcgccgtagtaacagctcattacgaaagagcgtgtggtcgggaacgttgacgacgtgctgcacgaaaaaggtatgggtgtttaagatctcggcctctgagttgaacttaggcagtacccgtccttcgatggtaatcgagtcacggcccgcccgtttggaccggtagaggttttcatcggcccgtttgtacaggtcctcgacgtcttgatcggtcgcaatgatttgcgtgacccccacggaaattgtaatgtcgatacgctgattatcaaattcaaagtgggatttacggacggtatcaatacagttacgcaggactgcggtgacatcttgtggcgtgtgatcgagaaacacgaggataaattcttcgccaccggttcgataaagccggaaattaagcttttcttcatccaagacgtcgctaattaatttggcgaagcccactaggacgttgttgcccgctaagtggccgtagttgtcgttaacctgtttaaaatggtcaatgtcgatcgctacaaaggtgaggggggtatgatctagtttcgcgttttgaaaaatatcggtaatttcatgttggtaactggcgtagttttggacgtctgtgagtgcgtcgtagttgaccattttttcaatacgccggttttcgatgattttagtatacgtatctttttgataacgaaaggtgaacacggccataatcgcgtacatgattagtgcttcaaatcgaagcagtggggtaaccatcattcccgccgagtggtagggaatggttaaccaaaacacgatgccagcggccagggtggttcctaaaaagcccgccgcgttgtagtggagctgcttttgccacaggccgatgatggcggcgaccaccaagaccccgaccatgccaatcatgtagcgccaactttcaaaggcgcccatgtagtgcatggagacaatcatggcaatccaaactgcgcggattaagtattctccgatattgatcccgtcatcaaagagtgacaaaactaagatgaacaagccaatgttatggtacataacggcgttgttgccgacaacgtagccgataaaatgtaaaatgctaccgattcccagtgccgtaacggtaatggcgattcgactgaagaccttacggcgccgactgatgatcgtattatgaaaggcattttgccacagtccggtagagaaactaaggtaaccggcggtaaaaaagcaagcaatcaccagttgcacaatccaaacgatcagtggtgattgcgcaaatttcatgtaactcatatccattattaagtaatcccccaactaacagcgcactattcagcattgtacaatgcgcacccggttctcccagtgaactaattaaaccggctaactttttaatagtattcattaaaaagttaaagatttaagaatacaacaattgtagaccagttaacacaaggtgaaaaggccttgcactcataaatatctcatatttttttaattaaccatttaatgataaaaacgccgtagctcaatgatagtatgagctgcggcgttttataaagttgacattgaattcatattaaatgagttattaatttataatagggtattaatggttatcgaacgaatcgattttgatcattagataacatgatcgttataacgatcagcatttactaaagttacatgttattcggctaccgtggcagattcaggagtggcagctagcttatgcaagccaattccggtgatcccgctcaatagtgaaattacggggcacaacaggttaaagaaggcgaatggaaggtagtcgatggtgggcacgcccaaggtgttggcgatgaaaaccccgccgacgccccatggcacgaggtagttgatcatcgtaccgccatcctcgagcacccgtcctaatgcggaacgatcaaggcccccagcaataaaggtttccttgaaggagcggccgggaaggataatcgaaagaaattgttcaccgacaaaaatgttgattccgatgcaggcggcgagggcggcgctgatcagtttaaccgtgctatttagtttcgtggccagagggatcatcacggcactaatgagaccgaagttgacgagcaggcccccaagcgagagggtcagcacgatcagggccacggtcggcatcatgctaacgattccgccccgcgataaaagcagatttacctcgtcattagttgttttcgcaacgaagccgttggtaataatggcactggctttggtgacggataaatgtggattatcaaaaaacatcatgattgcggaaacgaagacgttaagcagcatcgttggaatggcggccatcttaaaggcggcacaaacgaatactagaatgatcggaattaaagcgataattgaaatgttgaagttctgattgagggcggccacggtggtgttaatctttgccatattagcatggttgtggccgatgccgagggccgcaaaggcgatggttgaaatggtagcggctggaattgtggaccagagaatggtcttcatgtgggcgaataagtcggtgtcgactaccgcggcggataggttgttggtttcggacaggggcgagagtttatcgccaaagatccccccggccacaatgcagccagccactagtgcggggttaaagttcatggtaataccaatgccgaaaaaggcgatcccaaccgttgaaacaacggtgaaacagcttccgacggccgcaccaacaagggcgcacacgagaaagacggcggggagaaaccactgagcactgatggccttaaacccaattaccatcaaggtgggaattgtgccggcggcaatccaagtactgatcatggatccgatcaaaatgaagatcacaatggggatgatccccttatcaatcccatctttgatgccggcattgatgttgtcccaagtgaggcccttaaacttggcccaaaaaatggtgacggtaatcgcaagaagcaccggtacctgtggagaaaggcctaatccgattaccccgtagcccatgatggccaaaatgacaattaggacaatcgttgcctcacgtaaacttaacttaatcttttgcataactaatgaactccgtttctctaaatttgggtatataaaaatcgtccctatcgcaattaaatgcaatagggacgattagactagaccgtggtaccacccaaattgtgtgttctttatccactacgacacggacaggctgcccggaattttaatgtcgcacaaaacacaccactcactagaagataatggattctagttattaaccatcgtcatcgtattacggtatttcgcctcacttaccctgattggttcgcagcaaccaccaacttcctgacacccagataaggaactacttcatgtaatttgactttaaatatttagtagcagtatatagcgccaaaatcaaaaatgcaagtttttacaaaattaaaaactgattgttatatcatggataactaataattatttttttgttttgaaattaaaatcgtaatggacaaggtggtgtaataggcaatgttgctggtgagacatgacgcaaactttgtttcacatgaaacgcttactagacaacctcaaaatgttgaattagcatggtaggtactattattttaaggaggacgtgacatatgctcaaagcaccgttatttgaatgtgatgttcctgtttgccgctaagcagcggtgactaccgctgaatacccttattaatatttagcggaggaaattatgaaaacaaagaaattaatcggagcactattacttagcctgtcagccggcatttggggtggcatgttcgttgttgtaaagtcggtggtgggaaccatcccacccgtgcagcttgtttggttacggtatgctgtggggatcgttgtactagtcggatttgcgattgccagtcgggttcgctggtactggaattgggccgatatcaagattatcgtgctaatgggcatcattggtaatggaatctcgattgtgacgcaagaaaccgggacgtggtattcgtcggctcagctcgggtcggttatcacggcagctacgcccaccttcatggtgttgtttagctggtggctattcgcagagcggccaactcggagtgacgcagtgggtcttggattagcaacactgggggttttagcgattgtggggttgcaatttagtggccggcacgctcttttgggtggaacgctactattggtggctggcctgacttgggcgttcatgtcggtgttagttcgcaaaatttcgccaacatataatgccctgcaagtaacactactatcgacaatagtggcctttgtgtgtctaacaccatgggtactcactcattggtcggtgatggccggagtggcgttattagcaccccatattgcactgagtattttttacttaggtgctatctcgacggcactggcattcgtaatgtggaatcgggggttgaagcttcttgatagtagtctgtcaggccttttctttcttttccaacccattattggcggcctacttggctggctaatactaggggaacccattggcatcggctttctccttggcaccgtgctgattgtgggaagcgtactcgtttcgattaaacgactttaatctaaaaaaaatgcgtttgaagctgatctgcttcaaacgcattttagttaactgagatagttcagcgttgccgtccccactgccttaccggcaattaacagggcatcttcattcataagaaaatcgggactgtggtggggatggttagcgccatcgggtgtttgacagccaacgtagaaaaaggtacttggcgtatcttgtgcaaagtaggcgaagtcttcagaaggatcctgcgggccacaatcgaagattttagtaacttccggtagttgtgcttgcttgatgctatcgatggtttgggtcgtgagggtgggatcattgaaaagcactggatagttatcgtcgtagtcgatatcggcatggacaccaaacatggcttccatgccatgggcaatctgctcgatttgatgccgaacggtggtccgggtgctttctttcatgatccggacgtctccttttagcgtcacactttctttgatggcgttgaatgagccaaccccgtcgaaggaaccgatggtcacgctggcggtatcaaacggatcaatccgacgggagacgactgtttgtagagcggtgacgaaataagagcctgccacaattgcgtcgttggaaaggtgcggcattgaggcgtggccccctttaccggtaaacgtaatcgtgaagtttccccgaccagtttgggtttcgtttagatggtacccaatcgatccggtgggcatagaggtcatgacgtggacgccaagaacgttatcgacatcggttaggacaccggctgcgagcattcccttagcaccaccgggagagacttcctcggctggctggtgaataatgcgaacactacctttgagttggtcttttaactcaatgagtgccttggcgagcaccatcatataggcggtatgggcgtcgtgcccgcaggcatgcattacaccgggattttgagatttgaagggtaactcattatcttcttgaacggccagagcgtcgaaatcggcacgtaaagccagtttctttccgggatgaccactatcgatatccactgcaaatccgtagccctcaccgtaatcagtgacagtgcaatcaagattctggtaaaacgctttgatgtaggcagccgtcttaacctcgtggaacgaaatttcggggtgtgcgtgtaaatgacgacgaatgcgaatcatttccggttcggcggcctcaagtttgtgcattaattctgtttgtagatccattatgatcatcctttcttatttgacgtggcaaaccagcgttgcaacacgggtttaagttggtaaaaaattgcttcggcaatcacgaaaccaacggcgagggccatcgcgatggtcagagttttgagaagattttgttcggcgctgccattgaggccgagcgtaaaatctttaaggctcatgtagatgatggcgccgggaactagggacacaaggcaggggatgtagaggaggttgacgggcgctttgatccacatagcggccgcgttggcgagcaatccaatcgtcactgccgcaagcagattgggcataataatgttgctggtcaactgactggttattagataaacgacccaggcaatcgcaccggtcaacccagctgggagaagggtacggcggggaacgttggtaatgatgccaaagccgacggtggataagaagctaaagataaagccaattaaaagccgcaatttaagcgcctcccatcagtaaccgggcgagggcgccgccaacaatgacgccagcgccgatggcaccagccaccatgacggcgtcaacggcccgaacgaggcccgaaatggtatgtttaccaataatttcgcggagtgaattagtgacggcgaccccgggaactagtggcattagggcactaacaatgatgttgtcagcactattggcgagtccactgagttgcagccccacggctaagcagccaatcactaagccccccacaccgacgccaatgtagggtgtttgggagtggcgaccaatccattgggttgcaaggtagccgcagataccgacgatgagggcgaggcctaagtccgaccaagtggcttgaaaaaggagcatgggtgcgacagagactagtccggcgccaagaattttttgccaccatgaaaagtcgatgacccgttgatcaatggcggtgaccccggctttgagttggtcgtaattgatttgatgatttgtgaagcggcgtgagagggtattaatctcatcgaccttttggagattaaaatctccagtgcggacctttactaaatgggtggtaggatcgctatttgagtccacgaagattgcagtcatcgttgcatgacaactgagatcgatgccggcggcctttccgatgtattcgacggtggtttcaacccggggtgtttcagcaccgttttcgagcaggattttgccaactgttccacaaagatcgatgatatccgtttgaattgttgcgggcacacatttcacctccaaaacaaaaaacggccccctgctaagtatctgcagtgaccgtttatgaatgccgtattaaattaacaaaattcattataagactaaagaatcaaatttggcaaccagaacaggttaaacaatgttagaaacggcctggtaagtccgctaaggtgtattaaagatgccatttttaggggactttgaaattttttcacgagcggataactagtaaccacgcggttttaactagttataatttaaaatcataccgttaaacgcggtgtaagttgtataattataatcaaccactcacattaacaccagtaaatattaatacattaaaaaataatgtgattaaaattggcggtcatgggagtcgaactacatagtattggacaagttttctgttgctaaggtcaattagttaatatgccgaagcgaatatacatcaaaggagagtattaaaatgacatatcatttttcaaatcgtgttccgaagtcggatgttgatcccgtgggtgacatcctaaaagttgctggagatccaaaggtcatgtcgtttgccggcggattaccggctcccgaactgtttcccgtggaacaagttaaaaaagcggctgatgcggtctttgatcaaaaagggcgggcagccttgcagtacggatcatctcaaggggttccagagctgcgtcaagtcattttggaccgggtcaaggtcgaaggcattgaaaccgatgccgaccatgtgatggtggccaccggctcacaacaatcgatcgacttaaccgggaagatgtttttggatgaggggagcgttgtgatcgttgaggatccaacgtacctgaccgccgttgatgtctttcgctcatacggcgcccgctttgtgggtgtggcgatggatgaagaggggatgaagatggacgccttggaaaaggcactccaagataatcctgaagcacggcttatctacacgattccgacttttcagaatccaactggtcggacgatgacactggcccggcggcaaaaattattggcactagctgagaaatacgacgtaatggtgctagaagataacccatacggggcaatccgttgggaaggtgagaacttaccatccctgaagtcaatggataaaaccggtcatgttatttacatgggcacgctatcgaaaatcttggctcccggccttcggttaggttgggtggtggcagaacccaaacttatcaaaaagtacacgatgatgaaacaatccgctgacttacatacggacagtttggcacagtacatcgctgccgagtactttgctcaaaatgatattaacgaacacattgcaacgatcacgaatctgtatcataagcgtgaacagattatgatggctgctatcgataaatatttcccagctggcgtgaagcacagtaaccccgagggtggcatgttcttatgggtcatggtaccaggggttgatgatacgcaagtcttatttgatgccgcgctggctcgcaatgttgcaattgtgcctggtgatcctttctttgggaatgaaaccatccccggaacgttcagaatgaactattctaatacgccggaagataaaattgaagacggtgttaaacgtttggccgaagcaattagtgaggttatggcgcaaaattaaaggttagtaaaaaaacattcctctatcaggaatgctttttttatcactaacgaagaatagcatctacaataaactagccttatgagcgatgatttcatcgatgaagtaccgactagcaattggtagactggctgtgtcgcgaaaaccaatggcgaggtcacgatttaaaatagggtttaatgagcgtgttacgatattaaagtgtgtgcgttgaagtaccagtttaggcaaaatgctaattccgagaccggcctcaaccatggtcatgatgccatagtcgtcatggatgcgataacgaatatggggctttaaatggatatgttcaaatgcacgaagaggctcattgaaatgcccctcttcgagtagaataaagggttcttgacttagatcggttaaggttaaactggtcttggtggcgagcggactacccggggaaaggacagctaacaattcatcttgctttagctcaattgtttggataccagtaacggccgcaggggaagtaaacccaaagtcaacaacaccagttttgatccagttttgaatagaattgtagtcgccctgataaaagacaaaatcgacgtgtggataacgagctgtaaatgttttaattagttgtggaagccagtggcaagtaatgctcgaaacagtaccaactcggataacaccggtatcgagccctttgatttcggttgctttttcctgaacgctgttaaatgcgcggatggtttgttcaatgatggtgtatagttgttgaccctcaagagttaaactaaccccgttctttgaccggttaaggatttgaataccatattctgtttctaacgactgcatcatttgactaatggatgattgtgtatagcccagagcctgagcggcttttgtgaaactaccaagttcgataattttttcgagcgctaaaaaacgattcattgattagatctcctaataatttaataagtaagattaatttaacttatttcaatgctcagtatatactaaattcatgataattttagataactttggaggacggattcatgacagttcattttcaaccagcgcagttagctgatctcgacgaaattatggtgatcgaaaatagcggatttaccgcggacgaggcggctagccgtgatagtatgcgagaacgaatcgaacaaatcagtgacacgtttgtggttgctaaaaatgatgccggtgcggttttaggctacattgttggccctgcggatcagcagcgttatattgcggacgaactcttcgaaacgacgatccctaatcaggcaggtgatcgttaccaaacggtattgagcttggccgttagcccggattaccagaaacagggaatcgcgggacaattattgaccgaattagctcggattgcccgtgctcagaatcgtgtcgccattacgctgacttgtttggaacgactagtctctttttatgagaaaaacgggtatcaaaatgagggtgtatcggcttccacacatgcaggagaaacgtggtataacatggtgttgttgttaactgcggctaagtaacaattaaatgacagcattgagttgatgaaacagcaggcaaggtcaaggacggcgcggtctgacgcaaaagtacaaaagacatactggtgtgatctttaattccactggggactagggtagaataatttggtaccctatttcaattaacgaaggaagattaacaatgaaagcacaatttgaatatgcaacacaagaagatttagctacaattaccgccatttataatcaaatcattccgtcacgtttggcaactgccgacctggaaccagtgacggtcgcatcaaaacaggcgtggttcgacgccttcaatcacgaacaacgcccgatttggaaaattatgttggatggtaaaatcgctggatgggtctctgtggaatatttttacggtcgaccagcttatattcataccgctgaaattagtatttatatcgacgaaaatgcgcgtcatcaaggccttggtcagcaatcacttgattttgtctttagccaattaaaagcgctcgaaattgatactttagtcgcctttatttttggtcacaataagcctagtctgggactctttaataaaaatgggttctcggaatggggccatttaccagctgttgcattgatggatgatcacaagcgggacctaaacattttgggccgtcatttcgactagggttgtgtttcacgtgaaacaatggtgcctaaatcatggttgtgttacccgttaattggtgtataattcaaaatattaaaaattaaatggccgtgtgtcgtccccggatggcgcactaagggcactaagtcgatctcactagggcaccgttagcggtgagagatcggcttagtgccctctttattggaggaagaaagtcgatgaaggatttaaagctagtaattaagtcaactgcagagttaaccagcgcggaattactgatgattttaaaagagcggacgcgggtgtttgtggtggaacagcactgcccgtatcaggaagtggatgatcaggatgatgaggcatgccacgttatgctacaagaccacggtcagttagtggcctacacacggattatcaaacacctagatggtattaatatgagttttggccgggtacttgttgtgatggcgtatcgcgggcaacaactgggccgacaaattgtggcagaaacaattaaagtgctcaggcaacaatttccgggagcccccattaaaattgcggcccagagtcgcttacgtgatttttacggctcatttgggtttcggcccgtctctgacgtctatttagaagacgatattccgcatattgacatgctgttagaaaattaaaaaatgatgagggattgacgcgatgatagatctatgttttaatcaatctataatcaaaaaggagaaatacaatgacaactcaactaacccaagttaatgcgttttattttggctattactttagttagcgtccgtagctttgcatgcggacgccatccatcgcgttcgcgtctaaagcttagccgtatgttgtcgtgccagctagacgtgaaaatctagctgaaattgtcattttccacacggagtaaatgcagccagctagattcaatctagctggcttttttcttacccaaaataggagtgatcggaaatgacaaaatcaaccaaacgaactttagcaatctgtttgtacctcaattacctcgtccatggcttcggtctaattatattagcgcaaaatatgcaagccttgggccacctgtggggagtcccgttggcgactgtttcttacgtggtctcagggattggtatcggccggttactagcttacttcacgtttgggtatctctcggatcgctttggccgtaaatttttgatctacttagggattttgacctacatgattttctttttgggcatgccattcgtgcaaaatatccaactggcatatggcctagcaatcttagctggggtagccaattcggcgttagattcgggaacgtatcccacgttcatggagatgggcggtaaggagagtgcctcaaacgtgtttattaaggcgttcatgtcgattggtgagtttattttgccgttgctcgttgcgactttagagacgcggcagctatggtttgggtggtcatttattttacccgttattttgttactggcaaacttgggattgctgactcgggtgacgtttccgaagcgcaatcaggccgatcacacgagtatcattcgacagggccgactttcgaaggttaaacggcgactcgcaaccgtggctctgtcagtttacgggtacacaaccatggcggtcatgatcttatttacgcagtggattacgctgtatgcgaccaaagagttaggatacagttcgttaattgcgcacgggttactgtcgctttacagcgttgggtccattaccggcgtcgtaatcgtgtttgccatgttacggcgacaggtttcagaaacgggcttgttggtgatcaacaatgcgctatctttagtagctttggtggtgatctgtagtgttacaacgcaatggctttcggcggtggctgcatttatctttggttttacggctgccagcggcatgatgcaggtcgcactgaacctgtttttgcgcctatacccaacgcacaagggaattgttaccggcacgtactttacgttcgggagtattgcgacgttcacggttccaatcgtaacggggtggctatcaaaaacaagcattgcttacgcgatggagtttgatattttgattggcgttgtggggatggttatggtgattctcgtggcgcttgtcatgagccctcgatcgctcagggttggtctttggcgaccagcagtacgtcatgttaatcgataaatttaaaaaatgaggccagtttaccgtggtagtaaactggtctcattttttagtgcatgcagccgtgactagctagccacgacgccccaagatgatggctgcccatcattgaaaatcccattgtgtggaacgcaactaaccagagaagtaataacagagtgataaaaagtaaaaacagtagtaacagtaaaactagtttagttgaccaagcatgatttccattcatccgatcaggtcccttctatctaaaaagcaacgtgattcgactctaatataagtcaaagtggtttaaatgggaagtacaacgctagataaaggaacttaatccgcttttgttgaggcgaataacgtagttacggagctgatcttggccgatgagaccgggtttacgcctagaaagttgcaaaatagagagcgtattgttggtcaagaagtgcgcgatgatggccgcatcttgagcgctaaaatgataggtattagccaagatatcggctagttgatcggtgacgttacgtgtaatgcgctgagtaaattggctataatcatcatttgataaaatggtgcgtgcaaaggcgtagtgatgattaaaaagggaaattaggtggtcaaaaaaatagccattctgctcttgaataacatcgtcaaacggccgttcctttaaaatcgcaacgaggtggttggaaatctctgtgacgtaggcatccagcaaattatcgatagaatcgtagtgaagataaaatgttttacgattgattccagcagtatctgttaggcgtttcacggtaatttctgatagcgggtgttgtgcaattaataattcgaacgcttggcggatggcgcgttgggtgcggatgatacgtttatcggttgccataattagaattctcctgtcggttgctacccaattggtgggcagatgtggcatatgccccagaattgggtaagttggtgttgccaatgagagggaacctctctatagtgacttaatactcacgtggttattatgccccatgtgtggattaagatcaatatgggagaagaataaatgattaaggcagaatggcgttacatgttacagcataaattcttgattgtcgcattatgtgtcgtagttctcattccctcgatttatgcggtcacatttcttaaatcgatgtgggatccgtatggaaaattggccgatttaccagtggcagtggttaatcatgaccatgcggtgacgtatcagcaccggcgattagcggttggaaaacagttaacccaaaatctcaaaaaatcgcaaaacatggactttcaaatcgtaaaatcggccgatcaagctcatcgggggctaaagaacgggcaatactatatggttgtgacaattccggcgaatttttcagttcatgccacaacgttattggaccaacacccacagcaaatggtgcttcattatgatacgagtgccggtcataactatgttgcggccaagatgacgagtgcagcagcaactaaaattcagacgcagattaatcgggaaattaccaggacctacgcaaaatccttgtttgcatctattaagaaattggaccgggggatgcaatctgccggaaatgggagtcaaaaagtgaccaacggaattgcaaaattacaagtcggcagtcaaaccatgacgactaatttagcgaaactagcccaaagttcgttaacccttgcaactggtagtcggcaagtgactactggaatccaacaatatgtgggaggcgttcaacaagcgcaggctgggactggtcagttagtgactggattagaccaattattagcgaaaacagcccagttgcaaaccggcagtgagcaattacgcaatggcgccgctagcttaaagagtggggttaatcagtatgtgggagcggctactcaactggatacggggacacagcagctgaacacgggtgttcaaaatttaaacactaacgtgacatctctgagccaaaatattggccaactaaatcaaggcacagcaacgttaaccactgggctgcagcaattagctaatcgtagtcagacgctgagtacggctattcagcaattggcaacgaaccaaggccagagtatgacgaccacacaaaaacaacttacgcaactttcgcaggagctggcgcagttaaatgaccagtcccagcaagtccagcaggtcaaaacagcgctgaccaagttgcaggcggcggtcacaaccttgaatcaacaacaatcgcaaagcacatcattagcacaacgggttgcccaaacggccgatgcacagcaactaactgccagccaaaaacaggcaatggtcgccgtagtgtccgacaaccagcaatcgacaactgatacaactgccattacaagcgcaatggcggccttaaacgtcgcaattaatgatctcaccgccacggtcaatacgactgcggtcacggctaacattgctcaaattaagcagtcgcaaaatacaacggcccagcagttaaaccagttggcgactggggccactaatttgaatgatgggttatcgactgcagctcagcgaatgcaaaccgttcatacgggaacgacgacgctagcgcaaacgataccgacgttgatcgctggaattggtcaacttgcggatggatctcagacactagcaacaaagacgcatcaatttgcacaatccggaacgcaactctcaagtggcgcccaaaaattgagtgcaagcatgaccggattaaccgctaagttaccagcgtttgtgagcggggttggtcaattaaccacgggaagtcatacactggcaaccggcttaacacaattagtaactcaaggtggtcgacttcttactggtgcccagcaggtgagtgttgggaatcaaacactggcaagtggtgctggtcaactcgcaactggatcacaaacattggacgctggaataacgcaactcggccaaggatcggctcaattgacaactagtcttcagagtgcggctcgaaaagcgcatttaacaaccaatgcgcaaactaatcggcaggttgcctcaccagtgaaaacgacccacacagagttagatcgagtggctaataacggaactggaatggcgccatatatggtttcggtttccctatttgttggggcattagcacttaacttgctttttgatctttactcaccacgaaaatatcctaagacagcatggagttggatgatcagtaaatttagtatttggggcccctttgcggttggtgaagctctgatcgtgtatgggttgctttgcggaattgatggtctgaatcctgttcatcaggcggccacattaggcattatgatgcttagtgcgttgagttctatggcactagtgacctggctcaaccttgtgtttggccgtattggggctttctttagtatggtcctgctcgttctgcaattgagcgggtctgccggaacgtatccaattcaattatcgaaccattttttcaaaatgattcatccgtacttgccaatgacctatagcgtaaacgggcttcgtaagacattgatgattgggtcttcggcaattcctgaagccactattttgacggcaattctcgtcgggttgttaatattaattttgttattctatagtcggcggcatgcacgcttaaaagccattgattttgatgatccagacgcggttaaggcgacgcagggcaggttaacttcacgaatgcaataactgcttcgcaagaaaaattcaaatggtataattgggctaatcttaagtaacaggagttgtccatgaaaattataattgcgcccgcgaaaaaaatgacggttgattccgattcgttgcccattttgagccaaccgacgtatttagatgcaacgcgtcagattttacaagcattgcgtcaattgacgtatgacgaggccaaagcactgtggcactgtagcgataaactggcgcggcccaactacgactggttgcaacagctagacgtcacacggcaacttagtccggcagtgttggcgtacaccggcattcaatatcagtacatggcgcccgatgtgtttacacaaccagcgattgattatgtacagcacagcctgagaatcttgtcgggtttttacggtatattacggccgtttgatgggattgttccgtaccgactggagatgcagtcgaagttgccggtggccgatcagcctaatttgtacgacttttggggatcgcggttatatgacgatctgtatgaagaccacgaaccggtgattaatttggcgtcgaaagagtatgctaaggcgattgaaaaatatttgcgaccccaagatcaattaatcaccattacgtttggaacgctgcaggatggtcgacttaagacccgggcaacgttggctaaaatggctcgtggagaaatggtgcgattcatggcagaaaaacaggtgacgactgttgcggcactcaaacaatttgatcatttagattatcggtatgcggaggagctttcaacgaccgatcagttagtttttgtcaaatagtttcacgtgaaatattttttgaactgataaatgttaagaacatgaaaaaggaggagattgtagtcttaattatcagggaatacaatctggacgatatttttgtcgtggcgaaaatattttatgatactgtgcatactgttaatgccaaagattacacgaagaaacagcttgatgtatgggcgacgggtcacgtcgatttggatgcgtggaaccgttcctttttggaacacgatacgttaatcgcggaaatagacgggaaaaccgtgggttttgcggacatagataaaactggtcttgtggatagaatctttgtagatagggattttcagggtatgggcattgcaactgctttattatctgaattagaacaccgtgcgcaagaaaatggtgcgatttcttttagaacatattcctcaattacggcgaagcctttttttgaaaaacaaggttatgtggttgaagcagaaaacaaagcaatacgtaatggcattgtattactgaattttaagatgagaaagatgtaaagtttgctgtattctaatgctatcgattggttaaagattagacggtatcagtgaaacttgtaaagcagtttaggataaacgattatgtttcacgtgaaacaagatggtagtgtcacgttgttcaattaatggagggtaaaaaatgcgtgcagtagttattcatcaagcaggagctccacaacagttagttatggaagaacgtccggttccacaacccaagccggggtggtcggtcattcggattcgggcatttggattaaaccatgcggaatccatcacgcgccggggcggatcgccgagcgttcaatttccgcaagtaatcggcatcgaggccgttggggaagttgccgcaacgcaatcaccggcattgacggtgggagagcgggtgacaaccctgatgggcgaacttggtcgtcagttcgatggcagctatgaagaatacgctttagtgccagatacgcaaatttacccgttgccgctatcgggagattgggcgcagctggctacgattcctgaaagtgggtacacggcgtggggatcgattcaaaattgtcagattgtggcgggacaaagtgtacttgtacgcggtggtacgagtacggtcggcatcgcggcaattcagttgatgacggccatgggagttcacgtgacggcgacgactcgccggactgaaaagagcgcctttttgaagcgccaaggagccgaagcagtcgtcttagatgcggctgggaaactgcaaacaacggccaattatgatgcgatcatcgaatttgtgggcgaagtgacgctactcgattcgctaacccatttgaaacatccgggaggctacctcaatgtgacgggagaactcgcaaatcaatggaccctcgatggcttttcgtcatttaacgttccatcggggtcgtatttgacgagtttccagtctaccgacattaatcgacaatggttggcagaaatgatgcagttaattgcagataaacacctcgaatttccaattggcgcgcggtttacactagatgaaattgtggcggcgcacgagctcttggacgccggaacggccgataaaattgtggtgacggtttaacggtccgtagtcgatgaatgacgtctccaacggtactaaaattgaaggtcactaaccgaacttcttgcttttacgggcagcgataagcgatttttggaggaggtaatggccatgcgcgcgctatattttaacgaatttgggtcagctgatgtgttgcgatacggtgagttggccgatccaactattgctgatagtgatgttttagtacaaacaacctatattgggcttaactacgcggatatctatcggcggcgaggaacgtaccacattgaatctcacgatccttatattgacgggtacgaaggcgtggggacggtggtagcggttggtgctgatgttacccacgttggtctgggggaacgagtcttgttcgtggatgtgccactggcaaatgcggaattggtgcgggtgcctgccgatcatatcattcaggtccccgactcactcagtgatcaagacgtggccagcattggcttacagggtctgactgcggacttcttagtgcacgatttggcgcaaaatgtcgcgggtaaacgtgtcttggttcacggtattagcggtggggtggggcaattattggcccagattctggtcgcacaaggcgccgaggtaactggaatcgtatcgacaccggccaaacaacaattagcacaatccttgggagtccaacaggtatttttacggaatactgactgggcaactgcgtgtgtggcaaccttcgatttggtttttgacggtgctggtgtgacgttgcccacgagcctacgaatactgaagcatcgcggtcgtgttatcttttatgggatggcggggggcaacccaccggccatagaccccgtggcgctactagcggaatctaagagtattttgacgggagatttgtgggactatttggacagttttgcggcgcgccagacacgaagtcagcgactgtttcaatatgtggcccagcaacagattaagcttaatcctcccacaattatgccccttgctgcgggaaaaacggcccatcaactcttagaatcaggaaaaagtaccggcaagattttgctccaaccggaatctaaataagtgacgaaaaaagcacgctgtgattgttcacagcgtgctttcaattttggtaccttgaacaaagttaacaccgggtaaatcagcaacgagatctaacgacgattgttgatcaatatgactgacggcaaattgtaagtggtaatcttgtgcaaattgataccagtgttggaagagttggtgacgagcatgatcctgtgtttcgtgaccgctgaggataaagtggagacccttgatgcgcggggtgtataaaatcgcttgttttaaatcaagcacgttatgttgaattaaccaaatatcaatcggtgtgtcgaggtcagtgagtggtggcagtaggtcgatgagatgcggatcggtgagatgaatgatcaaacgttcggggccaagatcgctttgactaaaagcgatcagactgttaatggcatcagagttactgacatcgattcgtgaaagtggcagtgtaacagtttggcaacggctagtttgtaagtattttttcagtagcgaaattctaaatttcattgagatactggtgggattaatgatctcccaacggtgggtttggtcattgcgttctttgagaattaactcatccgcgacgaggggcttcatcggggatcggagatcatagacgctttcaccaaagtaggctaacgcgtcaaggttgcgtgccattttgacgaggtaggtcattgaatcaatggaaatggtttgacggccattatgtttgctgtggtagaggctatgatcagcgcgctggtaaacatcttgaaacgaagtatcatcgggtgcactgttcgtaatgccgaccgaggtggtgatattgatggtatgaccgttgtacatgaagtcgtgttcactgagcttcgaccagcattcagtgataatttcagcagccgtgttggtcgaagcattacgaaagataacgacaaattcttcaccaccagagcggtaaagttcttgatcacaaccatatttttttaaggtgttatgtaatagatcggaaacaccaatgaggacggtattacccgccaagtgcccgaatcgatcgttaacctgtttgaagtaatcaatgtcgattgaagcaacaacggtgttggtacctgctagcttggcgttttgaaagcgacgttcaatatcggtcgtataggctgtataatttttagcttgtgtgagtggatcgtagtaggccaacttttcgatggcatgggttcgcttgctttggcggttttgatagttccagtaaagcgaaataaagagtgaaataacgagcaccattagggttgctcggataagaacgacgttggaaacaaccacgtcagtaaagtctgtttcggtaactttatggggaaatgatagccagaacacacaaccaatgagggttaatagcataaagctaatgaccggattgtgtctgatttgggcgtgaaaacggtagatgatcaggagaatacacactagaaataaaattgaggcgaccgctatcgatgagctgatgtggtctagctggtgaatcacccagaaaacgccgataccacaacagcgtaaaaagtattcgaagcgattaatgtgatcatcaaacagcggaaaaaggacgatgatgagacagacgttgtggtagagcatttcaccgtcaacggcatacaagccggcggtgtggaaaaacagacctgcaaagagaatgaaaccgagcatgccaatgcggtagtgaaccttagtgttggcactgctgtggcccgcgaaggcccgttgccagaggtgtgtatagtagacgattaagccctcgctaaaaaaactcacaaggagaatttcggcgaaccaataaattataatacccggacttaccgtactcataggtgttgaggacctccaactttacgtatatcggtttcgtacatgaaaccatagaagagtatactgcaccagtttgtgagcgatcaagcgcttacgagaaaagaaaccgacgtaaaaagacgacgatacttatccggaaggactttctttctggcaaaggtatgctaaaattaagcaaacaaggatagtacgaatagtaataatgttcgccagcattcgaacaattagcagataatagaaccgtaaaaacggttaactatggaacaacagcttgatagacaggcggaggtaatttttatgttgcgtttctttggccaacctaagtatgcagataaagaattattcggctatgaactatttttacgagaaaaagtggcgggcaattggcagtttccgaagagttttagccagattcatgggcatgaatttagtcagttattggcggcgacactggcactgatgtcgactgatattcaattaatatcgatcaatttggatcgggaacagtttattgaggaagcttacatttgcgagctgggacgggtacaagaagagtatcctcaaattcaggttgtggttgagctcactgagcatgatggcaaggtgaccaaccggcaactgattgatgcggccgcacgctatgtacaatccagaatatggatttgtttggacgacgttggaaccggcgacaaccaaattagttttgtgcaacaaattgatccgtacgtcagtgagtacaaatttgccctgcaaaactttcatggtaaaaaagactatgcgacgagtgtcagcccgtatcttcagttttggcgtgagcaggcagccctccatcacaaatttttcgccattgaaggatttgaaaatgcggttgatctcaaaattgcgcaaaactatcacgctgatattaaacaagggtactactttggtcgaccacacgaaatcgcagcgcagtcaacgctactggtggcagatcactaatctgatgaactaggaacaagggcgaatggaaaatgataaattaacacagttaaaagttcacgctcagcacgtcggtgatcgcctctctgcgatggtcttgccgaatatcggagcgtttattgcgtggggcctaattgcggcgatctttaataaaaccggatggtggcccaacgcacatttagcaacccttgttggaccgatgagccactatttgttacccctactgattgcatattccgggggctcggccattgctaagcatcggggtggcgctgtcggcatgattgcaacgatgggactgattgtcggttcctcgatgccgatgtttatcggggcgatgattatgggcccgctgggtggctgggttatcaatcggtgggatcgacatgtcgagcggcggattccacagggctttgagatgctgacaaataatttttcggcaggcattatcggcatgggattggcactggtcggatatgtactcatccagccgattatgttgctgggaaaccgtttgttggcggccggggtggaccacattattcatacgggcctattaccactcgctaacattttgattgaacctgccaaggtgctcttcttaaataatgcgattaatcagggaattttagcgccgttgggcactcaggcggcttcggtgagtggccaatcgattttatttctgcttgaaactaatccgggcccaggactcggggtattactggccttttccgttttaggaaggggtgttttacggacgtcagcctctagtgccattattattcaatttttgggtggcattcatgaaatctactttccatttgttctcatgcggccgcttctgttactggccgtgattgcgggaggcgtatcaggaactttcacgtttaccttttttaacgttgggttacgtgcgatcccgtcaccggggtcaatcatttcgattttactaatgacacctaagggacttcataatttaatgggggtgctggccggtattttagtggcgaccgttgtctcatttgcgctctcgttggtcattttgcagtggtatcaaagcaatcgacacagtgcattgagcggtaggatttctactattcagcccgttaagcgggtgatctttgctgatgaagcggggatgggcacgagtcaaatgggccggcgaatttttgagatgaaactacaggccgcagaattggaaattccggttcagcatgttttgattcaaaatctagtcgacgagccagatgtgatcgtcatcacccggcaaagctacgctaaatgggtaacgaagaagatgccacaggcgttgcaagtggtagccgtggataacttctttaacgcgccgcagtacgacgaactgattaaaaagctccggccagagaagataatttaaattaatatttttcgaatgattttgatgttgcgtgatagtcattttaaggagcactttcgacaggttaatattccgattgtataaatgttacgaagagtaccaacggggtttcaatgaatatcttgttggatatgctggttaggcatatgcttcttcttgggaggtggtccagtatggaattttcgcaaacaatagaaattatgcgtagtaagaatagcttaactcagcagcagttagccaatgaactacacgtctcaagagcggccattgcaaagtgggaaagcggtcggggacttccagatattgataatttgattgcacttagtgaactttacaatatcagtttggatgagctgataaaggaagaggatgaagtatcttccaaactaattagtgacagtaaagcgcgaagcggccattttcttgttgttttgtatttattagccactatttgttatgttggatttttgtatatgtcgataggaatctttctaattggcttcttgatagcaacctgttttgtacttttttttgagataaaggttttatacaagacattaggtgttctcaaaaagtaagtagctacatgtttagaaagtagaaaatattcagataaagatagttataaatcaagatttaatatttcctgggaaataatctattcgttcgactaactcatggaatccagtgacaatacgctttatggaatgcattgcggtaccaatatcaaacataatgctgctgaaatgtaccactgatgtgtcacctcaatgaataagactgctgttaccgtagcggtcttatttgtttagagtatgttttcaccaggtttgcttggttcattaaatcttttcgtatgttttcttaatccgcgctagtgtccgtcgctgccttttgttccccccttgaccggttttgcctgtgcgactaacgatttccacgtcgttcagttcagagcagtaatattatacaacaccttcttatcagctgtagaaaggattgcaatggccgtggcaagattctcatctttgacgaatgattcaaggtgatcaatttcgttagcagttagaagaaagtcttcaagatgccctgattctgcaatctcttccagtagccattcctcaagtggatcttctttgattgtttcgagatacttacgatgaagggtgatgagttcgtttcggagaacttattgcatgtatctgataaacatacgagatacttcgcgttcgctactcataatacagacctcttgatcaaaatgaatttctttcggcacgtatacagacgaaaatcaaaagtagaaatgaaactaaatctggaattagccgaatattagcgaaaataggtaaaataaaaccgccaagccgaggggctaagcggtttaccgaggatgttcataataaatcttcgatttcgtcgtgtgatgacggtactagtactaatcggtggtctttacgcaacaagaatcagcagactaatcaactgatttaagcgcttctagcatatctacgctttgaatctttcggttcatcatgaacatcacaaccaaagaaaatacaattgttaaactgacagaaataataatgttgatccaagttagaccaggcgctaccattgctgttgcaggagggagaagtgccataatatatgcgtgaaatgcatatcccactccgacgccgactatgatccccgcaccggttaagatgttggtttcacgatagatatacatcagcacttccttagggtagaaaccaagcactttgagcgtggataattcgcgcacccgctctgacacattgatattggttagcgtgtatagcacgaccagcgagagcagcgaagcactaagcactaagacaaggattaggttgttcagattacttaagatgttagtaatggtcttcttggtttcctgtgactgaacggtttgaacggccgcggttgtccggttgaatttggcagcaaaagcattcacagatttggtagtggcgtgtttcagcgtcactagatatgcgttagtggtgactttagtgtcatatacctgattgtaatatgctttgctcatgtagatggagtgccccgcatacatctttgtaataccggccacctttattttgtgactggtaccatcagtttctttgattgtgaatgtgtcaccgacattaacattttgaagcttggcgagcttttgcgatacgattgcgccattcttgctgagaatcatcttcttatttgtcttgtagtccctcagtttgatatatcgatcaagttgagaggccgaatttgggacaattaaagagatgtcttcacgcgagttagagtcgctatctgttgcgtaaacattggcaaagtaagccgagctataccgcttgacggtgttggctttggtaatgacctcttgagcagaggtaacctcactttttttggcattaggattgtacacggcaacaagatcgtactggctaatttggctaaactggcggtcaataattgtattgagcgaatcgcgaataccaaatccggtgatcatcaacgcggtggctcctgcaaccccaatgatggtcatgagcatgcgacccttatagcggaataggttgcgcgcagtgactttatgggaaaaactcattctcttccaaatcggggtgatgcgttctaacaaaattcgtgaaccactgacgggaggctttggcaacatgagctccgcggtgatcgtttttagggaagagcgtgcagccaaccaagaggccagtaccgtcgagaataaagcgagggcgaagcctgcagcaatgaattccggatgcagtgctagttggagactcgagaaattaaagttggcggtgtacgcgcggaagatgattcttggcaacacgagcaagccgagaatactgccaagcaccgtacccgtgatcgcggtggtaatactgtaaataaggaattcgcgcatgacttcgcctttggtgtacccaagcgcgcgcaaggttcccatttcaatgcgcttttcctcaaccatacgccgcatcgtggtgaagctgactaggatagcaatcaggaaaaagaacgcagggaaggatttgcccagcgcgtcaatgcgctctgcgtcctcgccgtagctgttatagccatcgttgtagtcgttgcgacttgcgatggttagggacacatcattgagctcacgcttagtggcctttgcttcggccaatttcgttttggcggtcttaagtacttgttcttgctccttcaattccgttttctgttgatctaacgattgctgtttagctgtcagggtcgcaatgtcacttgaagactgagcagcctttgcttgggccatctgagtgtttaattgtgtttgagccgtggagagcgatgtttctgctgtggcgatggtcgtcgtgttcttggcaatactcgtctctgcgtcggtaatctgcttggttaaatcctggcgtagttttgcgacgcgcgcgcgattgcggcggttgagattcttttgcagtttgtccacttgcttagttgcatagtgttcatatgatgtggaatacgctgcgccttcagagttagtaaaagcaagtcgggcaacattgggtttgctgctagaaaacgcggctttggtggtataggcaaagccgtataaggtaccgctaccaaggcttgtcgaaccgaggctgtccttctttagatactctgttgaggttgcaaagccaacgatggtaaatgttttgtgtgtcagcccagtactaccattagacttaccggcggctacagtaatgtgatcaccgagcttgtattgaccgcggagcttgtcacttaacacaatttgtttagcagtggttgccttgtgtcctttagtgatggtcaatttagataatgttttaggattgctttgaacacgtagcgcacgcttggtgttcttaattactgtgtccgttgtatagccgaattcggtctttttgatgcccgcaagattctggattgttgttcgatctttggcgttcaaactcacggttgatgtgactttagcatctgcaagctgctcggtgttgtatgcggtttgagcggttttgcgcatatttggtccggtgacgttcaacccaattaagacgaagacgcccagcatcaaaagcgctgataccgagatatatcttgcaagggacattttgaattcgcgcgcaatatttttgtttagcattttcatcaattatcgcctaccattctaattcggcaaccggagttggattctcgttgcgggtgtctgcttttacttgaccgtcagctatttcgatgacatgatcagccattggtcgaatcattgaattatgggtaacaataatcacgttcttaccggacttacgcgtgaaatcttgaaataattgtaaaatctttttgcccgtgtgatagtccagcgcgccagttggttcatcagccaataataaatcaggattcttcgcaatcgcgcgggcaatcgcgacgcgttgttgctcaccgcctgaaagttgggcggggaagttttgggtacgcttctctaggccgacagcagttaaggcttcttcagccggcatggcttgatctgcaatttcggctgctaattcaacattttcgatagtcgtcaagttttgcaccaagttgtaaaactggaaaacaaagccgacctgtttgcggcgataagttgttaatccacgcgaatcgagttcgccaagctcaaccccattcacatataccgtgccactggtcaaatgatccattccaccaagtacgttgagtaacgttgacttgccggcgccagacgcgccgagaatgatagttagttcaccaggggcaatttcaaagctgatatttttgtttgcggtaacagcgtgatcaccactaccatatgttttggtttcattttgtactgagatgaaagatgtcattgatttttccctccagccggataataatagacaacgtgttaatcaaactaccctattagtaaaacacatggcttgctgaattctatgaccacttatttgaaaagtgtcaattaaacagaggaggttgacatgccaacacatcaagaacgaattgcgcagactgatgcagctatcttgaacgcactggttaccgtggggagaactaaatcattaaaccgaattacggtgagtgatttaacccgtcttagtgggattagtcgaggaaccttttatttgcactaccttgataaggatgatttggtaacgacagttgagaatagtattttttccagttttcagttgatgttagataccggaattgacggtaccatgaactatcaagatttgagtgtcggtcaaccgtatcctgtgatagaagatattgttgcttttgcggccgaaaacaaagcgattcttagctttctttttggcccgaatggtgatccggcttttgcggcgtcgattacagctatgcttcaaaaatcaattttaagcgaactaaagcgagttaagggcactgcagtatttagaaatgacttaccccaacaatattcgttgtgcttggttactaatgccatcatgtcagttgttcttacctggttgtccagtgatgatttgttgtcagaaaacgagctatcaaaagtgattatgcggacattgtatttgtcaccgtatgatttgcttgggattactgttcggtaatgtcttgaatctaaattgcccagatatgttgcaatccactatcaatatctggtatcttcaagctccaatccgagatggagggggaagtggttaatgatgtggtcattgatttcaacggtgaatggcggacaagatgcttgtattgaccttgttggtatgcgtactagcgtatttcgtcttgccactgtttttgttattcttctattcagtcatgcaagtggtcgtcacactggtggttgttgcattagtaatcttcatcatgtttcagattggtagagtgcttgccaaaattgtaatcttcgtcttcggctacctatcttacctagtcatttgtaaagcccgcgaaggcaacgctacaatccctgaataacgacaagacccagcacgaccagctacgctagtttcagcgtgaggtcgtgccgggccttcttttagatttagatgccgtcagtgataattcagctgttgtacttggaaaaatccaaatgtcactagttaaccgctgtcacctatcaattctacttttcaccttggcataactctatggtcttgagttcttggtatgttcggtgaatttccttaattgataaattttggtatctggattgcttaataatttgttgatcattctcatctgtctctggaacaccatcttcatcaaccggcgtgtactagtgaaaatattgcatgatttcgtttaactgttcggccaccccatctaactgtcgtggcgaaaagtcactcatcatgtgcgttattctgcgtatctctgcaacttttggcatatactcatcaattcgatcaagaacggccgtggtttctccaactgcggccttttttctgttcgcaataactctgatggcatgacattgaagaacttagcgatgccaatcaagttttcacaagtgggatgattgatctcgcgttcccagtttgaaatggcctgcccgttgactggcgtaaccaaggcggcgcaaatttctggctgtgataagccactttgaagacggagtctttttagatttggaccaaaatagtgtacttctgtcatgttgatcagcctcggtgaaaacccactccagatcaaagatcgtctggaacatgaggatatcgagacaatacttggcacttacggttatctctctcccaacagtaattttgaagttgcaaaaaagctcaacgggatattctccaaagaggtgccatcagagccaaaataatttgaaaagagtcaaaactgtgccaccgtaaaacggtggtgctagaaacgttgataccacggaacgggtaagagatgtgccattgtttcccgggaaataaaaaggtcgctcacaataatgtgaacggcctttattgattagtaaattgttgcgatttgatcttggacggcttggtggttagtgaattcgtcataggtggtatcagcccgatcgacgacgccctttggtcctacttccacgatgtggttagcgatggtttggataaattggtggtcatgactggtgaagaccatggatcccttaaaatcaatcaacgcatcgttcaaactcgtaatactttcaagatccaggtggttggttggatcgtcaaggagaaggacgttagccttactgagcatcatcttagaaagatagctccgcaccttttcgcccccggaaaggacattaacctgttttaagacatcatcgccccggaagagcatttggcctaggaaaccgcggaggaaggtattatcactttcttccttggcggcaaattggcgcagccattccaaaatgttgagacggtcatcatcaaattcagggtttaagtccttaggcatataggcccggttagtcgtaaccccccacgtgatggtaccttcgtcgggttccatcgcgcccgcaatgatttgcatcaaaatacttgcggtgacatcggatcgagaaatgaacgcggttttgtcgccgggacgtaaaatgaagctaacgttgtcgagaactttgacaccctcgatcgttttgctaacattttctacccgtaataaatcattgcctaactcgcgttctggtgtgaacttgatgaaggggtacttacgggaactgggcttaatgtcatcaagggtaattttatcgagttgcttcttacgcgacgtcgcctgcttggattttgaggcgttggcggaaaaacgagcgataaattcttgcagttgcttaatttgttcctcttttttggcgttcgcttgcgatttcaacttgagggctaattcggaactttgcatccagaagtcatagttaccaacgaataattcgatcttgccaaagtccacgtcacacatgtgcgtgcagacggcatttaagaagtgccgatcatggctgaccactaaaacggtgttttcatagccggcaagaaaatcttctagccaactaatggtttggggatcaagtccgttggttggttcgtccaacagcaaaatgtcgggcttgccgaatagggcttgggccagcaagaccttgattttgtcgttctcagcaaggtccttcatcaaactttggtgaagatcttcgccaatgcccattgattggaggagttggctggcgtcgctttcggcgttccaaccatccatttcggcgaattcgccttctagttcggcagcacgaatcccgtcagcatccgagaagtcgggtttggcgtagagggcatctttttcggtcatcacttcgtagaggtgatcgtaaccttgcaaaacagtattcatgacggtttggtcgtcaaatgcaaagtgatcttgcttcaagctactcatccgctcgttaggacccatcgagacgtttccggtggtcggtgctagtttaccttcgataatttttaggaaggttgatttccctgcaccattggcaccgatgatcccgtagcagttaccgggcgtgaattttaaattgacgtcgtcgtagagtttacgatcagaaaacgtcatggatacgttatttacagttaacaatctgttacctcgctttattcgtgtgaaattttaagtggctgataatcgtcatcttatcttatcagataacgtgaagtgggacaaatcagattctgaaaaatgttagatttttaatcttgcatatttcattaggttagacacgacaatgggattaatcaaccgttaaactgatggtatactaggaaggattgcatttaaattgatgacgaaggagacgagtacgatcgcagttcaactttcagatgatttaagagcccttttattggcgagcaacctcggattaaataaaaatcatccgctcgcggggtggaattttctcaccattttataccatgatggtgctagtagcgcggtacccattactaaagattttcttcttcagaaatataatcacgattatcgtgactttaagggccacgaagacccgatcaaagatgaaacgatgaaacacattatggctgtcctgacgggaccagccggcttggtcgaagtgtcaccacgcaaggtgcgcgagcggatgcgtaacggattttatcatattcaccagtcgtacgtgtaccgcattacgagtagtggaattgaatatcttaaaatgatgcaacgggtcgtggatgccgaaagtaccgttacggctaacacgaaccgtatcgacgagtattgtcagctcgttgcccggctaaaccaagcaacggaaagcgccgaaagtacccaattttacaatgattttcataacatggtgacggcttacgatgatgtgatgaagggcatgcataaattggacgaagatctcgatgagctcgctaacgatttagccttccaacatgggagtgaagaggcccatcatttgcaggtcatgttaacggataaagccgtgccatcatttaaaaagatgctagcgactgggaaaccaatcaaggcaatggcttactcggatcacttcatcgagcgggtcgcccggagtcagcaggggagcgatgatttggatacggcgcatgcgattgaagacacggccagtatgctgctacgatttaaccgaacgaaagactacgtcaaacgccaaatggcccatttagcgatgagttttgaatcaaacgcgagtgcgatcgatacgagcttggattcaatgtacatgctctttggcacgattatgaatgctgtgaagttgctcgggcgcgaatacgaacatgttaagagtcagacggtggatgtgaaggccctgacggatcaaattgatgctttgatgacgcattatcagacgctacgggtaccaactcagattccccggcacctgcccatggatcggcagattgaagatcgcagcgatctattggatgccaccacgatggggccggtgacgtatacggcggatgaaagtaagcaacaggtcgccaccgaagccgacaatccagtgacagctgatgaccagtttgatgaacaggcacagacggccggtttagccgaatttcaacgattggtcatggtggatgaggatacgcttgtcgtggatcatgacttagaatttcagacggtggtcgcacgcgatgaagtcatgcgattatacagtgcgacgggctacgactcgtacgcggggttcgcaccatttgggcgaccgattaaagcggcgcgactaatgccaaccgcgcaaccaattcggctgcactgcgttaatgaacagtttagtgcttttttgccaggaggctttacggttgatttccaaagtgaggagcaggtagatgactgatttaacgagttcggaacgcctagtgattaaccagctatttgatcatggaattttcacaagcacggtgacaccgaaaatgaccaataaaatgacggacgcgattaaggcggtcaaacgaccgctagtccagcaacatatcaatacgtatctcaaacagttggttggaagtggcccagataactatcagaataattttctctttttcattggcagtaaccaattagacgaagatcatgtccacgtgttgctcgcgacccttaaggcggtgatcaacttaccagaacttaagggacgtgatgccgatcgcgcggtcgcgacgcagtcgattatgcggcaggttcatagtgaagtgccgaatctcagtgaaaaactgatttacaagatgattaccgacttattcgtgacgcgcttagaactttttaagcccgatattcccgaaaatttaagtggcgaagaaacccaagaagtggaggagtactgggatgtgagtcctgatttcaattacattgcgcaatgtatcgtcaattatttgatggcgcaaaaggatacccccaaactaacggcggttcagcgtgttaaccgcgcgttgatgatcaaacgctacattagtgcgcaaacggatccgggattatggccgattttagtcagcaataaaaatgaagtcgctgagcaatgggcccagctccaacgctttgaccttgagtgtggtaacgactatgcattgctactcgatcgaacgcaccagccaagcagtgcccggccctttgttttggcgattgcggtggcgcattcgctcggagcggggattccagccgcccacttaaatcaacggatcaaacagattaaccactcggtgttacccgatcatgtggtggcaccggggctggttagtcaggccttagaagataacgcactggcgtacgaacggggcggatttgtaattccatcccccctcgtaaagcgatttagtgcacaaaaaacggaataggagttgaacagtcgtgccatttaatcagcaattaattccagttagttttcaccttcgtaattttaataagtaccaccaactcgacctaccagcttccaagaacggtaatttaacgttgattggtgaaaacgcggttggaaagacgacgctcgccaactgctttttcccaatgctcattgatggggctatctcgacgccttcctttaaccctgctaaggggaccgataagctgggacaatcgattaatccgcgcaatagtgcccgtgatacccgtaactttgagggaatgctactcggctggggcgccggtgccatgaaggtccggaccggttatagctacattttgtggcaatctgatcagcggcaactcatcactgggattggtgcctatcgtgcccaaggggcgacgcggaaaccaacttggtggttcgtagccagtcaggaagggcttgaacctaaattggaaattgtgacgacggatgataccggtaagagcctaggtcgcgacgaatttatcgcccagaaccggcatctgggagaacaattaaaggtctacgatcgggctgaggattaccgggactacgtggccaaccacgtctacggatttaccagtgaggccctcggaaagttggccaatgtgtaccgcctcttggcgtcaccaatcttgacggcggggaatgcgaagtttaccccaattcgggaagcgctccgaaccgcgcaggaagggattgacccgcaggtaattaacgatgtcgctgaaagccagcgtgaagtgaaccggatgaacgggattctcacgcgggttcagcgcgctcaggatcggttgcaaaagctgcaacaagaacttttctggcgtaacctcaatcatttacaagaactacggctacaaccctatagcgagcgtcatcaccagtacgaagatcaccgcaagaagtttgaaagtacgggagatcagattcaacagctaagtacccaacagcagttgaccagtcaaaacctcttggatacgcagacgcagttagcagcgatgcaaaaacaaaaggccgagcaggagtatgtcatagagcgtaagcaccagtatgaaagtcagatcagccaggctaagcgtgaactggataagtatcgtaaagaggcacggcataagacggcgttgcagcaacaggttggcgaactaacgcagcagttgaccaaactaaatcagcaagcgcaagaattggatgaacgccaattaaagccgcttcaagcatcgctggacgccaagacggcgaatttgcaagagttagccgccatggtggcagaagtgacggtagccgggacgcaacaccagctagcacagtatctgcaattgatgcagcggctgatcaccaaacatcagtcattgactgagatgatcgaccatcttgacgccaatatgaaggtggtcgccgggatgcaaggggatctggatattcggattgatcagcggcttactaatccgatgacgagtcgtgcgcggggacatttgcacgaagataaccgggagatccaccaagctggaatggctaaaatgaatgagcagttcatcacgttgaacaagcaacgagcagatttgattgtcgatcatggcgatcttaagcggctccttggtcatcaggaacgcattgacgagttacaaacgattaactcgcagctccaaacctacttgcaagacagtgatgcggtccaaacgcagattaaggaacgcacgattaagcagacgggccttgatgaagagttggctcaattaaaccggatgatggatccgaactttaatatcgacgatcaagaagcccggattaaggagttacaacgccagtccgatgcgctgaagattgatctgcagttggatgtacggatggccgaaacgagtacggcactgcagaagtttaccgcagacaacaataccctgatcaaaaagatcagtgaacaacgcgggattcaaaatgagtcccaagcggcgatggggcaagatgaacaggtcctagcagacatgaaagcgcaaatttctcgggcattaacggccctcacgccgtatatggcagatgatcagcacctgaccaacgtggcggaagccgtcgcctttgtgcatgcgaacggcagtcgagtgcgtaatagtaattatgccggcattagtgctcaggttagccggttgattcatgataatgatagtaacggtgtggatcaatatgcgttggacaacctatttgaagaacgtggctatactgaaatggttggactaatgcggggcaaacgggtggcacaaaatggtgatatggttaccgtgacgttcgatattgcggaagcccagcgattgatgcgggctgatgaaaaggacgtgcagcggtcactagagacgcttaccacggggaatgacctcgcccagattgtgtatacagaagctgtcattgatcgaattgccagtcaataccggctaatcaatgaatacaaccagatgttggcagaaggtggtcgagcacaaaaaattcatttgaaggtgacattacggccggatacggtgacccagactgtcatcgatgaagcccgtgatttgcaacgggaagaacggcctgcgttgcaagatgagattgcccgccggttggaaaaactagcgaataatcccgataccgcggatgatgacgatgaattttatcgggctgcacagctgagcttggatacccggcagtggtcgaactttgtggtcctcatcaaacggcgtcaaaacggagactatgaagaagtggatgacaaatttgtgcaatccggtggttccggtgccgaaaagtcccaagcgatggttctaccgttgttgctagtgcccaaaatggtcctacaacgtgcgagccgggcggacgctccgggactcgtcatgtttgatgagttcgcggataagctggatccggagacggccaaagcctttgccaacacgattacgaactttgggtttaactttattgcgacaatgccaagcggtgcgcaaaataagatcttggccgacggtgtcgaaaacattgcttacgacgtgattgcaccgcaaacgcaagatgacggacggttccacaaaaatattgtccgcccagcccttatctggcaaatggcgcgggatcatgagtaactatcaagatgcttatgaagcgcaaacgggccgtgttgcaccggcacaagccgcacaactagatgcgttatttgataagatggtgcgtcacgaattattaccaccgcgcggccaacaagctgtcgatgctggattgacggcgcacacattgaatgatgcgcaggaaaatccagcgctgtaccagtactaccgctggatggtgacgacttattttggcaaccagccgattaatgaattacccgcacaactgatcggcaggtcgttaacctgtgccaatatttttcagacaacgctcccacaaccgctcacgttgaacgtctggcagatggcggcaatgcaagactttccgctaatgaccgaccgagccgtgattgtggaaaataacggtattcttatctggctgttgcatcgacatcccaactggccgttgattaatcaggaaggtaataactttaatcagccgtcggtgaagatgatgcagacgctggaacgacgggggatggcctacacgtacctcggagatttggatactgatggtattgaaattgcggatcgattgtacggtaaactacagcgaaccaccatcgaggcgttcacggcactgcaatccccgctcaccgtggcgaagtgggtaacgttgtacggtaaaacgccggtatcggtgcatcgcacccgtgctggtcaggtacaacaaccaatttttcagcaggagctgaatacgatccatttgcttggtaagtttgtggagcaagagcagcttattcaacagtacgaggcattgattagccagtggctcgctaaaaaaacaccgtcatcattcgatttgaaatgatgacggtgtttttgttattgtgcggcaggggcagttaagtggagatcagcagcgattttggcaagttggtcggcggtggtgtcatcaatgctgacaccatgaaccttattttcatcgtagtgcttgtattcgcggtcgcctggaatcatgatctgggttccgggctgatgatcaaggctgcgaattcgagtgaacatgctttgggcgttggccttgagggttgccaaatcgccaaagaatgacggatcgagcaccatgaagaactgactgaaatcatgtttacccgtgttggtatcggccgaaattgagccctgagctaggataccggtcaacaattctacgaccagcgagttaccaaaccctttgtagttcgagttttcctcggagtttcccccgagtgtcaaaacgccaccaccgggttgtttttcggtgaaggcaactgccgataagatgtcttcggcctcattggcgtccttgaccacttggcgatcaccatcaatggcccactcaccaggaatggggtcgccctttttggcgagaacttgaattttaccaccggagacaacggaagtggccccatcgaagacaaacgggtggggttcaccggggaaggtaaaggcaaaggcgttggatcccagaaaggcatccttagcgttagtcggaacgacgaggggtcgcgtattggtattagaaatcccaattagtcccgcttcggccgccatgcgagagtagtagccggccgtaccgaagtggttagaattacgaataacggctgtggccacaaccgaatttttggccttttcaatcagtttggtcatggcaagcgctgaggcaatgtggcccatattttggttcgcatcaacgagtaggctggtaggagtttcctttaaaataaggggctcattttgtggttcgatggtatggtctttaatcatgttgatataccaagcgagtcgttgaattccgtgcgaagaaattccccggagatcggcatctactaaggtatctgcgagtaacgcactgttgtctggcgtaaagccatatttagtaaagacttgaattaaaaactcattttctgatttagcactgattttcatgctgtgcatccttctttctcatattaataaaaaatcgtccctatgcattttgcataaggacgatgacgatgcaaccgtggtaccacctttgtttacggcctttacggaccgcctcagtcttctcccatgagggaaaagaggcgcaagataacggttgccaagcggggatgtagcgtgaacccaccccgatattctgagctcatcttcacttagtccaaatcacattcttgcaccaaccgaatgctctctactgatctgacttagctactcttctcattaacatttaatgtattaagactaaagaaaaaactaacccagaatcagaaatttgtcaagacgggctataaaaaaatccataaccacaggttatggatgcgcttggagcaattgaaaatcagttgatactcccaccgtgaacctctgtcgcttcggttactaaaacgaaggcggctggatcgtaatggtgaacgtgatcgactaagtggcgaaagtcgctttgttccacgacgaccatcagcatttcgcgttcctgaccggagtagccaccgactacttgatgaatggtcattccgtagtcggttttatcgagcaggctttgcttaatgtcagctagggtgtggttgctcataatgtaaaccgccttttttcgatcaaagccggtttcaacgtagttcatgacgatgctggtgagtcccacagcgaaaacggcgaggataaaggcttcgataccagaaacggggatgttgaaaaggcagacgacaaagtcgatgagaaacaagccaacagcaggcttaatgttgaagtagcgtttgagaatcattggtggaacggtcgtaccaccgctggaagcatcgagacggtagtttagcgccacgccaaaggcgaagacgatactgccgacgatgattgcaaggaggcgatctttgacaatcattgtttgcggcgtaatggccagtaagacggggagcatcagactgcctagtaaaatccggcgggttgtccctaagtttagcaagacggccgccagaattaacatggcgacgttgatgacgagcgtcgtccagcctagtgcaatcccaaaggtttcttgcacaaggatggcaattccagtagcgcctccggcggccacgttatgtggtgcgtaaaaaagattaatactgatcgcgataatttccagagccacaagcattaatccaccacgcaccagtggaaatttaaggtatttatccataggtcacctctcattttgacgattagtaacaagttatattattaattataacatatcgctggtaattccccgaataagggccattcaatagctgaaatactatataatagggaaatgataacgaatcgatgggggtgagaacttgaaaaaaattgcaccacttttaattggtatgggcgcgatcagctatgggattcccggatcactctttgagctggcgaatcatcaaggagttacgagtggaatattgttggtcatgacgtttttaatttcctgtgtcatctttaatttagtggggattgtggtaccacgacatcagcgacatgctcacagtcaccgtcaggcttggatcgtgatgctatcggggacttcgatggcgttcacgaatacgttctacattatggcgttacagtacatttcggttgccgtagcggccgtcatgatgatgcaatcggtatggctgtcaatcgtgttggcggcgattgcggatcgggtatggccctcgctaatgcagttactgagcgtgatcgttgttttggcgggtacggtgatggccgcggggctgttgccactggacggtcacgtatcacttttcggaatgggactggcctttttggcggccctcgcatacgcggtgacgattcaatttaccggtggggcggccagcgatttacaccccctcaccaaggcacgcctcatgagtattggggcgttggtactcgtggcggccatttgggggcccacgattgcgccgtctgctaactggggcttagccttgaagtggggcgcgatcacgtcgttttttgtgatggtctttccactgaccagcttttcatacttcatgccgtatctgccaatgggaatcggcccgattctatcatcgctggagttgccggcttcggtcatttttgcatttatcttgctgcgtcagacggtcacgccgcttcaaatgatgggagtggcgatcatcattacgacggtgattgttactaattggcttcaggtacgccatcggcaacagcaatcgtggctgaagtaggggaggtgagttcgtgaaaactcaatttcaaattggtgaaatggcggctattaatcacacaaccattaaaacgctccggtattacgatcagattgggttatttgaaccacgctacgtggatccgcacactgggtatcggtattacgaagccgaacagtttgaacggctgaatacgattcagtatttgaagacgatggggttgtcgctccgggagattcaagtgcacttggataaccgcagtatcgacgattttcaggagctattggcgaaccaagaggctgagattgatcggcagattcggaccctccaatccatcaagcaccgttttaaacaccgaattgaagatttagaaattggccgccaccatccaccgcttggtcacccgcagcttgaaatggtgcccgagcgtcgggtgattcgcttggatcaagtcattcatacaaatgatgagttagaggtggccctccggcagttagaaaaccaagccgaattacaggcggttattttcattggtggggtggggctggtcatcgagcaacatgaactggcccagcaccggtttgatgagtaccacggaatttttgtgttagtggacgaaacgacgacctcaccactcgtagcgaccatccccgccggttgctacgccagtatttaccacaacggcaatcatacccaatcggcgcagtactatgatcaattgttgcactacgtggccgatcagcgaaagacggtggcgggggatgcgattgagcgcacgattattgaccagtacgtttctcgtaatccgcaagattacctgacaaaaattgaaattccaattaagaattgaccctccacctagtggagggtttattcttttaacagaaaacgaatgggggaacggcatatatgattgggacaatttttaataccgcaatgattattgtggggagcttgattggcagtctgtttaaacgggggctgaaggagtcctatcaccgaattttaatgcaggctctcgggctggcggtggtgttactgggaatcaataccaccattacccatatggcggatagcaagtatccggtgctcttcattgtgagcttggcattaggggggctgattggtcaggcgcttaatctggaagcccgctttaatcgactgctgagtcggttttcagggaaaaataatttagcgcagggcttgtcgacggccgtcttactgttttgcattggaactttgtcaatcgttggaccgatcgaggcggcattgcgccataacaacacgtatctctttaccaacgggatgctcgatggcattacttccatggtgctggcttcgacgtttgggattggtattatgatagcgagtgtgattttattttcatggcagggaagcatctatgccctgtcgctcctaatgcagggcgcgattagcaatgatctgatcactgaattatcggtcgtaggtggtattttaattttagcctcgggacttaatattttagagatcaaacaaattaataccgtgaacctcttgccagcgctagcgatgccggcgattctcttacccatcattcatttagtggtcggctaatcagtagttagttggttgaacaaaataatttaaaactttattagttcaaggcattgatttgatctatcacgatgatttacaataaacacaataagtcggaagtagttaaatagaaaattctgatattgcaatagcaatccgctcaagttcgcaatttgaacatacgacccgcacatgagaaagacatgtccgggtcgttttctattctaaatggggagacatcgatatgtatagcttttatggacaaccaaaatttaagattaatgcccagcaaccgatgggctatgagctatttattcgtgagtggactgctgggcagtggcagcttccccaaaatttcaacacgattacaagtacaactctggaacgcttattgtgtcaggtgattaaaaaaatgcccgccaacattgaaatgctatcctttaacctggaacaaaatcagtttattcaacccgaatttatggctatggtcgctagggttcagcaacaaacgtcaattcgaatttttacggaattgacggaacggttagcaccgggtgtcagtgaagcagaaattatcgcggcggcccaacggtttcatgatcagggattgctggtctgcattgatgacgtcggtaccggtcaaaacacccccaatatggtactgaaaatgaatgcgtatattgatgaatataagtttgcttttcaaaatttccggccctttgaacatattgcggagattgctgatgaacttgatttttggtacaacctagcgcaccgtgaacataagatgttggcgttggaaggcttggaaaccgaagaagacttagagacggtcaagcgtgattatccatgcgatgtgattcagggatactatactggccgaccagagtttttggtacaagattagatgtttcacgtgaaacaaatttagactgacaaatgttgatttgtcggtcttttttttgcacgtaagtatttagattgcgtatgggtggtaattcaacataggcattagacatgttggcgtgctgtaagctatgctttatctgttgagaacggcacgtattgtgcattcttaatttgttaacgaagtgattggtaggtgaatttgttgggagttacaaaagatattttgaaacaagcgaggaatggtggaatcattgaatttgatcacactaattacagtcaaattgacacaatagttgagcaaaatgctgaattaacaactctatttaataatacttaccataatgcagctggaagacgggagttgcttagtaaaatttttggctataatctgccagcgacaactaccattaacgcaccgtttaatacggactttggccgacatacgcggatcggcgagcgggtattcattaacaaggattgcctgttcgtggatctgggcggtgtgaccatcgatgatgatgtgttgattggaccacgggtgacgctgatttcagtgaaccacgtggagaatcccagtcagcgccgcaatttgatcaccaagtcggtgcatatcaaacggcatgcctggctcggggccaatgtgaccgtgctccccggcgtaacgattggcgaaaacgcaatcgtgggcgctggttcggtcgtcacgaaggatgtgcctgataacacggttgtcgttggcaatccggccaaaaaattacgcatgaccaatgtttaacgagggaggaattttagatgaacgaaaatgaattcgtcaccttagccaacggtgtgaaaatgccatcagttgggtttggtgtgtttcaggttgaagatttatcacaggccgaatcggcggttacagcagctatcaaaaccggttatcgcttgattgatacagcgagttcttacaaaaatgaggaagctgttgggcgtgctattgctaaatccgatatcgcccgcaaagatttattcgtgactactaaggcgtatattcagcaaatgggctatgagcagacgattcgggcattctatgaatcactgaataaactcggtttagactatctagatttgtatctgattcatatgccatttggtgactattatggtacctggcgggcgatgattgacctgtaccaagctggaaagatccgcgccattggcgttagcaattttgatgcagcccgtctgatggacctgagttacaattttgacgtcacgccaatggtcaatcaaattgagcatcacccgcattatcagcgcctttcggagttagcagtaatgcgtgatttgggggtgcaaccggaagcgtgggcaccatttgcggaaggcttaaacgggatgttcgacgaaccactattaaaatcgattgcggcgaagtatgataagtctgtcgcacaggtcatcctgcgttggaatctacaacagggagttgtcgtgattccaaagtcggttcatgaaaatcggatgattgaaaaccgtgatgtatttgattttgaattaactgatgccgagatggaacagattcaaagtttagacgagggtcagccgtcaatgcttgataccactaaacctagcgaagttaagcgagtctacgattatttaaataatccggtactcactagtttgtaattgtcataacaggtaaggagcgaatcaaaatgaaaagtacgttatttgtaaaaccaggcgaagtcaccattaaagacattgaaaaaccaaccattcaggccgacgacgatgtgattatccatgtcgtacggacttgtgtttgtggctctgacttatgggcttaccgggggctagaagataaagcccctaattcggaaaacactggtcatgaagcaattggtattgtggaatcagttggttccgcaatcacgagcgttgtgccaggtgactttgtcattgcgccatttacccacggttgtggtcactgtgccgcttgtcgggccggctttgacggcgactgtcaaaaccacaccgacaactttagcaacggcattcaagccgaatatgttcggttccaacatgccaactgggccttgatcaagattcctgggcaaccagccgattacagcgaagaaatgctcaattcattactcagtttggcggacgtgatggcgactggctaccacgccgctcgggtggccaacgtgaaaactggtgatactgtcgttgtcgtcggtgatggagcggttggtctgtgtggtgtgattgccgctcagatgcgtggtgccaagcggattatcgcgatgagccgtcatgaggatcggcaacagttggcgcgcgaatttggcgccaccgatattgtcgctgaacgtggcgatgaagccgtagcaaaagtgatggcactgacgaacaatgcgggtgcggatgccgtgcttgaatgtgtgggtacagaacaatcaaatgaaacagccatgagtgttggccgtccgggcgcaatcgttggtcgtgtgggcttaccacatgaacccaagatggacatgacgcggtcgttctacagcaacacgatcattgctggtggtcctgcttcggtcacgacttacgataagcaatcgttgttgaaggccgttttggatggccaaattcatcccggtaaggtcttcactaagtcgtttgcactggatgatatcaacgccgcgtaccaagcaatggctaaccgtgaagcaatcaagtctctgattgtgattcaataaaaatagccatacttttatagcatgtaaaaaagcaaaataagaggttagacaaaatttgatttttgtctaacctcttatttgcctatcaagactgattattcaaacgaaagtcgcaaggcggttaattgagttcggcggatatctgattcagcaatgtctttgcggcagtcgacaagcgatgccctttgagccagacaatactcgaaccggtggtcaacgtgggtgctaaggggatgaaggtgagctcggattgattcgtattgatgatgccatcaatgcacagcgcgtaaccgacacccgcagaaaccatcaaggaggcgttgtagagtaggttgtaggtcgccacgacatgaatatcgcggttgctttcgccaaaccagtcgttgaggacgtcggtcatgcccttttgctgcgaaataatgagcttctcaccaagcagatcgtcgagtttcaggtgatcccgctgtgcaagcggcgaagtattcggtacaagcaggccccagcgactttcaccaggcaagtgcataaagtcgaagtcacttttctctgccggttccataatcacgccaaaatcaaatacgccagatttaaggcgggcgcgcacatcgtcagcgttagtactggtcacgttaatttgaatatgtggataggtatcttgtagctctcggattgcttgggcaatcgtcagaaagtttttggcttcggcactgccgatccagacagagccactaatgtcttgattttcatgaatgttttcgagtgttttgtccgttaatgacaaaatctggcgggcctgcgccgcaaaatattcgccgctattggtcagttgaatcgaacgactaccacgctcaaacaagatgatcccgagttcttcttctaagtctttaatttgtcgcgagatggtcggttgcgaaacatgtaattgttgggcagcccggctgatatttttttcgtcgaccacggctaaaaagtagcgcaaaacacgtagttccattaaatccatctcctataactaatttgtatatatttggatttattataagtattagacattgctaaaatcaagtcctatgattaaaacatcgaaataaagtaaactaacaatttagtaaacggagggtttattgatggataattatatttttgaattgagtacggcagtgacccgcgaaacggtacgttaccagaatcgtttcggcattgaattagcggccgacgtgtataagccaaagtcgtttgatgagtcccggcaatacccagccttagtcgttggcccaccttacagtggtgtaaaggaacaaggtcccggcatctatgcccaagagatggcaaaacgaggattcattgcactagcatttgatccatcgtttaacggttttagtggtggaaacccacgacatgcttcctcaccggatatcttcgtggaagatttcttagccagtgttgattatttagggactcgatcatacatcaaccgtgaacagatcggcgccatcggtatttgcggtagcggcagttttgccttgagtgcggcgcagatggatatgcggattaaagccgttgccacggccagcatggtcgacatttctgcagcagcgcagatggggaccaaagaagaacggcaagctcagttgaaggcgatcggcgaacaacgatatgtggattttgaaagtgaccaacctttgctgggggcccgtggtgccggattagctgacgaaaccgatgatcctgtcttccgcgaatttggtgatttctactttaccagccgtggttggcacccaaattcaatcacgatgtttacgcaatcgtcaaatgcttcattcatgaatttcagtttgttgagtaagatcgatgaaatttcgccccgtccaatcatgttgatcgcgggtgatcaggcattttcaaaggacttttctgaacaggcatatgcagcagcaaacgaaccgaaacaattagtgaagattgagaatgcgaaccacattgatttgtacgatgatacgactaaaattccgtttgagaaattggacgcgttctttaaggaaggattgaaggtgaagtaatgactgctagtacgaatgataattggtcggcagtggagattgaagcatttaccacggccgatgacatgaaaatctcgccattttatagtgatggtaagacgtacggcacaccgacatggatttggtcggtggtggtagacagccaactctatgtccgggcctggaatgggcaacgatcacgctggtatcaatcggcgatgacgcaacatggtggacgcgtctatttggcacaacataatcatgaggtgacgtttgaagatgcgagtggggatgtcacactggatgctaagattgaccaggcttaccaaactaagtatgccggcagtccctacatgcccccaatgattcaagatggcccacggagggccacggttagaattttacccaagtaaaggagaacatgatgacaaaagtattgattattgctgctcatggcgcgatggcgcaactggtcaccaaacggttgctagcagaaacggatgatgagctggtcctatttttacgcaatgccaaaaggttaaatgactacacagacaattcacgggtcacgctgatcgaaggcaatacgctcagcacggatgacttggtcgccgccatgcaagaaattgatattgtgtattctaatgctggcggtcctgatcttggtgaccagacagcacacatcttggccgcaatgaagcaagtgggtctaacccggctcatctatattagtgcgttgggtgctcatcacgaggttgtcggtgagtttggtcagtggaatgaacaagctatcagcgcatttttaccaggtttccgtcggtcggcagcgttagtagcacaatcagcagtggattacactgaagtgcggccttcctggctcaccgatgcggacgaaatcgattatgagctgatcaagttaaatgaaccatttgttggtacggaggtatcacgggcaagtgttgccgactttgtttttcaagtgattcaagatccaagccggtacgtgcgagaaagcattggccttagtaaatcaaatacctccggagataagccaagctggctgtaggcagtaagtacaaatcaagatatgtgttgctatttattttggttgtgaaaaaggtgctagttggatttttccactatcctagctccttagttaaagtgaatgagtacttttccttttggatgaccgttttgtagatacgcttgtgcctcgtttacctgctcaattgtgaatgtggtcggatctactgcaggtacgattgtgttctgatcgattagagtgctcaactgttggagttgtttaccgttgctgcgcacaaagatgaagtgataagtcacaccatattgtttggctaaacggtccatctttcgcccattcgccttaaagaggatttttttccaaaaaggcatctgttgtgcttcggcgaagctaccatttggtcccattcgtagggaaagcaactgtccgccacgtttcagaatggaaagctcatggagcagttcggtttggccgagtgtatcgattacgagatctatttcagatagtttttcccaatagttttctgtcttaaagttaaaatatctatcagcaccagccttgagtgtccgttcacgagcttctgcactaccggtcacgatgacgttcattcccatctgtttggcgattggaatcgccatttgaccaaatgaaccagagcctccgggaatgaataacgtttgaccaaaatgagcctttagaatttcatgcaatgcttgatatgcagtcaacccagttagtgctgcggctgcaccggttttaaagtctaaagttaacggcattaaagcgatagcatctgcgttaaccgcaacatattctgcgaaagcaccaatatcagagatggggagtcgtgtgtataccctgtcatttacgctgaaacctgtcacgtctttgccaacttcaacaatctcgcctgttagttcattacccattgtttggggaagtcgataattttgaatgagccgcaaacttccggtcccaatcaatgaatcaagtgggttaactgccgcttcttttacttttattaatacttgtgagtgattggggcgaggcatatcgacgttacgaagttccagtttgtaattcttggtgtaccgagttaattgggctgctttcattgcagatcctccattcatgagcaaagtaacataattcgacttttgtgactagcaacataatattctcactggtaacatttgtcaaatgttgttactagataatttctgtggtattctcaatctatgattataaacacggaggtgcctgctttggaaagaattagccgcgataagattatcgatgtggccagtcggttgattgcggagaccggaagaacagatgtgtcgttgagtgcaattgccgatgctcttggcatcacacacggagcgctatataaacattttgagaacaagcaagagatatgggaagctgtggcatctcgttggtttcagcgacatattttggatcatgtaaatcaaacgtgttctctgggtacagaaggtattgatactcctgtgaaggttagattgcatgattggctgtgggcttttgttagtgccaagaaggaagcatacagggctgatccacaaatgttttcgctgaacactcgctatattgataacaatccgttagccctacgacgagttttgcagccagcgtatcaaatgattgatcacctaatggaatatgaagatccgcattttaagcgagctgaaactatcctttcggccttttcaatttttacgttgccaaactttaaggaaacttgggattggcctgattaccaagaacggtttgagacgatgtggaaactggtgagttcgggagtttagcgtagcgattctgtggatacattctcgtttgagcttctgcgaaatgtgattgacgaaagtaaacatggcgattatccgaaatgatggctaagtcggaagttcagtattttatttccgattgttacaaattgagtcgtatcaaattttcaccttgttagatgtcgggtattcgacaattgctatttgtttgtgtttacacagaaatcacgttaatgcgctattttaccccaatcaatggatggttttggtttcacgtgaaacacaaagaggcgttgatgcaagtttgaccttgtatcaacgcctttttaggtactctttatgattgatgagcttgattgattccttgccagcgttgtgaaagttggttttcgatgtgcaaatgatccaacagtttcatggtgttgtgattgatgatatcgtcaatggtttgcggattgttatagaatgcggggatggggggaatgatttcaacccccatttttgatagcttgagcatgttttccagatgaatttggttaaagggtgattcgcgcgggacaatcagtagcggccgccgttccttaagtgtcacatcggctgctcgtcccaccaacgtatcgcccatgccggttgcaatggaagcgatggttttcatgctggcgggcacaatgaccatgccatcatgtaagaaagaaccactggctacggctgcgcccatgttgcgttcgttgtagacttcgtcggcgaggtcgaggaccccctgtttcgtgtagccggtatgctcgatcgcgaggttttcccaagcccacttagtcatgatgaggtgggtttgaacggcgggattggcctttaacgcctccagtaggcgtaagccgtaaatggtgccggatgcaccggtgatggcaacaacaatttttttcatgagtgtgcgtcctttctatcaaagttcattatgtatgccgggcggtcccgacaggtcacgacggattagccgtgaaaaggtgctattatttcaggtaatcttgccagtttggcatttccttgaattgcgcccgtgtgaaggatttcttcatatcgtatgggaaggtaccatctaagacgagtttggaactcatcccccgcacacggatccgagctggatcgtattctggtaattcggacggatcaaggggatggttacgcaggccttccaagaccatgatgtctttatcggcttggaatcgggtattaatcgtccacatcacgtcgttccaatcaaaaatatcaacatcttcatcgacgaggatgacggtttttaattctttaaacgatgagaaggcgagcaaggcagcttggcgttgaatcccttcgtcgttagcatcgtccttgtgaatctgcatgatggtcatcaatttaccaccacctgcaggggcgttgtagacgtttttaactttccctgggattgcgcgatcgaccaggttcagaatagaagcttcggttggaatgccggccattgaaacgtgttcttcggatggcccaatcgttgtttggacgatcggattgtcttgacgatgagtgacggccttaattttaacgatgtgaacggctgggttggcagtaccgttatagccagggaattcgggcatcgcgtagccggtgttagtgttgatgtcttcttgcatggaagtgttgggcatgatttcagcttccacaatccattcagaacgggcgataccaagttgatcaacggccatcccgtcaacgacttggacgggttcgttacgaagcgcacccgcgacttgtaattcattgtagcctagtggtgtcgtcggtggctcgaaggttgcaccgatggtgattgctggatcaagaccgatgttgatggtgatgggcattggtttatccagcgcttcgtattctttgagaaaggcaccaatgtggcgaccaccgggcatgatgtacatgccgatcgtgtctttatcttcgaggaccatccggtgaatcgtgacgtcactttgttttttatcaggagatgcgccgtaaacgacacccatggtgatgtaggggccagcatctacgggggtattcgttggggcagctagaattttgcgaatatcaaaatcaggttcgctggcgtagtgaacaacctcttgtgcgggagcatctttgtgatctactttgactggtgcgacgggatgggtgacggcgtcattcagcatttgtccgagggtgtgccaatcgtgatgtaaaatcgtgccgacccgtttccggcttgcttggagaccgattaatacccgagaacccggaaagccctttacgttattaaacatcattgcggggccttcttgggtgggccgcattacggtaccaccagagccaatataccggtataccccggctaaatcagcatcgggatcaatttctttatctgttgcgtggtattggccgggcaagtctttaatctcgtccagtactttacgtaaatcatacggttgttcagtcatgctaactacctccaattcatttgttatctctattatcgattgcttggggaagaaaaacaattcaaggttgtcacggttctattccactttggaatgaacgcaatcaatctaagttaagcataacaaattggaattaccggtcacaagggcaacgggaaaacgtttctgattggcattcagccggatttcagagtatgttgaatgcatattaacctcagtagagaatggatgagaacgcgtgaaccaacaggatgaacacaaattagcaattttaaaccaactgatgacgcactatggtccccagcactggtgggaacatgaaaaccgtcttgaagattgggtttcgatgattttagtccagcagacaacgggcattaacgctgagaaggcggtggctaacttagccccatacctgacagtgacgggcctcagtgaacttgatatggatgaactccaacgattaattcgaccggccggattttatcgtcaaaagagtaactatatcaaaactttgattgcgtggtacgtggcgcacggcgccaatcttgcggctttcaagtcaactccaacgcctgatttgcgccgggagttattggcaatcaagggggtgggcgcagaaacggccgatgacatgctgctgtacatttttgaacggccggtgtttattgcggatacgtacgctcggcgcctgtttaatcggctggggtttggtccctatcagacgtaccatcaaatgcaacaggaatttgacgcgcttgctgcccagcaaagttttgcaacgtgtcgggaatggcatgcggtgattgacgagcatggcaaggcctaccgccgagacgaggcgttggatgaatcatggataaaataagggtgcgatgctaaccgattggaagccgggaattttaactgataaacgccaattgcgtgataatggttgcgctttcttaaatcagctatcataataaaacttattaaagctcatggatagttaatggagggaactaaatggcctatatcgaggttaaaaatgaatcaaagcggtatcaaatgggagaaaccacgattgtggcgaataatcggctgtcgtttgatgttgatcagggagcactgacggttattttaggccccagtggtgcgggaaaatcgactgttctcaatattttaggaggcatggattcgcccagcgagggccaagtcatcattgatggggttgatattgcccagtttaatgataagcaactgacgcagttccgacggacggacatcggattcgtatttcaattttataacctaattcctaatttaacgacgcgggaaaacgttgaattggcatcctcaattgtgcccgatgcgttagatgccacgcaggtgctcaaagatgtcgggttaggcgaccggctcgataattttccgtcgcagctatccggtggcgagcaacagcgggtggccattgcccgggcgttggcgaaaaatcccaagctgttactatgcgatgaaccgaccggcgcactggattaccagaccggtaagcaggtactaaccctgctgcaggatgcgagccggaaggcgcacaagaccgttttggtgattacccataattcagccttggcaaagatggcggaccgggtcattcggatcaacgatgcacaggtccgtgctgtggaagataatgcacatcccctgccagtcgccgagattgaatggtaggtgagctgatgaaacccttaacgaagtatatgtggcgtaatattcggggttccctcggacggtttattgcgattgttctgatcattatgttaggtgttatcacctttgtcggggtcaaggcaaccggtccggccctgaacgattcgctgaataaaacggtcaaagatctgcacttgtcagacgtgcaactgatgtcatcgaccggcttcaccaagcaagatgtgaaaacagctgagaaagtggcgggcgcacaagcggaagcggtcaaatttaagtatgttaccggtggtgcggacagctatgcggtggccttgtatggctacaacgcggcaaatcagcaaaatcagttggcactgcgaaccggacatttaccccaaaatcggcaccaaatcgtgctcgactaccgcactcaggaaaagtacgggtaccaccttggccagcactttactttcgaccggtcggcgaagctgcgtcatcgcacatacacgattgtcggctttgcggattcaccgagctacattgatagcagtgtgcgggggtcggccaatgtcggggatggcacggttaagttctttgcctatattccggccagtcagatgaatttaaccacggccactttactcaacgtctctttcaaaaagctacaacacacagatacgtttagcgaccagtatgatcgggcagttgatcggcgggtagtacagctgaagacggtctttaaagcccgcgctaagacgcgcagtgcggccttgcttaagcaggcggcaccccagttagcgagccagcaacaacaactcgatcaggcccggcaacagctagtcgcgtcggggttatcgacagcgcaagcaaaacagcaactgcaaccccaacaggcgcagctaaatgcggctttgcaaaaagcacagcgggctgtgaagacgacttacacatggcaaacccgtgacgacctccctggctttgcggcgtatggggaaagttcggatcgcattgcggcgattgcgaacgtctttccggtgttcttcttcttggtggcggccctcattacctttacgaccatcacgcgcatggtcgaggaggcgcgggcccagattgggacattcaaggcattgggatattccaagacggcgattgcccggaactacttaagttacgcgtttttggcggggatgattgggactgtgatcggcgcgtttgtgggcaatctatcgttaccccggcttgtgttatcactatatcggtcctacattccccttactgcggttgtccacttgcagtgggggctcttcggaatttcgctcttggtggccatgctcaccacggtgggagcggcattactggtggtacgccgagaactggaagaaaagccggcagaactgatgcggccgcggtcaccgaaatcggctaaacgagtgctgctggaaaaaataacgccactttggcgccgattgaacttcaaccaaaaggtcagttaccggaacatgtttcgatataaatcacgcatgctgatgaccattattgggattgccggcggcactgggcttattttgactgggtacggcattcaaagttcgatcggtgcgagtggcactaaacagtacggagaggttgtgaagtaccaggccctggtacgattagcacatgacgatcaggatcatcaggccgtcaaaatcttgcagaacaatgcacagtaccggcgacacacgcagattagtgccaacgtgggggatgtgcgttctcatggccataaggttgacgatgtgaacatttttgtgccgagttcaactaagcagattaagcagtttatcaggctccgaagtactgaaaatcagcatgcaattcagcttcagcaacacggagtcgtcttgtcagaaaagatggtacagaagttgaacgttcaggtcggggattcggtgaaggtgacgacgacggatcatgaccacggcactgccaaggtaacggcgatcacgcaaaattatgtgggggactatttatacgctagtccagcggcttatcggcatttgttcggtcaaacggccactaacaatacgttgctggtgagcctcaagcatcaaacccagcgccaacgtgatcagctagcacaccgcctgttgaaggatggggatactcagggaacgagttacacgagtgatcagcgtcagacgattacgacaatgtcggggagtctagatacggtcgtcctcatttttatcctgctgtctggggtgttgtcctttgtggtattgtataaccttacgaatatcaacgtttccgaacggattcgcgaattatcaacgattaaggtccttggattctatgatcgagaggtgacaatgtatatcgtacgggaaaatattatgttgacgctgatcggcatcgtgctgggttacggtgtcggcaatcttctgacggcctatattttgcaccaggccgccacggatcaagttatttttccactgacgatttattggccgggctatgtagtggccaccctattgatggtggtcttcacggtcattgtgatgggggtcacgcatcgcagattaaagtgcgttgacatggtatcagcgttgaaatcaaatgaataataaaaataatcccgctcgcctttgataagtgagtgggattatttagatgaaacgaattcaattaggattgattggcgaaaatatcttccattgcgtcgattgcggtaccaccataaacgtaggcgggcccaccgctcatcaggatggcggtgttgacggtttcgacaacctcttccttagtagcacccgcggcaatcgcatggtgaagatggtctaaaatgcacccctcacaccggatcgaaatggcaacacatagacacatgagttctttttgcttatgagatagggcgccgtctttcaaggcggcagcgtgcatcgttaagaagtctttgccggtatcaccagaagcggccgttaatttctggtagttactattaatttgttgaaacttatcgctatattctgacatgtgtactccactccatttctaagttgattacggcttgatgataacgctttcaaataactaagacaactaaaatgatagggcaatatcacggatctttgacggtggtaactgtctttttagaaacgaattaagccaaattgacggccgccacgggcgttccacttgtacttgactggcgaaatgattatagtcaaaagcataaccggagggagaaatgcattgattgaatttgagaatgtaagcaaaacgtatgaacaacagcccgcgctaaacgatctgaacctgacgatcaatgatggtgagctgtttgtgttggttggcccgtccgggagcgggaagaccacactccttaaaatgattaataaactaattgaaccaaccaccggaacggtcaaaattgacggccaagacgtggaggccgcggatatccgccagttgcgtcatcaaattggctatgtgcttcaagcaggggcgctatttccgaatatgaccgtggaacaaaatgcggcgattcaacttgatcagctggattgggatgttcgccaaaaacatgaccgcattaatgaactacttacgcgggttgatttagatccgcaaacctacatggagcggatgccaagcgaactatcgggtggagaagcccagcgggtgggcatcgttcgggcattagcctcacaacccaagctaattttgatggatgagccatttagtgcgctagaccccttgtcacgccgccgcttgcagcaacttgtgctaaagcttcatcaggagttggcctgcacgatcgtatttgtgacccatgatatgcaggaggccattaagctggccgatcggttagccgtgattcataatggcgatttattgcaagtcggccgatcacaagaaataattgctaatccggctagtgagtttgtggctgactttttcgacgatggtacgacgcgcaatcttttcttaagtcaggttttgaaaaccggatttggccggttaccggaatcagccgatcagccggtgaagctggctggcacggacacgattttcacttgggccgatctcttgaatcaacacccccgccaactcgtgacggttgacgacctcgtcttggaaccacaggacctgctttcttacatgtcacagattgggcaggtgagctaaatgacagcatttggtaattacctcgtcaagaacggcaatgacttgctggcgtcactgggccagcatatttttatttcactggtagcggcgttaattgcaattgtgatcgcgattccgttggcggtggccttggttaatcatcgccggtggggcgaagttgtccttcaggtaactggcgtggtacagacgattccaagtctggcggtcttaggattactaattccgttggtggggattggaacggttccttcgattattgcgttagtcctgtacgccatcatgccgatttttcaaaatacctatgcggggctgaccaatatcgacccgctgttaatcgaagcggcagatgcgtttgggatgtcacggcggtttaagctgtttcgtgttcagttgccacttgcgatgccgatgattctatcgggaattcggattgcagtcgtcctaattatcggaacggcgacgctcgccgctttaattggtggcggtggtctggggacctatattattacgggaattcagactaacaatgatcaggcattgattgctggggcggtgctatccgccattttagcactggttgctagctggttgatcaaagttttatcacgggtttcggtgaaaaaactcctatacggtctgggaatcttagcggttttaggggttggtggaggcatttaccaccaagcaacccagcccaaggaaacaataacgattgctggtaagttgggcggcgaacccgatattttgattcacatgtataaagatttgatcgagcaggataatccgaatgtccatgttgtcttaaaacctaattttggtggtacgaccttcctattcaagggattgcagagcggtaaaattgatatttatccggagtttaccggtacggtactgcaaacgttggttaagcagcccaagcatgtcagtcatgatccggctaagtcgtaccaacaggcaaaggcactcctgaaaaagcagtacgggttggactatttgaagccgatgaagtatcagaataactactcgctggcgcttcgtaagcaggatgcggagaagtaccatctaaagacgatttcggatttaagtcaggtttcgacaacgttgacgagcgcctttgacactgacttttcgcagcaaaaggatggctatccgggactgaaaacggcctacgggttagtcttcaaatccgtccagacgatggaaccttcgctgcggtatcaagcggtggcggatcgtaaggtcgatgtgaccgatgcgtatacgactgatccgcagattcggcagtatcatctagtgacgttgaaggatgacaaatcatttttcccagcctaccaaggtgcgcctttgatgaaggcgtcatttgctaagcaacatccacgggtggttaaaagtctcaaccagctcagtggtaaggtgacgacgaagcaaatgcaggaaatgaattatcaagtgacggtcaagcaccgaaaggcagcgaccgtggcacgtgaatttttgcaacagcaacacttactcaaatagggtgaaggcaccttgatctttttttggatcaaggtgcttttttagaaaataaaggtcaaattttttttgacctttagcaatcaagtttgaaggaaaattacttataatcattgatataacagcgcttatagcttattttattggtgaaataaaatgtttgacctttcttgaccatatgacacaaacgtggtatattattcatcgaggaggaaagaaaaatggaaattgatgttaaggcttatttggacgacaatcacctcacgatctatcgggtcgccaagtcagctgggtatggttattcaacgattcataagtcatttaacaagacgcaatccgacgccacctcactgaacttgcgagatctcgatgcactcgcaaccgcaatgcaccagaacatgtgggaagtactccgcgaattggaaacccactatttaaaataggcgactcaaaaaacggtgctggtgatcgatatctggtagccgtttttcataacacaagacaattaagcttaaaaaagcgatcctaaggaggaatttaaatatggcaaactcattttttggtaacgacccatttttcggcgggcacgatttcgacgatatttttaatgaaatgatgcggggaatgaacggtgttaactcggaaaaccgcttcctagtcaacggcgaagaagtgaccccagaacaatttgatcaattaagaaagcaagctgctacccagcgggcgcaacaggcgcaacaagcgggtggcgcaccgactgcggtagccggtaagaaacaaggtggaattctggaaaagctgggacgcaatttgactcaggaagccaaagatggcaagctcgatccggtgatcggtcggaataaggaaatccaagagactgctgaaattttaagtcggcggattaaaaacaatccggttctcgttggagatgctggcgttggtaaaacggcggttgtcgaaggattggcacaggcaattgtgaaaggcaatgtaccggccgcaattaaggaccatgagctaatcagtatcgatttgtcgaacctagaggctgggacacagtatcgcgggagtttcgaacaaaatattcaggatttagtaaaagaagttcaagcacgcggaaacgtaatcttgttctttgatgaaattcaccagattttgggtgctggttcgacgggcgacgaatccggttcgaaagggctagcagatatgattaagccagctttaagtcgtggtgaaatcacggttattggggcaacaacccaagacgaataccggaacaccattttgaaaaacgctgctttagcacggcggtttaatgaagtgacggtaaacgcccccagcgctgaagacacgcttgaaattttaaaaggggttcggagcctgtacgaaaagcaccatcacgtaactttacctgatgatgtattgaaggcggcggtcgattacgcggttcagtacattccacaacggtctttgccagataaggccatcgatcttgtagatatgacggccgcccatctatcagcacaacatccagtgacggacaaggtgtcactcgaacaacaattgaaggctgccaagcaaacgcaacaggatgcagttcagaaagaagattatgaacaggcccagaagtcgaaacagctggttgagaaactcgaacagcaattgaaggcggggacggacgatcaacctaccgaaaaagtagtcgccacggttaacgatgtcgccgaatcgacagaacgactgactggaattccggtctcccaaatgggcgcttcggatattgaacgcttgaaaggcattagtcagcggcttcggggcaaggtcattggtcaagatgaggccgtcgaaatggttgctcgtgcaatccgacggaaccgcgcgggattcgatgaaggaaaccgtcccatcgggagttttctgtttgttggtccaaccggggttggaaagacggaattggcaaagcaactggcgctagatatgtttgggagtaaggacaatattatccggctcgacatgtctgaatactctgatttgacagctgtttcgaaattaatcggaacgagtgcggggtacgtgggttacgaagacaacagcaatacgttgactgaaaaagtacggcggaacccatactcgattgtgctactcgacgaaatcgaaaaggcccatccacaggtattgacactcttgttacagctcatggatgatggccgcttaactgacggtcaggggaacgtcgtcaactttaagaatacggtcgtgattgcaacctctaacgccggattcagtagcgataccgctgacgatgatcagcaaccactgatgaaaaagttggaagcttatttccggccagagttcctaaaccggttcaacgggattgttgagttcagccatttgaccaaggacgatttggcccaaattgtggacctcatgattgaagaagttaaccaaacgttatctaaaaaagatattacgcttgaagtgactgataaggctaagagctggctcatcgatcaaggctatgatgaagccatgggggctcggccactccggcgagtaatcgaacaacagattcgtgataaggtcacagatttctatctggatcacatggatgtgaaggctttaaaggcgggtgtggttgatgatacgattgaaattagtgcaaaataagatttgttaaaacgaggcttgtgtttcacgtgaaacacaaagcaatagtcaagagcgggtacgctaatctcacttatgggatgggggtgcccgctttttgtcgaccattttttacaatcgttgtaaataaaatggaaattgggtgccaagtagtacagtatttttaaaaaaatatggtagaatcacaaataatatcagaaacttgttatctgttgataaattaaatacttatttcattattagaactacatttggggaggtgtaggggtgaattactacgtttttttaaataaaaatgatcaagaaacgcttcaagttgcctggcgattaacgacgtcgaccagtaatgaattgtatattaacgaaattgtcgactggttaaaactgtcacactataaattgaatcggctaattagtgacctgcaaagcggattggcgcagataacgcatgatcccaaagcggttcaggtgagcaatggcaaactaatggggcgtaacttaaactgtgagtattttcgtcagtttcagttgatgctgttgcaccagtcattaccatttcaaatttttgaatttgactatgttaatcgccagcggcagtcgcgccagacttttttagaacagcactttattagcaagtcgacgtactataaaattcgcgcgcagattgaggaacatttgacggccgcgagcggctataaaaactcaattaaattgaatctccaccgagaatttatgacacgatcgcaaattacgaaggtttattactattactgtatgggactagaagatccctttccggagcaaaatgaattagttgcgaagctggtcaacgtggtgataatgacctatcgcttgatgctgagccccggagaaaaggcgcaactacgcttgtttttgcacgtccaactgatgcgaattaagaatcaacatttcgttaacttacgcgatgttcttcagttatcacaggatcatcaaacagaaaccgtgaagacgtttttcaagaatcacctggggtatctgcaggggattgattgtgattccgaagtggcctacctactcgcctatttgagtagtcaatgctacaccaacacgatggcgattaagtttgtgaatgccgttgatggttgcttttcggaggcccgccgtaaatttttgatagatttacgtcaggcacaaattttgaaccagccgcaggtgagtgatcaccagatgaaagagatggtggagcggctgattcgactaagcagtagactccttatttttgattttcagtacgattcaatggaatggcaggacagtaaacaaaagattaagagcgattttccggggctacaattgttggccgatacgctaacggaccgcttaagcaagattttctatctgaacccaagtgacgtggagtacgatcgaatttcttacaactacctagtcgaattagtcgtgtcgttaccaccccacgcagttcgggatcgcattcagatctgtgtagattttgttggtggcgccgcgatgcgagactacgtagcagccaacttgcgacactttttcttccgcaatgtggacgtcaccacgacgctgactaagcaaacggatatttacgttacggatttatataatcatacagttaatggcatgttgcaaattgtgttgccgacatcctataactatgaaattttacaaaaactagcaggggaagtttatcgagtgcgagaagataaacttctccgggcgtttaaaaatgatgacttagagacggaaaaattgggataattggatcagatacaaaaacagatgctggttgtaccaacaaaaaaataacgccccacaggcatgaatatcatgtgtggggcgttatttttagttgagatttagttagaacaatccttcaatcgtgccatcgtcgtcaatatgcatcttaacggcggcaggttcctttggtaaaccgggcatggttaaaatatttcctgttaaggcaacgatgaagccggccccgatcttagggacgagttcacgaacgttgatgtcaaaatcacttggggcacccaatagtttaggatcgtcagacaatgaatactgggtcttggcgatacagattggcaggtttccccagccattttcagtaaactgcttgatttgtcgctgggctttcttgctgaggacggctttgcggccgccgtagaccttagtcacaacggcatctagtttgtcttcaatgggttggttgtcatcataaagtggagtgaaggtacttgcttgatcggcctttttgatgacttctttggccagatcgagtgttccttcgcctccctttgcccaactgtcagtgaggatggcagtaacgccatgcgcggcgcaggtatccttgatcagatcaagttctgcttgagtgtcgctgacaaagtggttaatggcaacgactaacggcacaccatactgttgaatattctcgatatggtgaaggaggttcggtaatccagcttttaaggcgtccaggttttcggtttgaaggtcaggaagcttttgaccgccgttgtacttcaacgcccgaacagtagccacaataacagcggcatctggagttttgcctaaaacaggggccttaatatcaaggaacttttcggcacccaagtcagaaccaaatccggattcggtgacggtgtaatcggctaggtttaagccggtcttagtagcggcgacactgttacagccgtgagcaatgttggcaaatggaccgccgtgaataattgcgggagtgtgggccagtgtctgggccaagttcggcttgatggcatcctttaagagaatggtaatggcatcttcaaatccgagttgagcaacggtaacgggttgtttgtcgtggttgtaaccgacaacaatcttaccaatgcggtgcttcaaatcggcaatactggttgataggcagaggatggccattaattcggaagcggcagtgatgtcaaatccggtttcgcgaggaattccttgtgaaaggcctcctagaccagtaatggtgtggcgcaatacccgatcattgatgtcaaggactcgtttccagatgatccgtcgtggatcgaggtctagtttgttatcgcgctggatgtagttgtcgatcaatgcggccaaggtattgttggcgctggtgagggcgtgcaaatcgccggtaaagtggaggttgatgtcttccatcggcatgacttggctgtagccgccgccagtggcaccacccttcatccccatgacgggacccattgaaggttcacgaatggcaatgatggtcttcttttcgagaagcgacagagcgtcacctaagccgacgaggacggtcgatttaccttcaccaggtggcgttgggttgatcgaagtcacaagaacgagcttgtgagcaggatctggtgtggcttgttcgaatttcgtactaattttagctttgtaattaccgtagggttcaatatcatcttcagtcaaaccaattttagctgcgatttctttgatgggcagcatggtggcttgttgagcaatttcaagatctgtcatgttttgaatgcgctcctttatgagttagttgagacgtttgcgacgtcttgggttgttttggcaaaacgtttcctgattaagaatgacacagttagggcaataatttcaagtattccgaaaacaattagtgtcgaattgtagctgtgtaagagttggtgtgacacggagagcacaaccggaccaacaagaccggcaatgccccacgccgtgagcacgtagccgtgaatggcgcctaattccttggtgccaaaaatatcactcaggtaggcggggatgactgagaacccggcaccgtatcccgaaagaataatgcaaaggacaatggtgaagaggtatgacgagtgaatgaacattaagctgacgattaagattgcttcaaacgtgaagaccacgctgaaggtgtttggtcgaccgaggtagtcggaaatcgaagcccaagcgaggcgccctaatccgttgaaaataccgatgacacccaccatccacgcagctttagtgacgctcatcgcggtgaattcttgtgccatgggggaggccgcggcaacgaggccgatgccgcaagtgatgttgatgaatagcattagccataggagacggaattcacgcgttttgacggcctgattggcggtcaattgttgtccgttcatgaggctgacacccgcggcaactggtgtcacggtttccgccacattgagcgccttctttggtggccgaatgaattgagccgcgctaatcatgacgatgaaataaacggcgccgaggatgtaaaaagtgcgttcgaccccgacactcgcaattaatccgtgggcaaccgggcttgtgagcatggcggcaaagccaaagcccatgatcgcgcagccggtagccattccccgacggttagggaaccatttgatgatggttgatacaggggtgacatagccggagcccagacctaagcccccgattaccccgtatgcgaggtagaggagccagagctggtcggtatgaattgcaacccccgtcagtgcggtgccagcaccgtaacagatactggaaattgtgccggtcacgttcggaccgaacttttcaaccaaccgccccatgaaggcggctgacatcccaaggaagaagatggcgagactaaaagcaaacgtgatcgatgattctgaccaaccggtttgggcctgaattgactgggtgtaaacgctccaagcgtaaacggacccgatcatcaggtggagtaaaataccactaccagcgacaacataacgattaaccttcaacaaaacaatcccctttcgttaacaaaaaaacatgaacaatgattacgtaaaatctttcttatatgcaaaaatagtataatatacgacttaataaagtgcaataacgaaaataaattcactaaaacacgaacgattatattttttatataaaaatggaatattttatttgcgttcaaggaacccgtggggcataattgacgtgagaaacgggggatttagatgactgaatttgatcggatttttgaagcgattaaggcggacccacaaaatgcggattacaccagacaagatattgaaccactgtattacgcgggtaaagaggcccgcattaacgtaattgggcaagcaccgggcaaacgggcacaagacacgaagatcttttggaacgatccgagtggcgtgcggttgcgagactggatgggcgtttctgacgatgaattctacaattctggcaagattgccattattccgatggacttttactacccgggaaaagggaagagcggtgacttggctcctcgtaagggctttgcccagaaatggcatcaacccctcttagatttgatgcccaacatcgaactcacgctgttgattgggagctacgcccaacgctattatctgtcactgaagtcaaaagacaccctcacgcaaaccgttaaggactatcagcagtatctaccggaatttatgccgctaccgcacccatcgccacgtaatttttcgtggttagctaagaatccgtggtacgaagaccaggtactgccggaacttaagcagcggaccagggagatccttaacaaatgagtatggagaaaaataaatgttaaaagaattgatatcgcaaaagctctactatgggtttcccatcttcttattggcctatccggatgaccggcatggctataatgtgacgacgtgcagctcgtcgtattcgttacgcaacatgctcgtttttggcttaggaaaagggacgaatgctgccaaacagttgatgagtcatggcgtaggtagtgccaacattgtcgcacccaaataccatgaattggtggaatatgccggtgaccatcatgggcaagataagcttggtggcgggcgggttccttacgatattctcgatgacagtcatgttccgatccttaaacaggccagtgccgttctcgtgtttcacgtggaacattatgaggttgtggggggctacgtgaacttcacggcgacgatcgataaacgcttcgcccaggaaagcctgcttgaggatccgaaccaaattgggcgccaacttgatactttgcactactttggcattgatcacgatctggttaaacgcgcaattgaagctgaataagtaaaaaataggaacgtcttttcccgatagttgagaaaaggcgttcctattttcgtgtgttgtgtattgtgtgttgtgtgaaacaaaagggactagccgcgtggacggcggttaaaaccgccaccaaatccgttgaagttaccaaacggaaattcgaacccaccctgagcaggtccacggccatgaaatttgttgctatgctgctgtgtccaatcgggttccttaacctctaagtcggtgatgagcttgttgagaaggtgccgtaattgctgctgctcatcactggtgagcgattcgaacatcgattccgataattcatctttaaactttttcgatcccgtgatgtagtcacggcccttatcggtaagggtgatgagcgaaacccgtttgtcgtcgggagattcgtgccgttcgatcagttcgttagcttccagtttgctaacaagggcactaacggagctggggcgaatatccaaggcatcaacgatttcggagtttgtgagattatctttttcagcgaggaggtgtaaaacacgaaattgaccgcgctggttttgctgatggtcatcaaatttccagctcttgattgcagcggagataaaagtccgttgctggaatagacggccaaataaggtgagtagttcttgtgagtcgtaggtcataatcaagacttcctttattgttattttagttaggtagttatttcttctgctaactaattgagttcattgtaaattattagttagttcttgtcaacagaaactaactaatataaaataaaacccatcctgaattttgttagcaggataaactagttttaaaacgtgggtggcacttgtataatgagacaagcatcacgcgcgcaagattttaattataaaggagaataatatggcatttctcacattacatgatattcacaagtcatacttcctcggtaaagaggaatttccagttttaatgggaattgacttggactttgaactgggtgaatttgtttccatcctcggtgaatccggtggtggtaagtcgaccttaatgaatattattggcgggttggaccgcaattttgaagggaccgtcacgatcgatggtcaacaactggatcataaaaaagaaaagcaactcgacgaatatcgccgcgggacaatcggctatatttaccagtcgtataacttgatttcacacctgtccgttctcgataacgtgttagtcgcattagacatgacgacgctcaaccggagtcaacggattaagcgggccacggaattgctaaataaggttggtttgagcgatcaaattaagaagcatccgaaccaactttccggtggtcaaaaacagcgggtggcgatcgcccgggcgctggctgccgatccacagatcattatcgcggatgaaccaaccggagcgctggattcacaaaacacaaaagaagtgctggacctattagaagagattgctcaggaaggcaagctcgttatcgccgttacccattctcaggaagtggcgaactatgggacgcggatcgtgcatctggccgacggtaaaatcgacggggatgatcgaattaagccggcgtttgatggggaccacgaaagcgatgaaattccagcgcgaccattggcagcgatggcctcgtatcgaaccgctttcaagcacttaatgtacaatttctggcgtaattcgttgatcattttaggaacggcaatcgggctgttttccgtgatgctattcttggggctcggtaacggaattaagagctacattaataatcaggtcacggaattagctaatcccgactttgtgaccgtgatgaagaacgtgtcgaaggataacaaaaaggacgtcaacgaacgcatgacggcgacccagcaagcaatggcgaccgactataagtcgaccacgttgacgagtgcccagttgaaaaagctgaaggatacaaagcacgtgtcgaaggtccaaccgggctatcaattgagcagcgctcaactgacgcagggtaagaagaccgagtcagtgtccacatttgttacctggacggggcaaaatgggtcgaagtcaattaaagcgggccaccaacctggcaagaatgaaattgtgatcgacaagaaatttgccaagagcttgaacagtaagaactggaagaaggccgttggaaagaccgtgacgattagttttgcggctatgaatgaccagaatcaacctgtgaaaatcacgaagacgttgaaggtggccggtattgtgagcgtcggtgaacaaggatcatccgcttatggtaattacgccacaatgaagaccatgttgagcgacgctggtgcggtgagtgagccaacctttgcggccgtcaagattaatgataccaagcaggttaaggctaccaatgcgaagatcaacgacatgaagacggctggcgtgcatgattttgctagcatgtcggtgggcagcattctcgataccgttaacaccatcacggacttagcaactaacgtactggcggcgattgcggcgatttcactagttgtttcggcgctgatgatcatcgtgtcgatgtacatgtcagtttcagaacggaccaaagaaattggtatcttgcgggccctcggtgaatcgaagaaggacattcggcgactatttacctctgaatccctcttcatcgggctactggctgctgtactagggacggtgatggcgtttgcgattggtgcgggcttgaacagcctcctatactccattgcgaagtacaacctaattcgaatcagcatgggtgacgtgatctttgcctttgttgtggcggtgatcatttcattcctcgcagcgctcatgccggcaagacgggcttcgaagttgaacccgatcgatgcgttagcggcagattagcataatcaaatacagttaaatgatagataaaaggaagctatgatagcttcctttttgatttcctttttcatctgaatggtggttatcgaaatatttctggaaaaaatttaagaattatctatctaaaaattataaaagcattaattactaaaagtaatatagaaaaagttaaattattcacttgacttgaatgaaccaagaacgctgatatcactgaattaagcgctaatcactatgggataaaagattaaggacataatttattatagtgaaaggcataaactattctaaaattttatcactcgattaatatgaacgtaaaaaaatacaaaaaaagatgtttttttagtgataattgtgctttaatattaaaagataaataggacaactgctcacttcgctttttgaagacgacccgcacccaggaccgaatggccgctagggacgggtcgttttattttacgacgaatttcactggttttggccgcaaacgtaagtagtgtctaacacttgataattgtaaaaagtagaggtaaaagacgatgatgatgaattcattttttggtcccgcggggagactgtttgattctgatgcagcacagttagatcgcaatcggggaatcgttgaacgacaattaaagcaactaagaactttatcgttggatgaagttttacaagttttggcaaatgtatatgtcttgggaatgtcgaatggggttaaatacgagcgccagcattttgaagcgcgatgcgatcacgttaagcaacatttgatggagagtctgaatgatgcggatagtgtcgagtttatggtgatggatcaagcgatttgtacaccgctgatggcggccaacggggtggaagatgtttatgacctcgacgacgcgccacagatcgagattgaaaaggaagatctgtttcagatttacgttaacggatggacactcggaagtcagacgttcattttccaaatgaagaaaaatgaactggccgtctttgatgacgcttggctctaccggaccgctaataaaattgcgcggcagcacgcttgcgctttatcctacgatgactaccgcgaggatacggtgcaacaaacttatggagaacaattactggcaacgctcaacgaaagcttgagtcgctactagactaaaaaacggcctgcaaatttcgagttaggaaatttgtgggtcgttttttgagcgttataggcgttaattgcccgggaaataagttagttggttcgaaaatcgacgtgatgtttgagactcgggaaaacatgggtgtccgaccaattcatcatcgcgccctgggccgttaacgctaaaatggtcccgaaccccacagcggtgaggtgcttagtgaaaataacggcgagaatcgtaatgacgactggtagcgagtagctaacccattgccctaagattgcggaaccgtgcatgaatttaaaccgtaaaatgtaggaaaggtcatcattgggatgcaaaatgaggttgcagcgttggtaaatagaaacggctgccgaaattagcatgatcccgaagatgtcgaggacgatgcgccagaataaattgaggttgggaacgccaacccagttccaaaagacggtaataaattgaacaagatagctgaacggaatggtataaagcaggtttgagatgagacgtcgtccgtcaaagtgaccaatgaaaaattggttggcgatggtgacgacaaccccgtacacgaataaggtggttcccagtgagatatgaatccagtctgcgaggttcacagacgaggcggtccaaacggcgctacccaggttagtggaaatggtgagcgcgttcccagtggagttaatgatgatggaaaagattaagaaccaaaagcgctgtttgaagtctttcatatgtgtcacggcagggactctccttctgatatattacttttgatctcatcatagcacgtagctaatcagtttgtttagttaaactttcgtttgacccgattatgatcgatgattaagtttgagtttatcgaaaaagccccgacgatgtttttcaaaggtgaatccctcaccgagggtttcttgggtttcgctaatggtaatgaaggcttgtggatccaagtctttaatgagttgtcgcaccgtattaacttctgagggatccacaacggtgtagaccacatgttgtgggtgcttcgtgtaaccgccctcggcgtgaaatagggaggtgccacgatcgagttggagcataatggcatccgaaatttccgaggcatggttggagaaaataaaaaatgcgcgggcgctgtacgccccttgctgcgtgaaattaatcatttgagcgaaaacaaatgaggcgatcacggtgtacatcatatgaacgaggtccaaataaaccagtgaaatcacgagtacgctgacatcgagaacaaacatggtccgtcccatggggacactggccttacgctccagcacctgagcgatgatatcagtcccgccagtggttccgccaaagcgcatgatgaggccgagaccaacaccgccaaataagcccgccaggagggcagaaataagaaggtcgtggtgcagtgaaagggtcatcggaactttttgccaaatccaaagccacgccgagagactaagcgttccgaaaagggtataaatgagggcgcggcggcccatcattcgaaacccgaagaaaagaagcggaatgttcaataaaatagttgtataagctggattcaggccaaaaagagcccggaggattagtgtaatcccagtcaccccgccttcagccagtgaattaggaatattaatattaactaaggaccacgcatagattgcggctcctaatataaacataagtaaatcggtcacccgaattcgttgattcgtcatttttccgtacatgatgattacgccccctatcacggctattatatcaaattcgatcatgggtgaatattgcagcctgtaacgtttgttaaagttttgtaatggtattaactatttaccaagcgtatactataaataaattataagtaaaataagttaaatgtatgccataaaatcttgagggggagctatatgggacatgtacaacagtacggaatctattacaaccccagtgcggggcacgggctggccgaaaaaaacgtcaaaattgtacaagaacaattaagtgaacatgatattcagccgattttaatgacagcgctctcgacggaagaggcaattatgattgttgccaaccggctttctggattagatgcgttgattgtggttggtggtgatggcacgctaaacgttgccgtaacggcgatgattcgtcggaagctcaccgttccattgggcttgattccatgtggtcgggtgaataattttgcgaaacggtggcgaatcccaacggacgtgcacgaggccctgcaaatcatatttgatcgtcattttcatcgcgtggggattgggaattgtgatgatcaacgggcgattgtgagctacttggattttggcaatttagcggatttagctggggatgtgcgggaacagcaacagcatcatgatcgttggggcaaacgactcacctattttttaaccgcgttgcgacgagcaggacggcataagtcccgcctagtgagttatcagatggatgccaagcagccggagacgtataaaacatggtttgccctgttgtcgacgacggcgccgaatgactcgggagataatccgctacgttttcatctcagtatcttgaaggacattcatcggcgacaggtcattccctacatctattttgcgtggagtggacatatgcaccagtcagacgccattacgagcctaacgccccgaaagttgacgttgcaggcgatggcggatgaaaaagtagtgacccgaattgatggcgacacggggccctatttaccagccgaaatcacgtattgtcccaacgtattgccagtttttatgcaacatttggtgacgccggaaccgtaacttgtggggacaagcacctttaaaatctgttgttttaccggggattcaggcctagtttgatagcggatgataatcataagaattttttatcccaaatgttaacttttactttgcaaattcgtatgaatgtagtataaatattagagaatataaaacgctcacttcatgaacaatgaagacgacccggacatggaaccagtgatggttgctatgtgcgggtcgttttactttaagcaggtcgtgtggtgagtgatggagagtagcgaaaataagcattgcacattggggagtgatcatgatgaatatattttttggaccagcaggccggcagtttgatcggcatgaattaagaattagtcgcaacgaagcgggactggatcgatacttggaggcgctaggaaatagttcagttgatacgatcctcaaccagttggcgcaaatctacgttgccggcatgcatgctggcattcaggcggggtttattggccatcacgtgcggtggatttcgggaaatattaagggcaaggtgattaagctagaatcagcggccacggtttgtgatcaggagttgtcgaccctactggtggccgccctcaacgaagccgatagcgtggagtttttaacgatggacgagctcattgaaacgcaactttgcgaagccaatcacctagttgatagtgacgacttagagttattaccggcgatcacggtggatgaggagcttttctttgctgttttcttaggtggctggcagtttgggtaccagaattatttgtacgagctatggcaacggcagcggccagactacgatgatggccgtcgttatcggaatgcagaaaagatggcccaacaaattgcgacaacgatgcaactcgcggattttgactgtccgaatacgaagcaatatatattggatcaaacaattaagggcattaatgattttaatgagttatattaaatctacgtttcgtttgcaagcaaaattgtaatattacagttcttaaaatcacttgatcgttcgaacaaaggttcgtataattattggctgaaggggtgctgataaatggaatacgaatattttaatcgcgaaggcgaaatgctaaagcatgagacattagcggaggcgctacaagataaagacctgtaccgagttgatgccacaaactcagttggcactcatgagtatttgaataccggtgcggggtggaaggacgcccgggatttgaacggctggagctacgcccaagatatctaaataacgtcatttgaagatgtaaaccttcaaatgacgtttttttagtggcgtttaaaaaaatttttacgataatagacaccgtaacacactgcgataaagggcaccatgtagagcagcgcaacgcgttggttcggatcgaaaatgatcaagacgcacgagagtaaactcatgatgaaggcggcccaggggatgactggataccatggtgttttaaactttaattcgctatcctgatggccggcccgccgaaaggcccggcgaaagttaatttctgagagggcaatcgccatccagacgatcacaacggcgagacctgaaatggaaactaaaacaagatacaccgttgaagcggcgacgacgctggataccagcgcaagaattccgccaatcatgctgacgcatagtgcgagcatcgggaccccgcgactggtcgtgtgtgcgaagcggggcgaaatcattttttcgtgggcgagggaccataacatgcgagttgaggcgtagagaccggagttggcggccgataaaatcgccgtaaggacgacgaagttcatcagatcgcccgcaaatggaagcccgatttgattaaagactaggacaaagggactttgactgacgccggcctgtttataagggatcaacgcggccatgacggtgatgctaccaatgaagaaaataacgagtcgtagcagggtggtgtgaattgctttagggatgtttttctccggatctttggtttcaccggccgttacgccaattagttcagtaccagaaaaagcgaagttaaccgtgagcatggtggtgaacacggctttgaaaccgttagggaaaagaccatgcgcgtacaaattatgaaaccacggtgcgtgggcctgatgaccaaagtggatcagccccacaatcgcaccgagtcccagcaaaataaagatcacaatcgccacgactttaatgctggaaaaccaaaattcggtttcggcaaagaatcgcaccgacaaggcgttggagacgaagatgacgatcatgaagagggcactccaaatccaggtcggcgagtcgggaaaccatttttgcatgatcagaccggcagctgtgaattcggagccgagggcgacggtccatgtaagccagtataaaatggcgacggtgaatcccgtgccggggccgatatagcgatcggcataaacgtgaaaggctcctgtttcaggcatggcaacggatagttcccccaaacacagcatgacgaggtagacgacgaccgcgccaattgcgtaggccatgatggtgccaatggggccggcttgctggatggtgtagccggaacttagaaagagcccggtaccaatgaccccgcccaatgaaatcatgagcaggtgccgggcctccattttacgtacaagtttatcgtgaggctgtttagccatggcaaatcctcctatgtaggtgtattgtatttcgataataagtaaattaaaatatgatgaaaacaccaatagatattatgctagcataattaagagtgatttggcgaataaattttaaccgatttaagattgggcgaagggattgaacgattattaacggattagaacacttgttaaaaacccagcgtgtggtagttagcgatggagcaatggcgacggagttggaaaagatgggggtccaaacggacaatgagctctggtccgcaatggcgctaattacaaatccagatgccattcgggctgttcatgagggctatttcatggctggcgcgacgattgcgacgaccaatacctaccaagcaaacctgccagcattggcggattttgatgtagatcaggaggctggtctgcaattgattcatgatgcagtaaaacttgctgatcaggcgcgtgctggtgatgaccgtctcttgattgcaggcagcgtggggccttacggggcatacttagccgatggcagtgaatatactggcgattatcgcctatcaaaagcggattatcaggccttccacttaccacggattcaagccttagtggccgcgggagtcgattgcttagcattggagacgatgcctaattttgctgaagttcaggcgctactggcgttattacagcgcgactttccaacagttcgggtttgggtttcgttcagtgttggggacacgccggctaatttgtgtgacggcaccccgttgcgggaagcggcccagtactgtgatgcccaagaaaatgtactggccgtcggcgttaactgcacgaagatggaaaatgtactgccggcgattaatgagatgcatggcgtgactgacaaagcaatcatcgtgtatccgaacaatggtgatcggtatgacccaaccaccaagacgtgggaaaaggtgactgatgcgccccagttcagcgagttagtgccccaatggttagccgcaggggcccgaattatcggaggctgttgtcgaacgacaccagatgacatcgcaacgattaaagcaagtgttgatcagtatctagcggggtaaatgtttcacgtggaacaagataagccgaatgatttaccatttattgggttccccactataatgaaaataagcctatttaataggctcctgggcttcaggtaattcccagctgcatttgaagtccagcctcctttacgaaacttcagtaacgcggatcggcgttgctgaagttttttgcgtaaaaaaacaattgcccatgaagcagacaattgttttaaattagatcattcgtggcatcacggggcgactgaagtagtaaccttgtgcgtaccgaattttcagatcacaaatttcctgaaaatcctcatggctgctaacaccgtggagaatcagatccttgcccgcgacatccatcaactcttgcaggtgtgcaatgagggcttggtgttgagcgggtaagcggtgaagatcgagcttaatgccatcgatgtagggaagcaatgccgttagcgtggcgtcgtcgttgatgatgtcatcattatcaatgaagataagaattccagcttgatggtaaagctcactcgttgttgtgacctgttcgaggttggggatgttgactagttcgatgccaaaggcttggctgagatggtgagttcgcacaaatttaatcaggtgatccatctcgtagaggttcgcaaattgttgtgcagttagattaatcgccagcgatttacccggcatgtcgtgagtaaatctggaaatcattgagagctgaacggtcataccagtttcagaaatatcaggtaaaagccagtgcccgtggtcgaacgtgcgcatcagtatttcctgggccatgagccggtcgtgttcaatatccatgacgggctgcgcgaagaaggtactggtcacaacggtcgtggacagttggttagcgtccaaggtttcgccattcaccgtgatgcagtcgcgaccgtgctgcttagaaatgtagagactgtcgtcggcccgactatacagatcgttcattacgatatcgtcaggctggagctcggtgacaccgaaggatgcagtgatcttaatgggtgcttgatcgtaatggtagttggctgtgcgcaaggcgtccaaacaatctttggcaatcggaatagccgctgcgagcgttgtgccgggcaaaatgatcacaaattcttcgccccccgtgcggtaaaaggtaaatggtcgttggctgtgctggagcgtgtgagtgagcgttgtggcacttttggtgagggcgccattgcccgcaagatggctaaaccgatcgttaatgctcttgaaattgtcgaggtctagctcgataaaagtcagtggctggtgggcgtcctgaaatttagcgaagagagctggtgtctcattcagataactagtattgcttttggcccgtgtcagggcatcatagttcacttcgtgggtcagctgctcttgctccagctgttggcgatgggtgaaattactgtaagcccaagaatagaggcccatcatgatgaatagcaaaacgtagctccgccgattggcattagaaatcccggcgtagctcgaccaatacatagtagataggacgattgaaaaaattaaatgggcccaccaaccgtaacgaataaagttgcggaagtaccggagtaggaggccacaaatgatgagaatgccggcaactaacgcgaatcgctcttgcccgtagttatgattgctaaaccagaaaaaagcaccaatcaggccttgggcccaaaattcggtggtggttaggcggttattaagcagggggtaggcgaccacaaacagttgaatgttagaaaataacaaaacattactcggtgcgtggttaatgataaattgcagccacgagcaaaatataatcgccactaggggcactgaccaccgttttaattgattaatgaaggatgattcgtgtttcggattgaaggcccattggacatgccattcgtaaaacgtaataaacccaattgcaaaaaagatggataaaaacaggcgtgacgcaatggcttgcaacgtcataggaggccctcctttcgtcatgccaaaataatggcagaatgatttcattgttataatgcgccatcatctgcaatggttcaagaatatgatgaaaggggattcttgtgagcaaaatgaaaaaagtttcgattattaatcagttcgtcatacaagcgtggaaagctaatgaaacgaaaatttaatttttaggtaatttggggataaaactaaagattagctaatttagcctaaattttactccaatttaagggtgtcgtaataaaccaacgatttactcgtggaaccggtcgtggagcttctgttcgctgtagcgcagtagctcttcagcgtcgatatcgtacttgctacagagaatgaggacttggtcgagcgtgtcggctagttcttcgtggagatggtcacgttgtgctgccggtgactgttcgatttcaccgggatgatcgcggccaatttcaaccgcccgaatggcttgagaaacttcgcccacttcttccgtgagaaagtttagccggatgaatggtgatagctggtaccagttgcgctgcttgtagaaatcggtgagccagtgttgatgttcagataatgtcatgatggtaagtctcccttaatcgtaacttaatttgaataagcatagcacaaacacgccccaaaattaattgcatgcggagacgacgcctattatttggtgggctgctgagactgtggcaacgagaaaatgaggagggtggcgagtaggcagagtccaacgaagaagaggagcacgttgtgactgccagcgagggtctgttgcgccgtagttagctgagtgtggtgggcgcttaacgccaaaatggcggccgcaacagccgtgcccaatgagccggaatattgctgaagcgtgttaaacgcggcgttaccatcggtaatttggggtggtgtaagctgttggaggccgaaggtgagggcgttattaaaggtgaaactaaatcccaacatgtagatcgcgtaaaagacaacgatggtcgccgtcgttagcgagcgactaaagctaaataacagacagctaccgagaaggagaaacccgctcccgattgaaaggatgcgcttggcaccgtacgtatcaagtaagtgtccggtaaacggggcggttacggcagacagtaagctccccgcgaggagcatcatcccagccagcatggtgccttggtgtaacgctaattgtgcgagggtggggagcagaaatgtgagcccaatctggataaattgaactaaaaagtagatcagcagggcccgtgaaaaaagtgaattgcgaaagatctggacgttaatcaggggatgaacgccgcggcttgcatggatgacaaagctagtgagactgatgacaccaatgcagagggggatgaccaccgcgacgacaccgtgatgattgccagcgctattgatcccgatcgtgatggtcgtgagggcgactgtgatgagcatgaactcgaggagcgggaaatggtgcttactaatggcagctgactgctgtacggtcgacagggccagtaggcaactaacgaggccaatcggcagtgtgatccagaaaatcagcggccacgcggcggtctgggtgatgaagccaccatacgtgggccccaatgatggagcaaaggcgatcaccatgccagccagtccgatatattgcccctgaaatcgtagggggacttgctgcataatgatggcaaacatcagtggcattgtgagcccagtactaatcccttgaatgacccgaccaacgagcaggattggcaatgagcgggccagcccggaggtgaggatacctaaaacaaataggagcccagccaatgtcagtaatgaccgaaggctgaagcgacgctgcgcaaaggcggtggtagtcattgtgattgcgacgactaataggtagatcgtggtgacccactgcacgttatttaagctttcgtggaactgcgtcatcagcgttggaaacgtgacgttcattgatgtttcgacgagcaccccacaaaaggcgaggccagccgtgccaatgattgagtacttcgtttttgaactgacctttgatacattttccataaaaaaacctccaattctaatcgaagcaccgcgtactcaaaaaggggtatgctacgctttcactagaattggagtcatcgaaatgagacgcacctgagatatcttctgttggaaatcaaatcgttattgccagcatcatgccgatgcttcggtttaagaatagttttattataccggattgcgaggcgaaatggcagccgttcttttggatcggcgtatcagttgaaaggaactcttactaacattgatagacttcggtttgggatggtcggagtagggggggctagtaaaatcgccgtgcttctataggtaactaaggaatttaacggtttgggtgagagctggtgtggtcacggtaggtgagtggcggacttcgatcactttcaaaactgatatacaagttgcaaaaacaggttaaaatggagaacgcgttttcaaaaaaacacggcatcgatactatttatgaaaataatttaagaaagcactaattacatgcttacataccttgtttacatagagaaaacggttacgaaaaatcataatagcatgtgttcgttttcataatcttgtgaaataaataatgaatgcgattaactttaactttttatccgtaagaaacgttgataataaaggaataatcaataaaataagaactgcacaaaataaaaaagttttaaaaactagtatacaagtacaaagtgaggtgctatagtaggtaaccgttgagagcgaatgattatcaaacacaagccatgcgggcgattgcttcaatcctagggcaagcaattgaaacatcagcgacacacaaatagttattcgcgaaagccattattgataaattaaaaattgtgattggatatagaggagaattaaaatgaagagtttaaagaagatcgtattaaatgcatttgttgttactgttgctttcgcaggttttgtaggtttgactggtaccgcccatgcagcttcatttagtgatgccgcagcttcaattcagactgaaactgctaagggtgttacggctcaagctagccagtcacacgttactttgaaccaaattgctaagaacgtggctaacgcccaaatcgccaacgctcgcgttgcaactgctcaagttaagggcggtcacagcagtgctttgaacaactttgcgaagacttatgcttcattcgttactgctaacgcccgtgttgcaacggcccaagcatcaactaagagcgctacaaactggagcaactttgctaacaactatgccgatgcaatcagtgcatcagctcgtgccgcagaagctaacgcttaatccggcataattagactgctccattgagtagtcggcgagatataccagatttttccggcaccaatgatgctaaaaccttgtagtactaccgagtgcgacagatctacccccaccctaaatgaattgaatatcagcaattaatattaaataacaaccaacgatttaatatgagttgaaaatatgtgcgaccgtctttccctaagagacggtcgtttttgtgtatccagatacagattggattgttttttttgttgacaacacgttgtttagtgctctgctgaggcatacactaagtacgaaaatctgtatgaataatctgtattcatatctgtgggaggatatttgatgaaaaaatatttaacaatggggatgacgctcctaattgctgggacacttgcggcgtgtggtagtacgagctcaaagtcaagtacgtcaaaacaaagttctagtactacgacttccaaaaaggtgagccaaagttcaagttcggtatcgattaatagtagcagttcttccgtttcttctagtagcgaaacacagtcggacaaattaagtgcccagatatcgacaaatgaatggtacatattagcgtacacaaacgtctggggtggtagctcaattggtacggtggacgataatccaaatttggaattatatatgggaacagatgatgagatggattcaactaacggtgaattaacgattacccaaggtacggttgattcgacggcatttgcagatagtgtcacttctacgacagtgacgattgcgccttcttcgggtgaaggtgcaactagtacgtttacgccacaaactgtctctaaggcagaactaatgaataagtatgtgcataatcaagcagactttgatcgactagcagcacttacacaaaatgcggttaacattgggcaggcagatagcgttgatcagcagagttcagcgtcagatgagagctcgaattaaggtattgggtgataatagcgacagtccgcgttgatgcttttaaaattgaaaaggtgatattaaaggcgatcactcatcacagagtggtcgcctttagtggatggagaaattatttctgtaactctttttcaagtgcagatgtcagaagcgctgaaaaattaatcccacgtttttcagccgcttgtgctaagtcggcggggatgctggtgtttttcttaacctttacgacgacaacttctgcttttgcctgatccagatcagcagctaccatattaacaagctgattaggatgttcgcggaccagctttttaatatcagttggttcaggaagcgtcttggcatcacataattccaagccaaggacttcggcggcgttaacgagggcttcggcgatgttatttccatctgtaatggtactaggtacgtcagggaaggtaacggtatattctcctggacgattgagcgaatcgtcgaagatggcagggtatgcgactaatttcattgatttttctccttatgatttttgccgttattatacgtaccggtacgtacgaatgcaatcaaagtgattttgatatattcatatatactcaacgagataaaaataagaatttccaacttgatttggacgtttcttggaatttaaggcacgacaaatttttaaattgacgtgtaaacgaattaagagatggattcaaagcttatagttcggaagttcatgttgaatactgtgtagaaattgataatgttcggatcggcgccaattaaaaaatttgtcgtatgttgtttttgggaaaatgcgatatttgtgattgagtggcgaattttagacggcaagattgccattaatcagtgcaaatctgaattattcatacaatgtctgacggtgttagagaaaatgttatttgaagcaagcaaaaaggtgttcagtataccattatatctaaaaacacgctcagatctgactgaaagccagttggagtcggtagttaaacgatggattattatgtcggcaattacttctcgatacagtggtttcagtgagacaagaagcgaagcagatattaagttattcatgagtagtgataacgcaattgctgtagctgatcaggaaactgcgcgacaattgtcaaatgatttttggaatgtacttttacctcagaagttcgtttcgtcgtcaacggctgcgaatgtgtggcgtgtgtttttgatgacacaagttcatgatggtgattcagcgtggcttgagaaagaccaccggattgaaagcctaatttctgagcagggaaacattcatcatatttttccacgtgcatatttgaaacaacatggattttcacaaactcagtttaaccagatagctaattatacttggcttacacaaccgcgcaatttgcagatcagcaatcagacacctaaggattatttgaataatccagaagtgactgaatttgcatccgagcaatcgtttgaagttaatgcaattcccaaggagctcgttaactatgattacagtaactacaatgattttttgagtcaacgccgcgtgctgatggctagcaaggttaaacggtattatcaacagctttaaaattagtaaatagatgaatcccccacaccttgtaaaacgcatagtgtgggggattcgtttgtctgattttgatataatgatggtgcaggaagttttatggacggcggcctttttccttcgggggtggtgcgatgcattgcaaaaccaaagaaaggcttttctggaccaatgagtacctatcaggtactaacgttattgatcgcattcggattgttaattattgcaatcctagatcacaacgaaaaacggtagaaaaaaaccgtcctgaaatagctttggcaagcacagggcggtaacgtcatgtcgcaaaccaccgtctttaaagcggtctgctgaggagcctcgtgcaagagactcctctttttctatgcccatattatagcatggttcgtttaaaagttcatcaagttagagcctgtgttatgtaccgctatcagggttccgtacataagaaagcattagtaccgtgtcgtgcgtctcaatctccccaccatcagtgtcccattctttcaaactaacttactaaaacaaaggaataaacgatcaaaaaagcccgttttagtgaatttgatcctgctataatgcccgtacaattgatagataagttaggtggtattagttatagggagggatagcgtcatgaaattaaatggtagagatgtcacgcaacggcgccttttattgatcgggacgacaacgattgcgtcgctaggggtcggaatgatgacggctggacaggcacaggcagatacaccaactcgctcggcgtcctcaaccgcagcagcggcggttgtcacggatccacagacgcaacagctaagcgacgcccaaacaaaagcaagccaggccgcatcaactgccgcaacggccaagatcgtcgctgatcaagctgtacgggctgatcaagtggcccagtcggcggtagcatcagcccaaagtcatgtggccgctttatccgagcaagcgactgtggcgcaagcaacgagtagtgcggtcagcactgtctccgcagcaacggatcaggcgactagtgcgctaggacaagtatcgcagagcctcgcctcgggtcaaatgaccgtggccgctagcagcgcaccagacgataacggcttaccggtcgccgatgatgagagttcgacggcggataacgtacaggattacgagcagacagcatcactcctgtatctactctatgggcaccgaattccagatcatgatagctctgataatgatggtttaagtgatcagacggtgcaggcggccatccaagaagcaacgacgactgcggaacaaaacgttatccccgccgattggaacgtggtgattagcggcgctgcatacgcgcaagatggcattgtgtattacgagaccgaccaaacacagtatggggatgcggtcgatcaggctgcagcatggtggaatcaaaatgcggggcaaaccgtgttccagcgtgcggacgcatctcatccagcaacggcccatattacggattactatgacgcccatttttcgatgttagcaacgacgggggccgatggtattgtggggttggatgtcagtgtgatggaggcctttaattatgagccattaaatgtgatcacgcatgagatggggcatttgctgggccttgcgcacgcaccggcggttggcgatattatgaatgccaccgttcctcggcaaacctatacgttttctgattacgaccgtgccgcattgaaaaccgcgatctgcgcctatggtaagttacgtgatagtgcaggtggggatctgaccaagtatcaggcactcagcggctatatgccattaagcacggatgatttagcgctactgggtgatcccaactacgaccagtggcattcgctccggtcacagttgcggacggtggcgactcaagcagcacagctggagcagcaatcaaccgcgctcaaaaatgctgagcaacaagcgacggatgcggccaatgcgtttaccaccggtcatgtcacattagcaatggttaaaaccggtgttgaagcacttctcgcgctctatcaggtaatgggcagtcagagcacggatatgttttccgcgttgaacgtgaacttgagtgccgcgacgcttgcaaaagaagccgccctacgtgagcagttgctacaacccgctgatacgactcagggatcaacggagaccggccagcaggcaaccacgacaacggcggccactgatttgacgcagcaacttaagacggcccaaacaatgctgacgacgttccaaaagattgcagtggcggcgcaattgggtagtgaagttgcgcaacgccattatcagacggctcaaaccaatgccagcgtggcactgacacgttatcaagccctattggcagtggttaaccaagggctgcataacggtcaaccacaggcgacagcaacgaatacaccagccagcacaacgaaccagtccacgcatgtagtggttgatgcaggtaaagtgctgcagacgaaagccactgttaacccagcaccgagtcgcttagatcaagcctcacgggcagcaactcaaagaaaaacgacgcgtgatgtcgcaatcgcggcgccaaagtcagcgggcaaccactcagatcaagttaagctaccacagacgagtgaacgtgagacatcccacattctggcacttgttgggaccctcttgatgggactgatggggctcctaggaattcggcaacgccaacggcgcaaataacgtgatcagtgggcactttaaacaattagttatacaacgtgcaaaataatgccatataatagaagaaaaaaagtggcgatcgaataagtaaccaatagtaatagttgtaaccacgccctgagaccatctttccgagtgttgtataaatgataaaaaatgagttgattttggcaataattgatatattggtctttcacgccattttttcttaaaaatccggaaaatgttccacgtgaaacaagaaaatcgggttaaaatgagagataaatgtgaaaaaattgcgaaaaaagcctaaactttgcgatttgtttttgaaaaagtaataaagttttgtcataaaagtataacgaaaagaagactattaagatttgcgagttgctcttgaaattttggcgcacaaagcctaatctagtagtaacgagctgtcctttttataaatgtcagtttgcatcaacgaccggctggtaacgcttttttgaaatgcgttactggcttttttgttacaaaaaaaacaaaaaacgggggaaaagaaaactcaccgttacatttctgtaatattaatcctgtaatctgattaccgttgatgcaacacataaccaaaaacaaatgactaagacaatttaaaaaggatggttttttactttatgaatttcaaatcaaaagcaattaagtttctcgttgccactttaggcgctgcgacaatgggtattcttggtgtcactgcgacagccaatgccgattcaatttacacagttcaatctggtgatacactttcatcaatctcatataaatttgcgaacaacacaagcatggttaacacgcttgctactaaaaacaacatttcagatatcaactttatcctagttggtcaaaaactttacattagtgatagcggccaaattacacaagcaacgaagcaagaagttgcaacgacgccagctgctactcaaagcacaacgacgactgctagccaatcaagcaccactcaaaaggctgcaacaacgacaactgcttcaacaactagtgcaagcacaagtactactacatctggttcagatgcttcagctaaagcttggattgccgctcgcgaatcaggtggttcatacactgcccgtaatggtcaatacgttggtaagtaccaattaagctcaagctaccttaatggtgactactcagctgctaaccaagaacgtgttgctaacaactacgtttcaagccgttatggttcatggtcagctgccaaggctcactggcaaagccaaggctggtactaaaattcagctttcaataatagaatgattaaaagtgaggacagatcaaacgatctgtcctctttttattttttgttcaatttcaaatgagatgacaaaacgatgtcaatgaacttgatataacagcctaattcatcaattatcggtaaataagcgccattaattgcccagatcgaacgataaaggatgctatcttgcaactaaaaacgggacttttgttacaaatgaataacttagagttgataatttatgaattttttgtgccaaggatgcttaccacgattgaaacggcggtataccggccttccaaagcagaaatcatgatgaaatgatggacaaatgggactaattttagctctttttaggcccattttgatcattttttattacaaaaaacacaaaaaccggcttaaaagaaaactcgctgttaagtgtctgtaacataaacctagtaatctagtaactgttgaagcgggcgagtaatcgcgccgcaagtaatcacagacaaaataaaaaggatggttcttttactttatgaaattaaaatcaaaagcgattaagttcattacagctacgttaggtgccactactcttggcgttctcggtgtaactgctacagcaaacgcagatgaaatttacaccgtccaatctggtgataccctatcatcaatctcatacaaatatgccaatgacacaagcatgatccaaaacattgccaacaaaaacaatatttcgaacatcgacttcattttagttggtcaaaaactttacattagtgacagtggtcaaatcaagcaagcaacgaagcaagaaattgcaacaacgcctgctgctagtcaaagcacgacaacgagcgcagctgctagccaagcaacttcaagctctgctacggtagcttcttcagctacagtggcgtcatcagctgctgtaacgtcaactgcttcaagtgcaagtgcctcatctgcatcaacacaggcatcttcagctacggttgcttcgtcagcaagcacaacgtcacagagcgcatcaagtgctgttagtcagccagctgctcaatcaacgacaactcgcacaaccacatcgacggcatcgtcatcaacatcgacgacaacgacttcaacaagtggttcagaagctgctgccaaagcctggattgttgctcgtgaatcaggtggttcatacactgcaagtaatggtcaatactacggtgcataccagttaagcaagagcatgttgaatggtgactactcagccgctcaccaagacagcgttgctaatagttacgtcgcaagtcgttacggctcatggactgctgccaaggcattctggcaaagtaacggttggtactaaaatttaacctaaactaggcatcactacgcaagaagtccctcgttatgaggggcttctttttgcgtggtgaaggaaaatgttttgtgtttgaattggcaaagtaataaaatagaatggttatggttttcgtaagtaaaattagataaggatggttaatcaatatgccaaaaaataatcaagggcagccacggcactccaagcgttggctgatcatgactgcggtatttatcgcgacgtttatgacgtctgtcgaggtgacgattgtcacgaccgcgctgccgtcgattatcagtgaacttcatggactcgcgtatcaaagctggattatgagtgcctacctgttgacgacggcaattacaacgcccatttatgggaagttagccgatacgatcggccgaaaaaaagtgtttttgtggggtgtgatcatgtttacccttggatcgctgtttagtggactcgccactaatatttacatgctaatcgcgatgcgggcgctacaagggattggttcgggggccgtactgccactgacatttacaatcattgcggataattacagttttgaagaacgtgcccgggtattggcctttaacaacacagcgtggggtctgtcggcactgatcggtccagcgctgggcgggtttttagtagacgccctttcgtggcactgggttttcttcgttaacgttccactgggcgtgatcgtggccgtactcatttggggaagctaccacgaaaaattacgggccacggagcgtttggtgatcgattggcagggaattagctacctcgcaatcacgatggtgggcattttattagccgttcaaagcttagattccaacctagttgttacgggcgcgctcgccgttgtggcggttatcagtttaatcctgttagtgcggaccgaaaaacgagtcgccaacccgttgatttctcctaaactctttagaaatccatcgttcagtattcaaattagtaccactgccatgttgagcggaattttgatggcttaccagatttattttcccatctggttgcagtcgatttaccgcatgcccgccaccatggccggactagtggtcagctcaagttccatcatgtggctaattgcagcgttctttgtgggcgcggttatttcacgctttgtaccaaagtatgtcgccatgggagtcgccattttattggtcattttttacacgattttggtctttgccggccgtgattttccgtcatggatgttctatctgattgccgcagtgaacggtggaacgatcggcatcatcatcagtatgaatacgattttgagccagcactttgtcgatgaatcgatgattgggtcggcgacatcattgctgacgttgggccaatcgctgggtcaaacgatcatgaccggggtgtttggtgcggtcttgaacctcatgatcgccactcatcgcggtaatctaccactggctgaaattaaccggtcgattagttcgaatcaagctggggcaaccgcgaataaagcggccgtagatacggtaatcttacacggcatgcacggagtatttgccgtcgtgatcggattattggttgcggtatttattgtgaatctcgtagatcctaataaaaaagtagtcagataaaagtaaaaatccgatgtggtcccataaaagggaaaacatcggattttttaatggcatcaaaaaagctcccacctgtagtcgttggtgagagcggcgctgacagtacagcgcatggcgcgattactcgcgcagcagacgtttaaggtctgcaggtttggcaccttgcctagtagtataccatattgggactaaattgtaagggcccgtgactgaatttggcggggattaatgggcctgccgagttactggattctcattttaaatggcaaaaattaaaaagattccaataatttgttgacaaagtgatgatcatcgcttaatatatgggacaatgattatgagagaacagttagaagatgagtagaaagtttcaactgccatagagaatcgctagacggtggaaggcgtgcaggagagcttttgaagatggtcttcagaaatggggcgtccgaatcgggtgattaggacgtcatgggaccgcccattacagcggaagggtatcgatattgggtacccagtgaggagggccgtgtcagcggacctcgaattaaggtggtaacacgagcaatcgtccttactttcgcattagcggaagtggggacgttttttgttggtctcagtaaaatcacagtaaagaagggagttttgagcatgcaagatcgtaaaatttattacttacacatgaataagaccgtgacggcatgcttcctgtttggcgatggcattggtgatcaagtcatgtcgcgttagtttgttgtaggcatttaagacaagaatcagcgcttcaccacatacatagggacggcgtttgatgacaaactaaggagataattaaatatgacaacaactgttatcggctacccacgcattgggagtcaccgtgaactcaaatttgcagtccaaaaatacttcaagcaggccatcagtgccgacgaacttgcacaaacggcgtcgcaactgcgtcatgaaaactggcaaaccctcagtgatgcggggatcgaccaaattccttccggtgatttctcgtactacgatcttaccctcgacaccgcaactttgctaaacattgtgccggcccgctataaagcattacacctcgcaccgttagacgaatattttgcccaggcgcggggctaccaaggtgaacacggcgacgtgaaagccttaagtatgaaaaaatggttcaacaccaactaccattacttagtaacggaatttgatgacgatgctgatattaagcttgtgggtaccaagattttcgacgaatatcaagaagctcgggatgctggttaccaaacgcgccccacgattatcggcccgtacacattaattaaaaatggacgctttacaggccacaagacggcgagtgactttgtgccagcgttggttgccgcttacgaagcggtatttgctcagctcgctaagcaaggtgctgactggattcagatcgacgaaccggctctagttaaggatcagacgaccgccgacttggctctctttagcagcctttacaaaccattgttagccgctaaacatggtttgaaggtgcttggtcagacatactttggcgatgtgcgagatagctatgacttactgacgagcctcgatttcgatgctttaggtctcgattttcttgaaggagctgaaacactgacgttagtccaagatcatgggttccccgccgataaaattttatacgccggcgtgattaacgggaaaaatatctggaaagctcattatcaagataagattgatttgttaaaccaaattaaggacgcggccgcgcaagtcgttattagtacctcgtgttcgttactccacgttccatacacgattgaaaacgaaccccagctagatgataagtacaaacgctacctcgcatttgctaaggaaaaattgacagaattggttgaactagatcgaattgaagcgggtgacacagcgttgctcgaacaaaacgaacagctcttcacccaaccacgctacgtggaaaacgaagccatcacgaagctggtagcgtcattgaaagaagccgactttcaccgcgagccatcgtttgaggaacgggcgcaggtacaaaaggcggagttcaacttacctaaattaccaacgacgaccattggttcgtttccccaaacaaaggaagttaaacgaaaccgggccaagttcaaaaagggtgagatcaccaaggaagcgtacgaccaattcaaccgcgaccagattaaggcctgtgtcgaattccaagaagaaattggggttgacgtcctcgtgcacggggagtttgaacgaaatgacatggtggaatacttcggtgaaaaactcgatggattcctgtttaccagtaatgcctgggttcaatcatatgggacgcggtgcgttaagccgccaattatctggggcgacgtcagccggaaccagcccatcaccgtagcagaatcagtctatgcacagagtctgacggataagccggtgaaggggatgctgacggggccggtaacgatcttgaactggtccttcccacgtgaagacctttcgttgaaagaatcaacgtatcaaattgcgctggctattcaagcagaagtgctggatcttgaacgcaacggcattaagattattcaaattgacgaagctgcattacgggaaaacttaccattacggcagtcagactggtattcgaagtacctagattgggcgattcccgcattccggcttgtccacagcagggtggccgcatcaactcagattcatacgcatatgtgctacagtgagtttgacgacatcatcgatgccattgatgacatggatgcggacgtgatttcatttgaagcatcgcgtgctgatttgacgttactcgatacgcttcaaaaggatcatttcaagacgcacgttggtcctggtgtttatgatattcattcaccacgggtaccatcacaggatgaaatcgaaggaacgattcgtaaaatcgtggctaagattccgcttgataatatctggattaaccccgactgtggtttgaagacacggggaaataaagaaaccacaccgagtctaattcacttagtggcagccaccaaaaaagtacgacaagagctggcctatgaaaactagcgcgtgttttaaacaacgccccgtgttatcgtttgaaatttttccaccccgtgagcatgcgtcagcaaagacactggatcggttttatgagacgctcgatattctcgccgatttaaaaccggcctacatcagtgtcacctatggtgctggcggggccggtagtcaaacgggaacgctccatttagtgaaatacattcgggagcactacggtatcgagacggtaccacatattccggcaatgcagttcacgaaggcgagcgtgcaagactacctggcagagctagcggcggccaatattcaaaatgtattggcgttgcgtggcgatttaccagcagatggcacccagccccgtgacttccagtacgccagcgatttggtgcactatatcaagcaggtcggtgatttcaatgttctaggtgcatgctacccagacgttcatccggaagccgctgatgcggttcgggatattcaaaatttgaagaccaaggtcgatgcgggtgtgtcccagctggtgactcaactcttctttgaaaatgatcatttttaccactttattgaacggtgtcagctcgccagcattgacgtccctattcaagccggaattatggcggccacgagcgagaaacaaatcgaacggatggccacgatgtgtggggtgacgctgccaccaaaatttgctaagatgatggatcgctataagggcaataagattgcgacccgtgatgcggggattgcctacgcggttgaccaaattgtcgacctactggcacatgacgtagatggcattcatctttacacgatggataatccagtagtggcgcaacgcatttgcgatgcggtaaagacgctcatttaaattatgatgattcgaaaaaaagacaattctcagcgacgagaattgtcttttttattactgaacaactgtccaatcatggattgttttgccatctggatcctgaagctgaagccagctgttagtaccgccgaagtaaagaaaaagtccgacttcgttgacgctcctcaacgtgatctcctcggtagtgatgaactggtcatcaaaggcggcgcgatgttcttcccggagttggttagcaaagcgggctgaaaaaccaatggtgccgtcggcatttaacggtgccgttggttgcatgtgcgcccctgcgagaatcaccagttcgttacgcttgcgccagtagacggttgcctgagtaccgttaaaatgagtggtaaacggaatcgtagcaattgctttggaccatcgatgccgtgctttagcagggcgctttttgggtgctacgaagctgactcccagtaatgttagagtgggttggatctgatgccagtagtcaagaacgactgcgcgttgattggctggcagtttagtcgttaccggttgggtaagtttgacctgactatctagtgccagttcggtcagcaggcgtgtgagataaggggcgtcaatggtactagccggaaagattgtgagtgtccgtgtgattttagtttctgcagggcggacgccgatactgattaagtgctgattctcaaagtatagctgagttgcctcagcaattaatgcggcagtaccaggctgcaggcgtatcgtgcccagttcattgtttaaggataggctgatcgtctggtcactaacttgcccgttaattgattgatcggtcatgttgaggtgctccatttcacttgaaagatgatatttcccgggaaataatgtttttaaatacctttactaacaaatagttttttgtgattaatgggtattatgttcagttactagtttggtaggcaggagtccccaaataaatagggcgacaatgacactgttgccagtggcatagccaacggcataaaatgaaagatgcattgtcagtaatacccagataccaacgagtagggcagctatggcggtaattagcaggctttgatgtggcgttaggctgaacctgtgctgattgacgtgccagttgcgctggcgggcatcttttagagtgaccaaattgacgatcagtaaaacaatcagcagggtggtgccagacaaacctgaaccgtgaccaaatttttgtgccatccaagctacgatcagaattccgtctaaaaataagtttattctgtatagcctgcgtgcctgacgttgtgctttttcttgtgcatgtaattgattcattatatcttcactcctcaatagttgatcgagggatacatgatataccgtgctcagatgcatcaagctgtcaatatctggcaaacttctactagtttcccagttggagattgtttgacgtgtgacatggattgccgtggccacatcttgttgcgttagctggtgagcccttcttgcttgttgtaattgtgcaccgatattcatgatagcctcccattgagcttatatgttcagtgcttattatccaagcaaaggtcttgcaacgccagtagaattagggacaagttgcttggcattgagatattttatctaaaatattgccactatttggcgatttgggtctccgtcggtgtttcacgaatcaatttaacgcccagaacggtcaaatgactgttttcaatgagttgaatcataaaatgagcaaggtgggcgggacggaattcttcgtccgaacggagccaccaatttaaggttcccgttagtgtagaagttatataggaatagataaattcatttggcacatctttaccattttgtgtaattcgcagattggttaagaattcatccgtcgtttcgcgaattaaattttgcaattcttccatcattttaacgtgttgtgagccatcaaagatcaaaaagaagaggtctttttgttcggacagactctggaagacttcggtcagggtgctttcaagggtatcaaggtgaatttcgttcttgccgacaaagatatccgcccggctaaaggttttgaatgattccatgacggtctggaagatctgctcgtacaggtcctgtttatccttgaagtgggcgtagaatgttgcgcgattgatcatggcctcgtcagcgatctgctggacagttaaccgctcaatcccgtattctttaactaacttaataaatgcgttgaaaatcattttgcgagttctgataactcttaagtcgtgtgctcttggcatagtgacaacctctttttaaattaattaatgcgtttccattgttatcataccagctaattagcgagttttccaacattattcgcaaaagtatcgtttatttaacaaaatgtataaaattgctgattgcagtattttagaacgcgggttagaatgattctaagatagcatacagaatgtcggttatttaacgttatgtcggataatcaatagtttagaacatattagagactgggaatataggcaagcgaaaagtggggagagattacatggagacacaacagctgtacggtgggattgatgttgggtcaacaaccgtcaaattagtgattatggatgaagcacatcagacgttattttcacgttacgagcgtcatttttcagatgttaaggcggctagcaagcgcattattgaagatgccgaaaaagaaattggcaccgatcaacccattgcgtttacgattaccggttccgggggaatcggtctcgctaatttattgaaattgaagtttgtgcaagaagtgattgcctgcacgaaaacggtcgaaacgctaatcccagaaaccaatgtcagcattgaactgggcggagaggatgcgaagatcaccttcttcggtgcatctctggaacaacgaatgaacggaagctgtgccggcgggaccggtgcctttatcgaccaaatggcgaccctgttgaagaccgatgccagcggattaaatgaactggcaaaggactacgataccctctatccgattgcgtcacggtgtggggtgtttgcgaaaacggacgtccaacccctgatcaatgatggcgcccgcaaggaagatattgcagctagtatttttcaggccgtcgtcaatcaaacgattgcgggccttgctgctggtcataaaattaaaggcaatgtcgccttccttgggggcccgttgtacttcatggatcaactgcgactccggttcattgaaacgctgaatttgagcgatgagcaggttatctttccgcccgatccacaactattcgtggcgaaaggggccgcgctgtacgctgaagatcaacccgtaacctcccttggtgatttgctgcatcttctggttcacggcgatgactctgtgatgcaaccatcacattctctcgacccactgtttaatgatgatgaagaactcgcccaattccggcaacggcacgatcaagcgcgggttgagcaacgcgacttgcaaagctaccgcggggtggcctttctgggcattgacgcggggtcaacgacgacgaagatcgcattaatgagtgacgacaataagctgctgtatacctactacgataataatgatggtgatccactcgccaagacgaaaatgatgcttaaagacctgtatcaacaacttcctgagggcgtcacgatcggtaaagcgaccgtcaccggctatggggaacatctgattaaaaacgcgttgaaagtggacgtgggagaagtggaaacgatggcccattacaaagccgcgcactacttccaacccaacgtcgattttattctcgatatcggtggtcaggatatgaaggccatgacgattaaaaatgatgccctatcaacgatcaagcttaacgaagcgtgttcatcggggtgtgggtcattccttgagacctttgccagttctttgaaatacgatatccgtgattttgctcaggcggcgttacttgccaaacacccgtctgatctgggttctcggtgtacggtattcatgaactccaaggtcaaacaagtccaaaaagaaggcgccacgatcggagatattgcggccggtctatcgatgtcgatcatcaaaaatgccctgtataaggttattaagatcaaacggccagaagacctgggcgaaaatatcgtgtgccaaggaggaaccttctataacgaggccgttttgcgagcctttgaaaagatttcgggacgggaagtcattcgaccgaatattgcgggcctaatgggcgcgtacggggccgccttgattgccgaagaacattatgaagaaggcgaccagacaacgttgctgcaacccgccgagatggatagtttgacggcgaccaaggaatatatgcactgtggtggttgtgaaaacaactgtgccttgacgattaccatcttcagtgatggccggcggtttgtcacgggtaaccggtgtgaacggggtgaagaacggggcttaaaactccggacccaccacgaaaacggcaaggttaacttggtcgaagaaaagtataagttattatttagttaccggccattgcgcaagaagctcgcaacgcgtggcacgattggtatgccacgggtcctcaatatgtatgaaaactatccgctctggcaaacgtttttctcgcagctcggtattcgggctgaactatcccataaggggagcaaggaacagtatgaaaagggaatggagaccattccaagtgatacggtatgttttcctgctaagcaagttcacggacacatccaaaacctgattgaaaaggggtataagaccattttctacccagcggtggtgtacgaagtggctgaaaatgcagacgcccaaaatcactttaactgtcccatcgtgcaatcctatcccgacgtaatcaagaataacgtggatgagatccgcagtggacaagtggatttccgtgatccatacctcaacctcgcggaccatgaatccacggccaagaacttgtacgactgctttaaagacatgggcgtttctgaaaaagaagtgaccgacgcccttgaagcaggttacaaggaattggaacactttaagcaacagattcgaaaccgcggcgaagacaccttgatgatgcttcgtgaaaagggtgagaaggggattgtgctcgctggccgcccttatcacttggacccacaaattaatcacgggatttcgcagatcatgacgacggaaggcttccacgttctaacggaagattcgatcgcgcacatgggggacgtgaagggcctccgagtcgttaaccagtgggtttaccactcacggctgtacgctgcggcccggattgcggccaagaatcccaaccttgagtttgtgcaactgaattcatttggttgtggcctggacgccattgataccgaccaagtagaagaaattatggcgcagtacaaccgtatttatacctgtctcaagattgacgaagggaccaatatgggggccatccgaattcggctccggtccctgaaagcggccgttgaagaacggaagcaccggaagattctgcccgttaagcagtttgacaatgacgaaccggtcaactttaccaaggatatgaaaaaggaagggtacacgttgctgatgccgatgatgtcaccaattcatcagcacgggttggtggatgtcgcattacgcgcatccggctacaacgttgtgaacctgccaatggatgaccggaaggcggttgacgtcgggcaaaaattcgtgaacaacgatgcgtgttatccagccatcatctcaattgggcaaatgctagaggccctgcaaagcggcaagtacgatctgaagaagacggccgtgatgatgacacaaactggtgggggctgtcgggcaacgaactatattccgttgatccggaaggccttgaaggatgccggtttcccacaggttcccgtagtttcaatgtcgatgggaaatcaaggggtcgagcagacaccaggattcaagttgacgttaccactcattaaacgggttgcgattgcctttttgtatggggacatcttcgaacgcgttgtttatcggacccggccatacgaaatggaaccgggaacgatcgataagatgcacgaagattggttgcaactggtgaaaccgagcgttgaaaaggggagtttctccgagttcaagaagaacgtggccgaaattgtcgaagactttgatacagtgccactccggcaggtttcaaaaccaaaagttggtttggtgggtgaaattttagtgaagtattcaccaattgccaacaacaacattgttcgattgctggaacgtgaaggggccgaggccgtggtaccagacattgtcggcttcatgaactattccttgtacaaccagatttacaagtatcaggaattcggtgcttccaagaaggcgaagatttttgccgaaatggcgattaagctgatcaaatggtgcgaacaaccaatgcaaaaggcgttgaccgcctcgaaacggtttgatggcattacggcgatcgaagaactggccgatgacgccagcaagattttgtcactaggaaaccaaaccggtgaaggctggttcctgacgggtgaaatgattgaactgctgaacagtggtgtccccaacattatctgtatgcaaccatttggctgtttgccaaaccacattgttggtaaggggatggtcaaggaattgcggcggcagtacccaggtgccaatattgccccaattgattacgatcccggaacgtcgattgtgaaccagttgaaccggattcggttgatgttagccactgccaataagaaattacgtcaagaaaatgatcatggtcgccagattccacgggaatcggttgggcggcgtgaatcacaggaactgctcagtgccgtttctaaattagaacgttaaaaaaagagcgtagccttgaaggtggctacgttctttttaattggagccggatgcatcgaggtgactgtgttgtgccccgctgatcagttgttccaataagtcttgatagttattgctaaataggcagttattgaccacggccggattcatgaattgctccgtactgcaagtttccagcagtgttttcagtgagttgtagtagccgtgcatgtttaaaattcccattggtttggtattgatgatcccaatatccatccaggaaagggcttgggtgacttcttcgagcgtcccaatcccgccaggaaacaccaaaaaggcgtctgcttctgacatcagtagttccttgcgttcgtcgatcgttttagtagtgatcaactttgtggcgttgtggcggggtaattcagatttgaacaggttctccgggtagatcccgagaacttcgccgttattttctagtacggcttggctgatggtgcccatgatgccagattgtgacccgccatagacgagttcaatatggtcctgagccagttgggtaccaagttgtttagcgacgagttggtattggttggcgcggccaaagcgggccccgcaaaaaacagttaatttcacgaaatcactccatcttctctaaatgcacgctatctagtttacacggaaacggacaaaaagcaaagaagagccgtccgatcccttatttttcgcggtctggtttggtatactgacactaggaaatatacggaaagctgggaacacgatggcacggttcgggtactatttcatattgaccgtttttttcatgttgggtttcgcggtcttttttcaacaactctttcaggttgcgcagcgtcaattaatgagtcatcacgaattacagcacgccaagctggaatttacgccggcactatttgcgtgcttgctgatgattgtgattcggttgttatcggctaatatgaccggaacagtgtattggatgttgattaatttgaacctgttggtgattaattacagcgtgattatcttagagtcgaagtttagttttatcctgttaacgattacgaacggcattgtgttaattattagtactgggattatggtgagtctgggaatttgggtggcttttgcggcagtcatggcgttgttttacgttcagcatctgcggattcgccagtttgataaacatccctttttgtacgtcattttcccaacgttaattggcccgatagtctggtggggctttatggttcaagtgggccgggtatacaaactgtcgtggtttcagaccggtacgatgatgggctcgtatgccgtggcgatgattgtggccgtcctgtacaccgtttatgtgcaccatgtgcgtcaaatcgattctaagtttgccaaggaagccaagtacgatgggctgactggatttaaaaactggaatgcgtttcgcgtggaatttgaaacctattttcggcgggcacgggagcatacgggcttatcgatcgcgacgattgacatcgataagtttaaagcgattaatgatcagtatggtcatctggcaggtaatcgggcgttgattagctttgctaactgtattgtacagacgcaaaaacagcagggcattgcgtgcgaaaactaccgcacgggtggggaagaatttacggttatttttcccggaatggcagttgatcaggcccagcggtactgtgatgactggcaaaatgcgattcggcaaatgacagtacactacggaaaagaacagatcaaaatgaccatttcagttgggctcacggaggttaaatcgacagatcgaacggcgacacacatttttcaacgtgctgaccagaacctatatcagtcgaaacgtcagggccgtgatcgattaactgtgggataggagcgcactcatggacgtaattttagcaatttataatattgtgatggcttcgttctttatgattggggcgacgacgatttttcgcctcgttttgcgacggacggagttagcgcaaatgcggcaacaccagttgaaactatcgatccttgaatttccggctattttattgttgtgtcttacggtgttggccttacgcctcatgacgatgggactagcgggtcctgatttttggctgattgttaatttacaactcctattagtggtatacggcatcatgaattccgcgagcttgttgagctatcaaacgttagcggtcacggtcatcctatcctttaccacgtttcactggcataattttgccatgatcgggccactcctgttgagcttagtagtggtctattacctgacgaaatcgttagggcaacgcgcgaatcggttacggtaccatgcaattgtggcgctggtaattggggtcgttacctggatggcactcaaactaagtggtcttgtgacgtggtttgaaatgacgttgatgttgatcgcatttgtcatcacggtcggaatggtgctggtgcaaggcgatcagctaaataaggaacgccgggccagttcccaactggaacaggctgcccgccatgatgggttaacgagtgttaaaaactggaatgcctttcgggacgatttcgaacgtgaatttgatcggacgccatcggaccagttgctgacgattacgacgcttgatattgaccattttaaggcgattaacgaccagtacggccatttgacgggaaatcaggtattagtgacgtttgccaatttgatgaccgaattgttggaaggctataacgcgggatatcagttttatcgcacgggcggcgaagaattcacttttttcatgcctcagacgtccttggagcaggcccatcaaattggtgatgcctgccagcgcgcgattcgagcgttaaagatcccagttgataagcaactgatccaactaacggcgtcgatggggatgaccaccaaacaagcatccgatagtgatgccacggccacctttcagcgtgcggatcactacctttatttagcgaaacagcagggacgtaatcgagttgttagtagcgaaaattaaattaaaaaattagattatactataataattttaattattataaaattctgataaaatgaaactattaataaaaaaattggaatgatcactgtgaatattgaaaagtttattgaaacacgtaaaaaaatgggattgtctcaagcagaactctgtgacgggatctgtacgcaggcaaccttgagtaagtttgaaaattcgggtaaggcacccgcgattcgaattttgattcagttgtgtgcgcggctaaacttaacgttagacgatgtgttcccaattaccctgcattcgcagaccaagcaggaacggatgctcgatgaagcagaatttatgttaattacgagtgactatgagcaggccaaggaaaagctagcgaagatcaaacctgaaaaattaaccgcaacgaccaagatgcagtattattttgtgacgggctatatttcagcgctgacgaaccggccgattatcgacacgctcttttactttgaccaaattatcaatgggttggacgaacatcacgaaacgatctactcgcagctggcctttaccggcatcggcattgcctacagccacgacgaggaacttgataagagcgagttctactttcagaaggtgtttgaggggttgcacgaactaccattaaccgacgataagtcgatctggcgcgccctgaacatgatcttttacacggccgaattctttgctcaaatcgaggactacgccacgagtgattcgttgttagattacgggtatgaagtttgtgcgaagaatcatatcacgtactatgtagcgcggattcggtaccggcaggcgcaaaacgcgcaggccacgcaccaaccaacggtcgcgatccaggatatgctgaacgacgcccgggccttcgctaaaatcaataataatcaaattttgttgcagcggattaatagcaacgaactaaatttgaaataattgtcatcgtaaaactgggaccgaccctttgagatcggtcccagtttttgttaggtttttcggtgaaaatcgtatcagttgtgaaacggctttcttaatgctagcatgaaatcagtaatcagctaaaaactcgaaacggaggaattatgatgacagatcgattaaaggataaagttgcaattgtgaccggtggggttgccggaatcggcctcggaattaccgaatgctttgtacgtgaaggggcgaaagttgtcgttacggccaaccataatgtcaaaggtggtcaagccgccgaaactaagtttggtgcagaccgggtgctcttcgttcaacaagatgtggcaactgaagacggctgggacaaggtgattaaagaaaccatcgccaagtttggcaagcttgatattctggtcaataatgccggtgtcggtggggatggaacacctatcgaaaaaatgagccttgataactggaatcaggtcatgaatattaacctgactggtaacttcctcggtgtacgggccgcaatcaacgccatgcaagaaactaatcatggacatggttcgatcattaatgtgtcatcagtggccggcctggtgggtctcccaatggcgccagagtattctgcatcaaagggaggaacgcggatgttcagccatgccgtagcattatcattagcccaacgcggtattgatattcgggttaactccgtgcatcccgggtggatcgatactaacatcatccccgaccaagcacgggatgcaatcctgaagaccattcctgctggtcacctcggtgaaccgaaggatattggtgaaatttgtgtttaccttggtagcgaggaatcgaagtatgccaatggggctgaatttaccgtcgacggcggcgtacgggcctagcgtcggttaataattgaatgagagttgaagaggctgggggttccccagcctcttctttgtcgtgtgatgagccactattcgggttgcacgttgccgttaatgtcttcttggtaaacttgaatccatttgagggtggtgttagctcgggcaaggcgcaattcgagtagtttataagcgtaccgatgaccgcgatgggaatcgtttaatagcgcatgcattttgatgttaatgtcgttcacaatttgatgctgttcggcctggtattcgtctagtagtgcgagttggcggctgggactaacatattgcatgacgtccagcttaatcataaaaagatcctcagtatgggcgttttccggaatgggttgttccatgaactgctgaaattgtttccggccaactggcagaatttcgtaaaccttcttactatgaatcccctgttctttaatcccaatgtagtcggcacgttgcattttatctaatagtgggtaaaggacgccgtagctgatctggcggtgcaaacccagtgtgttttggagacgcgcacggatttgataaccgctcttagggttggccagtaattgacctaaaataaagagttcgtacataattctcccccctgaaatgatgtttagcagtatcgtatatctaaaagatacaaaaagcaattaaaattttttaaaataatctaagcttttaaaaatcgcagtctggcaatgatgaaaacggttttaatgattctcataattgccggggatgcccgtataatgcaaaaaatcccggaatgaatttgaccgttttttactatactgttagaataaattaatcagattttaatatttaaagatcaaagcccgaatacataactagaacaacgaattttagcttcattaaatgttacacctagggactttgcttcttacaggaggatatgtgtatggcaagttttaaggagaagattttccggaaggaagatccgagtgtctatgatactaaagacgcccatttggtgcgttcattgcgggtgcgtgattttctcgcactaggaattgggacgattgtttccacttctattttcacactgccaggggttgttgccgcacaacatgctggtccagccgttgctttgtcattcttagttgctgcgatcgtggctggtttggtggcctttgcgtacgctgaaatgtcagccgcaatgccatttgccggttcagcttattcatggattaacgttatttttggtgaattcttcggttgggtcgctggttgggctcttcttgccgagtactttattgccgtggcctttgttgggtctggattatccgccaactttagaggattgattgcgccactcgggattaccttccctaagaccctttcaaatgcctttggcgttgacggtggggtcatcgatatcgtggccgccattgcgattattctggtcgcattgctcctttcacgtggggttacctcagctgcccgggttgaaaacgtcttggttgtgttgaaggtgctcgccgttattgtcttcttgattgtcggtgctactgctatcaaggccagcaactacgtcccatttattcctaagtatcatgaaacaagtgccggtgcctttggtggctggcaaggaatctacgcaggggtttcagaaatcttcctagcctatattggatttgattcaatcgctgccaactccgcggaagctaaaaatccgcaaaagacaatgccacgtgggatcttaggctcattggttgtggccgtggtcttgttcgtcggtgttgcgcttgtcttggtcggcatgttcaagtactcagactacgctaacaacgcggaacctgttggttgggctcttcgtcaaagtggtcatgccgttgtcgcttccgttgttcaagcgattgccgttgtcggaatgtttactgccttgatcgggatgacattggccggttcacggttgatctattcattcggtcgtgatgggttgcttccaaaatggttgggtaaattggatgataagaagcgtcctaaccacgctttgacacttttgacagtgatcgccgttgtgattgggtctgtcttcccattcgccttcttggcacaattgatttctgccgggactttgatcgcctttatgttcgtatctcttggcgtttatggccttcgtcgtcgtgaaggaaaagatattcaaaatccaagcttcaagatgccattttaccccgtattaccagccttgggctttatcggctcattgatcgtcttctggggtcttggtaacgatgctaaaatctatgccggcatttggttcattgtcggtgtcattatctactttgcttatggttctcgtcattcgtacttgaataaaaaagaaggtaagtaaaatgggacaaaccgaaaacgagcgacttcttgcacaggaaacgccggcgtattcggatgctgcgcgggtccagtactataaaattgtcatgaaaagtggcaaaggggcgacaattactgacgctgacgatcgcacatatatcgatctgttggccagtgcgtcggccactaatactgggcacagtcacccccatgtggtgaaagccattcaagaccaagcagcaaaattaattgaatatacgccagcttacttcgccaacgaacagggggccaagctggcccctcgtttgacggcactcgcccccattagtggggacgtggaactcgcctggggcaactcaggttcagatgccaacgatgccatcatcaagtattcacgggcctatacgggccgacaatacgtggtgagtttcacgggtgcttatcatggctctacgtacggatcaatgaccgtttccagcgttagcttgaacatgagccgcaaaatgggcccgatgttacccggcgtggtcaaggttccgtacccagacccgtggcaacgactgaggggtgaaagcgaagacgactttgtcgagcggatgtttaacgcctttaagttaccgtttgaaacgtatttgccagctgaagaaacggcggtcattttgatcgaaccgatccaaggagacggcggaatcgtcaaggccccacaggcctacatgcaaaaggtgtatgactttgctcatgaacacggcattttatttgctgtcgacgaagttaaccaaggcatgggacggactggtaaatggtggtccatcgaaaactttggcttggaacccgacctaatgtcggttggaaagtcattggcctccggcttgccactgagtgccgtgatggggcgtgctgaaatcatgaactcattgggctcacccgctcatgtcttcacgacggctgggaacccagtgagctgcgcgtcggccaacgccacgctggacgtgattgaagacgagcaccttctcgaacggtccacgaaattgggcaagctcgctgctgacttcttcaatgcggccaagcagcggtatgcgttcattggtgatgttcggatgtatggtctggacggcgggatcgatattatcgatcctacaaccggaaagggtgatgatgaagcgaccacgaagttgatctaccgggtcttcgaactgggagccattattatcagtttacggggcaacgtgctccgcttccaaccaccgctggtcattaccgaagcacaattaaatcaagcatttaagattcttgatcaagcttttgcagagttaaaggctggtaaactaagcctgcctgataacgctagtgaaattggttgggttaaataaaacaattaaaaataccgcgttctaatccgctagttggattggaacgcggtatttttgttgtgattggtgggtggataaaggtcgaaaaggggccatgtcaaagagttttgctagtcaaactagcccgttgtggcctatatttaagtcagaaatggggaggtgggattggtgaaaattagtgagcagttacgacagttacgtcagcagcgacaatggaatcaagatactgttgctgagcggctgcatgtttcacggcaaacaatttccaattgggagaacgatcgtagtttaccggatttacaaagtttactgttgttggcggatctatatcacattactttagatgatctcgtacgaggggagttgaatatggtggaatttaaaagaacgaaacgccgtttactgggagatacgttggggacggtgctagcgttgagcgtgtttttgttggcttctgtcttgcaggaaagcaatcggtggtggctgatactggggatactggcgttaatcgtgcaaggatactttggctttcggagtatccaactatcacgacgaaaaaatatttacacgatggcagaaattttgaattatctcaagacgggccagatcaggccttccaatcatcgacgggcccgcattattttggaaaccgtaggcgcattattgatcgggggcttaacgggtggaattttcgcttggttttggctttaatttcctgggaaatagtccttattgtagctgtttgatgagtgcttgatattggttgttcatccactggacgtaagtttcgttggctggttgagtttcagtcactttcaggacgggaatgtggtgctttttagccatgtgaacgaagttagtgacggtcgtactggtaacctgcttgttatcgacaaagaagcggatacgccccttttgaatgccggtttgcatggcttcaattgatttaacggaggggtcggtgcctttttcaatggcattttcaaagccgggattggcgaccttgaagcccattttttgcaacgaatagtcgaagattggttcactgacatagacttgtttggtcgaactctttttagcaatctgctgtaacttggcaatgtcgttatcgatgggtttcatcgaccggatatacttctgggcgttggcttcgaagtattttttgttttgtggttgctgcttggcgagttgcttggcaaagtaggtcacaaattttttcatcattgtgggattataccaaatatgaggattgacgcctttcttgaggcccatcacacgttcgccaaccttgatgtactggtgatcatcggaattattggcgagtttatccatccacgaatcatagcctaaaccgttggcgatgatgaaatcagcaccgctgacctttttcgcggtgttggtggtgggctcgtaatcgtgaggatccatggaaggcttattaataatagaagtgacggtgcccttgttaccaacgaccgctttagcagcctcaccataaaaattagtggtagccacgattttcaatttaccattttgatgggtggtggtctgctgaccgcatccagccagaatcatcatcaaaatgaaactgaataggaggatggtaccacgtttaaagagatgtgtgcgcataaactttggcctctatatcgtaattattatcatctaaccatcgtaactgattttgatgaaattgtaaattcaagaaattgttaaacttttagttgacatagtctaaaatgtgcagtaaattagcattgtattaaaaaatgattagaaaagcgatgaagagcaagagtaggtcaggttatcacgacgcagagagttttcgggtggtgagagaaaacgggtgatgactgagcgaaagtaggcttggagctgtaaatgcaatctgagtgtttactgggtgcccccattaacaaggccaacgactccacaggtgtgggctcgttaagactggcattagctagtaaaatcaaggtggtaccgtgtatctcaagagatgcgcccttcgaagatgaaaatctttgaggggcgctttttggattcgccaaaaaaagtccagattagggtcggcaattaccaccacagcaccaatcaatcagcgcttctcacaagtttaccgtgatcgtcaagaaaggaagttttatcatgagtcatttattaaaccaatatgcgagtaaccgtcacttaattatgccagctatcggagaagggatggccctccgactactaaaccgcaatcaactagtccccatttacttatcggcgaccttggccacgcaaacgttgctcggagaaaccaatcagggattactgacgctttccgaatatgccaaatttttgcgtgacatgcggttaacaacgaatttgccgttaattgccgacttgcaatcggggtttggcaacccactaaatacatattatgccgcccaagagctagagcgttccggcggggacgtgttgttgctgaatgatcagcactacccggcgcacagtgaggaacagccagcaacaacgaatttggcggatcttcttggtaaactacgagcagcccaggatgccaccagcgaaggaaccgaaatttgggttaagctcgaaggtctgtgggaatacggacccacggatattttgaaccggatgcaggccctcacgaaggccggtgcggatgcaatcattattgatcactggcaggccgaccagctgactaccattgcggcgcaaaagcggacgatcccgttgctggcaacgtggacaccaaactgtcaaatggacgcccagattgatgcctggctggacactggattattgattagagaggcccagcgggcgcaacaagaagccttagctgcattcatgggaggaattgcttatgcgcaaaaatgagttgatgagacaaacgttcaaaaaagccgtgtttggggaccagattattagaatggtggtcgctcccgacgccttagcggccaaaattgcggaagaaaacggggcggatgccgtgttcgcggccggctatgccacgagtgcctcgacattagcgatgccggatcggggaatcgcggacttcggcatgatgctggaacggtgtcgtgaaattattaatgccgttaatattccggtgtttgcggatgcggatactggctacggcgatcttgagaatgttaagcgaacggtgcgcagctacgaaatgatcggggcagcgggcatctttttagaggatcagaagtggccgaagcggtgtgggcacatggccggcaaaagcgtggaggcgcctgaggtgttagaggctaaaattgccacggcggtcgcgacgcgccaacacgatgattttctgattatgtcacggactgatgcccgcgcggtctacgggttggacgatgcgattgcccgtagccaccggtatcaagacgcgggggccgatatggtgttcattgaagcaccccgtaatcgcgaggaattagtcagcattcatgaagctttccctaccacgccgttaatggccaacatgattgaagggggtgccacgccactgacgcagacggcggacctgcaacgtcttgggtttcggattgtggtttacccaacggcgatgacgtacgcgcagacttatgcgaacgaagccttactccaaagtctgcaggaaaccggcaccacccaaaaatttgaagagcggatggtgacattctcgcggtttaatcactttgtgggcctagacgaagtcaacgcgcgtgagcaatgctatacacccgaaaagatgaaacaatatctctaacttccattaactgaatttcgtattgattgatcttccgtgataaacccgatatactggcatttatgagtttattttaaaaggggggcgcaattgtgcgtaaagtaacgaaacgagccatcttgatcttggtgttaagcgaatttttggtgtgtctggggattagtctggttattccagtcatgccctttatcaaaaatgaacttcacttaaccgccacggatatgggaattatgacatcgttgtttgcctttacacagtttgtggcgtcgccaattattgggcgggtttcggaccacctcggccggaaaccggtactggtgattgggctgttcctatacatgttgtcggaatttctatttgcaatcacgaattacctctggatgtttaacatttcgcgaattgtcggtgggctatcggcagcgatggttgtgccaacggcgatggcaatggcggcggatatcacgacgccattgcaacgggccaaagttatcggctggctgtcggcggccttcagtggtgggcttattttaggtcccggactggggggcctgctagctaaaatcgattacaaggcgccgttttgggtggccggagtaatggggctgctaagcatgattgcgatggcgatgttgttaccggccgaaaaagatctggtgcaccatcatcagcaagattcggggcaactaccatccaactggcgcgcagatttacgcaaaattttgacgcgttcggccgtattgctcttcatcatgattttaatttcatccttcggcctgcaaggatttgaaagcatttatagtatttacgtcaacgaagtctttcagtttagtctgaatgatattgcaattgtcctgacattcaacgggattatttccctgtttttccaagtcgtactgtttgaccgactggtgatttggctgcaagaaacgcggctaattcggtactgcttcttcctcggctttgcggggacggtttggatcatgatggcacactcgaaactcgaggtcatgattgcgaccctaattgtcttcaccgccttcgatctactccgccccgcaattacgacgttactcacgaagatgagtccagacaatcagggattactgaacggtctgaacatgtctttgaccagtgtcggaaatgtcattgggccaattatttcagggagtctgctagattggaactatcactatccttacatggtggtggccgtcttcttgctcctctcgtttgcgacgacgtatagcattaaacaacgacgaaattaaaaaacgatcccaacagggatcgttttttgtatacccaatatggggccgactagccgaagacgcgaatgatacgctcaatggcagccgtcatctgcgccgtttgggtggcaaagttcagtcggaaccagtgggcgccagcttcgccgtaccgcgcaccatcgttcaattctactttggcttcgttaaccaacttatcggcgatggtcgcgtcatctaggccggtggcggaaaagtcgagccacatgaggtaggtagcttgcggccacatagcggtaattttactctgcttgaagaggtcgaacgcaacgtgccgattgtggtcgaggtaggtcatcaggtcatcgtgccattgttcaccgtatgttaaggccgccgtggtggcacggtaaccaaacgttgagatggtatcatcaccaaattcgccactgatgatggcttgaatttgatcacgcatggtcgcatctttaatcagcatgtaagcatttttgatgccgggcatgttgaacgtcttcgtggcggcggtaaggacgagtccgtattgatcagcctcgggtaaggttagaaatgacgtaaattcgcgaggattatagacgagatcttggtgaatttcatccgcaatgatgcgagaattgtagtgcttggcgagttcgatgaggtgggtcaggtcctctttagaccagacgtggccgctcggattttgcgggttacagatcaccattaatggaatcggttgggaatggaagaccttttcgagggcctcgaaatcaatatggtactggccgtcttcttgcaagctgagatcaaacgccaagaggttacgatgagcccccttaatggcggcgaagaagggattgtagacgggggtaaataccagaacagattcttcgggctggctcaacgcccggatggcatatgaaagtccgggaagcaccccagtgagggggatgatttcgtctttttgaagggcaatctgttggtggtgctgctgccaattaatgatgctgttaaagtaggcatcgtcaacggcatcgtagcccagcacgtgggagcgggggatgaggtggtcgaagatgaaactgggcgtttcgaaatccatatctgcaacggtcatcgcggtcacgtcatagtgctcgggttggttggtaatttgccatttaaaactagccgattgggcccgactagcggatcgatcaaaattagtcatttttatctgtctccttatttaataaactgctttcattgagtatttatcgtactacaaaatgggtgcagatgcgaaaattattcctcgaaaatcaaaaaacggcggttatccgaggtaaggggataactgccgtttcaaatggggatgaattagaatttaatggtttggcccacgtaaatggtataaggacttgagatcccatttttagcagctagggttgcccaactgagtccatgttgagccgcaatcgctgacaaggagtcaccgctcttaaccgtgtacgatgatcccgaagtgcgcgtcgaagtcgacgttttgacactacttgatgatgagccactgagcttaatactttgaccaacgtagatcgcgttggtattgctaatgccattggcactggccagcgcacttaccgtggtgccatagttcgatgcaatcgctgagagggtatcaccgctcttgacggtgtaagccccactcgtgctggttgacgtggttgtggtcttaccagttgtggttgaggacgttgcactgagcttcagagtttgaccgaccagcaacagattagcgttactgagcttgttgactgaagttaaggttgcaacgctcgtcccatacttcgacgcaattgatgacaacgtgtcgccactcttaacggtgtaagtccccgcattagaactggttgacgtgttagtcgttgtggttgaggacatcgtggtgctgctcaacttaatggtttgaccgacgtaaattaagttgggattgctgaggttgttgatggaagtcaacgtgctcgtcgaggtcccaaacttgctggcgatggatgataatgaatcaccactcttaacggtgtacgtcgttgccgtattggtgttggtcgtcgtgcttgtcgtcgttgacgttgaagtcgacgccttcagttgaagcacttggcccacctgaatgaggttagcgttactgattttgttgagtgacgttaactgactgaccgtcgtattgtggctgctggcaatgccagagagggtatcgccgctcttaacggtgtaggtcgttgcactgctgcttgacgtattcgtcgaagtcgatgtgttagtgttggtcgtcgttgaagtggttgttgatttaaccagtaattgttgaccgacataaattttattaggattactaatgttattcagtgaggcgagcgttgccgccgttgtgctataactggaggcaatgccggaaagggtatcgccgctcttgacagtgtagtaagaagaactgcttgatgagccagtagtgccggtgaacttgccgccactagatgacaggctggctcccgcaattgcaatttgatctagctgcgtcaggttgtatgtttgaataatattattcaatgagctggcgtagtttggatcagttgcgtaaccatcagcttgcaagtcagcagtgacggtggcgtagtttgtgacgcctaacaggttacgataccgtgagttagagtataggaagttaccgtgatcagcaacactttctgagttgttagcataggctctaaattgcgcgtaaacggtaatgtaacgaccattaacgtattctttggtcgggtaattaatggaattgccgttgtaggttcccttgatcccgaagagattgtgggcctgagttgaaagggatgattttccccagccactttcgagaatggcctgggcgaccgtgacggatggcagtacgccataattattccaaccttcaatcgcacccgcttggacgctttcaatgaatgcttgaagcgtggcgttcgaactaaacgttggttgcgcggcactgacacttgcagcaacggcagtaatcgtttgtgcttggccggtttcagcgtagacttgagcggctgcagatttagccgctgcaattaccgtggcatcttcggtcgctaaggcataaacggtcgcacttgaggcagccgaactggtggcactggcgctagttgcagcacttgcaacatctgactgtgcgcttgtggctgacgaatcagcagcgctgctggcttgtgaagcagtgctcgtcgctgatgaagcggtagtggctgaactagcggttgattggctagtttgatttgctgcactagtggcgtcacttgtagcgctagcagaagtactggttgaacttgcaacctcgctggcagcactggcggtttcactggttgaactggtcagtgctgaagtggcggcacttaatgcagcatccgaaacgctggttgcggtatcgcttgcggcacttgagtcactcatggcactcgaagtagcaatggtcgtatcgcttacagcactggaatcagcggcactggctacggtagacgtgctagcgcttaaaacagcaacgttactgttgtcggtggtgtcactggtagttgactgagtggtgtctgcggcatctgatgtcgctgcgggggcatcgtcggcatgagcggcaattccggtggcccctaatccgatagaaaaagcggcaatactagcaaagacccacttgcggccttgtttatacattttgtaatgaagttggtgatctgtatgattagactgcattcaatctctctccttttaatggtaaatcagcttaaaattttagctttcaattgataagaaaaaattgcgtttattaaggaataattaagaatttcaattaagtcctacaataatctaaaacgcctactgtgtcaacggtttgtacaatacaaacacttgttttcattagagtgcttaaattccgtcgagagggtcttttgcccactaaaaaacgggaattcctgggaattctcgtttaatttgtaacttaattgtaataataagaattaagcgtttttcatgaatcttcttagggcacgaacttcttcgtccgttggagttgcggtcattgccttaatgttgtggacgcgttctaccgagacctgactgccaaaagcaacgtcgttgtcggcgaggtgctttttcttttcatattcaatgatttcttcagctaacttgctcaagttgttgtccaattcaaccactccttataagatattcttaaagtttgtaaacctctaccaccattgtaacttttttcgctaaaataatcacagaaatttctgttttgaagattttatgatggatttatggcataatttagggagacatattagagatgggagttagtgtgatgttaacaggttggaattggatcggaatcatactatggattattgcgattgcgtactttgtttttgtgattcactttattcgggtacggcaattaatgttgatcgttaaaactaaaaaagcatttgcctggaagaactttttacagtacgtcggattactggcagtttcggtagcagcctttgcaatgatggcttatctgagttttttccgtagtgttgactatacgagtcatcaagatgtgacggttagcacgacgtaccggccacttgttttgacatcggtggataacgatttttattatgcacaggcacagcggcggacaacggggagccgtcccgtgatttcatattcgtactgggttaagggaaataagtacacggtaagcgggcataattccgcggtggccgttggcgctaacccaatgagtatgtcggcttcggtttacccatggaacaaaaagcaacttgccaaggaagataaagaaaacggtaaggcattcgcagccgaaatgaccattcactacaaaaagagcttcattaatggtctaggggttcgaagtgggcgggtagccgatcaatataccttgattcgggtaccggcagccagctttgtggatcaaaaataagaaaccaactgcgtgacaccagttaaatttaaattagcttaagcaagcgagacaaaaacgatcaattttgtcttgcttgctttttttgacggcaaaattaacaaaagataaataatttttggctagaattgctaatgccgatcggcagcattttttctatactgatgatcaagttgtgagggacaggcggctgatcagtaccaatgaattgaccggaattaacgtgtaaaagccgaactttaacgggctgatgttatatttaatgacatgtagaaaggggtttcgcaaacttttagtggatttttttggaaaataggttaaaaagcattgacccacgatccatatgatgttaacttttataacatcaaagcaaaggcatgagaaaagggagagggatatatgagtttagctagtacatcgttcatgattttatctagtattttggtattatttatgaccccggggttagcgtttttctatggtggtctggtatcgaagcgcaacgtggttaacacgatgctgtctgtattctttatttgtgggttggccgtcttgctatggtttatggtgggctactcgttatcgtttagtggtgatcactttggggtgattggaaatctcaagatggcctttcatcaacactttgatatgagtgcaatgacggctaccacgaccaaaattccggatggcctcttttcaatttttgaaatgatgtttgccattattacgccagcactgtttgtgggggcgatcgtgggccggatgaaatttaacttccttttcattttcttgattatctggtcaattttaatttattatcccatggtgcatttggtttggagtgctggtggtattttttacaagatgggcgccttggattttgcgggtggaacggttgttcatattgatgccggaattacagccctagttttgtcaattttccttggtcatcgggtggactacaaagagccggaacactataacttgccatgggtcatgttaggcaccacgattctctggattggctggtacggctttaatgctgggagtgcctttggcgtttcgggtgttgcggttcaggcgacatttacgacgacgattgcgacggccagcgccatgatcacttggatgctgattgatatggtacggaaggggaaacctagtttagttggtgtttgtaccgggacgctgtgtgggctagttgcgattaccccagcgtgtgggtttgtgacactgacaggtgccttttggattgggattgccggaacctgcgtgagctacttcttcgtgaacttcctgaagccgcggctcaaggttgacgatacgcttgatgcgtttggttgccacggggtaagcggcattgtcggaagcttggcaacggggctcttcgcaacgaagtcggttaactcggcggttgctcataatggtttgttttacggcgggggctttcaccagttcggggttcagttagccgttactgcctttacgatcgtgtttgtggcgatcatggtgagtgtcattgttgtgatcatgaaggtcttcgtaccaatgcgtgtttccgagaaggaagaacggctgggcttggatcttggtgaacacggtgaaagtgctgattacgtggttgctgaccaatacaatcgaaaagacgtcgatatcttccgaaaagaatttgctggtcaattggctaacttgaacaagcggccagattaatacaattgaacgacgaaaccaacaactcagtgtgggcagcggtacctgttggtgaatggatctaataatagaagaaaacgtgcctgagattgtcgtttcttgggcctgataaaaaatagtgattaatccttggttgcgggttaatcactatttttctgtggattgagtaacggtaagttggtaggcattggtagtcgtgaaaggcgaacattctgaatgaagaatgctcgctttttaagtaaaattaaaattaaatgaaaaaaatccatcattgttgaataaatatacaaaagcattgtatactagtgagcgttgaatttttgatggaggaataatgacgataatgaagaaatttttcaaattttggctgatcagcgttctgagtgtcatgctcgttttaccactctttagtggggttgcgagcgctgcagaccaaacgagtagtagttcggtgagttcatcatcaagtagcacgactagccaatcaagcagtaccgctacaactagtggaacggatgactcgctcgctaagatcaaggcgaagggcgaaattgtgttggggacgagtcccgactacccaccgtatgaattcatgtcgaagggtaaagtcgtcgggatggatattcagattgccaaaaagatcgccaaagatatgggcgttaagttggttgttaagaagatgtcctttgattcactgttggtcgccctgcaaacggggaaggttgacatggtcatctcgggtgttaacccaacagccaagcgcgctaagagtgttaatttctcgaagtcatactacaaagccggtcagtacattctgatcaacaagtctgataagggtgtttatacgagtcgtaagtcgtttaacggcaagaaggttggtgcgcaaaccggatcgctaccttacaacttagccaagaagcaggttaagaattcgacgaccaaggggatggatcaagtttcagatctgatcattgccttgaagtcgcataaggtggacggggtcgtggtggatgaaccaacggctaaagcctacgctgaaaacgataaggatattgtggctattaacgggaaatttaacctcggctcgtcacaaactaatgacgtggtggccttgccaaagggggccacagccttaactaaccaagttaacaagtcaattgcttcgatcaagtcacaagggttgattgaggggtatctgaagaaggccggttcctacatgaaggtgaacacggtcaatacctcgatgtggcactactggaagtactttgccctcggggtagaatatacgatcgggattagtgcggtttccgtagtggctggtttcttaattggcgttttactggcctttatgcggttatcgaagaccaaggccattcgggccttgggaacggcctacgtcgaatttgtacggggcacgccattgatggttcaaatcctgtttgtttacttcggcctgggtgtgattgtcaacattccggctgtggtttccggaattattgcggtgtcactgaacagtggcgcgtacgtctgcgaggtgattcgtggtgggatcttgtcagttaacaagggacaaagtgaagctgcgcggagcctgggacttaatgcgcatgacacgatgtattcagttatcttgccacaggcgttgaagaacatctggccggcactgggaaatgaatttgtttcgttgatcaaggagacctcgatcgtgtcgatcatcggggtatcagatatgatttaccagttgaagatcgtgcaagccgatacgtatcggggtgtgattccgatcgtcattacgatgattctgtacttcattttgacgtttacaatttcacggattttgaagcattacgaagttaaaatgaacgcgaaataatgcgttaaaaactaaacaacgcttgtcatctgcccagtagtggggatgacaagcgttgttttcgttgttggcatggtgtgctaagcgtcggcgagaaagccgtgctctaaaatatcgatgtagtcttctacttcgtgaatgacggtgcccatttcgctaatcgtaatatcgggattgttttgaatcagggccttggcatcttcaccgatgagcatggtcatggcggtcattaatttttgaacggtggctggtttgacccccggccgcaggttgagccgatcgatgacgggatcgatcatcgacgggaccatggccgtcatttctgaattccaaatgtggcgcacctgttcttgaactgttgggggcaggtggcccagatccgcgtaggcggccatggagagtccgaactcggccggatgatcaatttgcatttgaattttgtacttggtcgcgcgtaaaatcatgcttttaagatcgggtgcgtcttgccatacggataggtcagccatttcaattaagcggtcgtagctggcctggacggcggtcacgtatagcttggccttgctgccaaagtagtggaataccaatcccttcgagacgtcagcctgttcagcaatttggtcggttttggcgttttgatagccattctttgcaaaattggcgatggcggcgtctaaaatgcgtcgttctttttcgggatccttgggtccactacgttttaccatggtgcgagctcctttcaagcggtgagacgggggttaatttgggcggctgacgtggtgatgcatccgccgcactggccttatttacaatctagtataccgttaattgattttcaggtcacggtgtcgatagataatataggcaatgataatgagaatgaaccctaagccggtcatccagcccgccgttgaccagtcaattgccttgaggggcacctgattaacccagccgtatggcgataatttttgagcccactccggtaagttcaacaattcgcctaggtaaagggcgaaaaaaccgtaaacgggtagcaaccaggcgagggcttgcaagcggggcacgagactgacaatgagtgccgtaatgccgatgatgacgaaaagggcgggccaataacccacaaatccgcggaggtagcgggagagatcaatggggtgcgctaacgtggcgttgcccgcaatgcccataccaatgatgcccagcacgagggtcgcagtaccgacaagggttgcaaatagcatgtgggtaccaaagatccgcaagcgagaaacaccgcgggcgtggagctgttcaaggtagcctttgcgttcatcggtgttgagtcgcaggatagtcatcatagccggaatggaagccaccacggcaaagatgatggtcagggtactggcaaacgagaggacgacgacccgattagcacttgccacagcggcatggccgatgagtcgggccatggtcgggtttgttttcatcaagtcacccacgttaccaaaaatagatccgtagctggctcctaggaggaatagaccgagaagccagacaatggtactagttcgttcgaggcgggccagcaggctaaagggcccggccaagaagagactggcgttacgccggccccgcgcagtcggaagaataccgctcccgacatcacgacgaccagcaatgaaaaaggcgaaggcgcctacgataatggcaaagccaagcattagtaggagcggggtccaatgattgtcatggtaaacatcgagtttttcgatccatccaaaaatggtccaccaagtaagatcgggatttttgacatcggtcgccatgcgggccacgtataagataccaagaacgccgtagctcagcatggtggcactccgcgcgctactaacgatttgggcacacaagagactgatggccgcaaacatgataccaaaggcggcaagcgagagtccaaatagccagctaccattggccgagatacctgtcattccggatgcttgcaggcctagggcttccacgcagccgatgatgagattaattaggataatttcgatggtggcggccagtagttggctaccacggcccaccgcgtgtgcgctgactaattccgcaacgccattatcctcttcgttacgactgtttttgacggcgaagtagatgttcatcatggcggtaaaaaggcccatgaagaccatcatttcggcggcgtaaataatggcggaagtgtacggtttcgcagcagtgaacggaccaaacatcgaaatcatggccggtgactttagcgtggtactaatggaagccatcgatttggcatcgccgtacagggtaccaaacttgccggccgccgcagccattaaaccggcgagcccaattagccaaaccaaaattttaagccagtcgcggcggaggtagaatcgaagcaataagcctgtttttgcaaagctattcttgcgcattgccatcggccccttcctgattgtagtaacgcatgaagagatcttcgagcgttggtggtgtactttgcagactgatgatgtgcttagcgctcagcgtggtcatgatggttccgagcgcttctgaatcgacagcaaaactggccttattggcgacttttgcagcggcctgaaacccatgaacggtgggtagttgcgcaatgtcatctaacgcgtcagtcgtttgaacggtaatattggtccgacttagcttacgcatatcggccaacgaaccggtttcgacaatttcacccgcacggataattccaatgcgatcacacatccgttctacttcactgagaatgtgactagagaggagcacgctcttgccggcttccttcagttgaaggacttggtgttgaaaaatttcttccatcagtggatcgaggccactcgtcggttcatcgaaaatatagaggtcggcggccgtcgaaaaggtggcgatgagggctaccttttgccggtttcccttagaatagctccggcattttttcttgacgtcgagatcgaatagtttgatgagggcatcggtacgggccgagtgtttttgaccgcttagctttaagaaaagatcgattgcttcaccgccggaaaggttgggccacagatagacgtcgcctggcacatacgcaattcgttgatgaatcgcaaccgcatctttccagacgtcttgcccaaagatggtcgcttggccaccattggtttttaagatccccaggagtgcccgaatagtggtcgatttaccggcaccattcgggccaatgaagccgaacacttccccagaatgaacgtcgaacgtaatatctttcagggcctgaaacttgccaaaatttttttgtaggtgtgaaatttggaccactgcttgtgccatgataaactcctccttctcatcggatcacggtgtaaaaaaagtgaccaataagcgccgattacagcttgtattagattacagggccagtgtaatctttgttgacttgaaagtcaatgactaactagtcaacgattttgcatcgtcgtgaatcgttggtatgacgggtaattagccaaataattatcagtggcgtgcagtcaatattatgttaacttgattgaatttctgtgatttgacggagtcaatctggtggttgcatttcgatccggatgtgttaaactgatattttgttagacaactagcataacaattgctagtcacctagcattaaattaagggggatgacgatgatggccaactacggcaaacagttgaaacatgcgacgaaccaaatgaatcgggcactcgataactatgcccggcagtatggggtaactggcgtgcaaatgtctattttagattatctcggctcccatgaacatgtattacaacgtgatattgaaactgagtttggcattcagcgctcgacgatgacggtgacgctccagcgaatggaaaaagcgggcttaatttatcggcaggaatcggcgaccgatgcccggcaaaagacagtcaacatgagagctaaggcgcgcgaaatcaagggattggcgaccagctacattgaccagcaacagcacgcgatggaaactcgtttttcgccggccgagctacaggtatttgaagaggtgctacagtactttactgatttgaatggacgtgaaagctaatatgagtgaagagaaaattgaaaaaattgcaccacgggtagtgggcgcggtcattgcgaccggattgatgtcattttgcggggtcattatcgagaccgcaatgaatatcacgtttccaaccttgatgaaggaatttgatgttacaacgaacctcgtgcagtggatgaccacgatttacctcttggtggtggccgccatggtgcctttgtcggccacactcaaacgccgttttaagatgcgcagcctttttctctgcgccattcttttatttatcgttggggtactgacggactactttgcgtcgaccttctggatgttgctgctagggcgcgcgattcaaggatttggaactgggattgcgttaccgttgatgtttaacattattttggagcaggtcccgatgagtaaacgcgggacgatgatgggcattgggacgatgattaccggggtggcgccggccattggccccacgtttgggggcctcgtggtttcgacgctcgggtggcgtgatatttttgccttcctaattccgctcctgattgtgtcgttggtactcggattaacgtgtatccaacaaaaggtccctacgagcgctgtgtcaatcgaccagtggagtgtcatcctaatcgtgatgacattttgcggtttaatttttggaattagcaatttaggaagtagtgccttcctgagctggtcggtcgcgggggccctcgtgatcggtctcgtggcgtttgtcgggtttatcatgcgtagccaacgcattgagacgccaattttagatattagtctgtttaaaaatcgtggctttagcagtaatctcttggcgtttgcgctgattcagacggctgcactgggactctcatttttgctaccgaactatattcaactagtcaatggcaatacggcgctaacggcgggcctaattgtgctgccgggggcggccttgggtgcgattgtgggaccgttcagtggacaactttacgacagtgtgggggccaaattaccactacgccttggtagtgtgctggtcttgattggggtactggggatgagcgtgatgggtcacaccctcagcaacctcgcaattttagcctggtacatctttttcatggccggaatgggaattcattatggtaacctgatgactaacggtctacggacgattgatcaaacagctaatagtgacggtaatgcgatctttaacaccacgcaacaatttatggcggcccttggaacgagtatgtcggcggccattgtcgccgccgcgcaggctaaggcgacgaaccaagcggccgcaacggcaaccggttccgttcatgccttgctcgtactgctcatcttgctggcagtcgaagtgattgtgattttgatgttgacacgaaccaagcgggacatcgcttagtagaatataccgattatcttaaattttggtaacggggatttaaatctgtacctacatgttatataatgaagccacttacaaatgactcgccctcctcctcaagggcgagttttttatgaaaacgaattagttgcgctagttgactatttctctgaaatgaataactttatgtcaaaagtgacccgttataaatgccgaaataccggcatttataaaataaaagcaaacaatttttaacaaatcgtgtcattagtggtacccttataacataatgaaaacacaaagagaaaaaatgacggctggtgaaccgtacgagcagtttgacccagaattgattacgcgacgaaaattaattcgagaaaagctgttgacggttaaccaactcgacaacaacgaacaacgaaatcaaaagatcaaggatttgctggccgataccggagatgatttttttgctgaggcaggaattgaattcgattacggcttcaatattcacattggtaatcacttttatgcgaactaccatttgacactgcttgatacttgcccgatcacgattggtgatcactgctacatcggtcccgacgtcggcttctacacgccggtgcacccgttatccgccaaattacgtgacgcggatgtggagctgggtaagccgattacggtcggcaacagtgtctggatgggcggccatgtgacgattttgccgggtgtgacgcttggtaatcgcgtcgtggtgggtgccggttcggtagtcacaaagtcgtttggggatgatgtggtgattgcaggtaatcctgcacgtattattcatcacctagatgaaaacggggatgtgatccccggcgattaattcaatctaatattgagcgaattcatgagtatttgtataagatagcaagctaaaagcacgctgtgcagatatccctagtggagaaactgtattggcgtgctttttttgtcgggtgtggcagaaaacaggttcatggaacccattgcgcacactcagtgaagtaaggaagacttcaccatattgtgaacgagaaacctaggaggaattttttattttaaaaaagcaaaatatcgacaagaagatgtttgtgccaacagttgccttatttttgttagtgtcaattgccctactggcgggcggcgccggtctcaaatcaacgcttagttcattgatgaacgtgattagtgccaagctcggctggctgtacttggggatttacattatcaattttattttctttatgtatattgctttaagccattttggcaaaattaagcttggcaaaaagggcgatcgcccgttatacagcaattttcaatggggaagcatggtatttgcgaccgcgattgatgctagtattttaatgttgagcatggttgatccactgcgctacgtccagcaacctctgtttggggcgaaggcgatgtcagcacagaactaccaaaatgcgcacatgctgggacagtttgactggggtccgatggcgtggatgatgtttgcatcagccgccgtgattattgcctatgtgatgtatgtcaaaaatgttcgggtaatgtgcattagcgacgccattccaatgttggaaggcgaccaaacttataaaaaagtattacgcaagattattgatttcttagtggtctttggaattatggggggcattggctcgtccgtggggatggaaattcccgtgctgtccaagattattgcccaattaacaggaattgcagatacgattgttctaaagctagcgttgtttgttatcctgtttgccatttttgctttgacgatgtttaaggggattaaaggtgggatcgaccgcttgagttctgctcatatttggaccgcgattggattcttactgatcgtgctcttagtgggccccaccatgtatattttgaagtccgaaggaaacagtctcgtcctactagtcgaacgatttgtttcgatgagtactggaacggcttccggtgttggtcatgcgatcgacccagtgaagtcggaaacgatcttttattggggctggtggttaacgtacatgccatttatgggactctttattgcccgaatttcgcgtggccggacgattcgccaagtcattttagggatgctcggatacggtgccctcgggtgtatgagtttctacgctattttaggaggctactcgctgtacctgcaacaaagtggggcagttaacctgattcatacgttgaacactcaaggccaagccatggccattgcccaggtcatttcaacattgccatttaagtacgtcatgctggtggtttacgcggtatcgtgctttattttcttagcaaccacgatttcgtcgtcggcctacatcgtgtcatcctttaccagcacgaagttgaagcccacacaacagccaagtttagttaaccgcttggtctggatggcgatcttcatgatcttctcatttgggattgtctttgttggtggctttaagacgattcaggcgatctgttcggtggcgggattcccattgatcttcgtgtcggcactgctgatcatttcgacgtggcagttgttatcgaaggactattcggtagaaattcccgacagttcaattgcacgtcttaatcgccaaataaaaagacacgccaaaacgcgtgccggagtgttacatgatattattcataattaaataggtgcttggaaaaagagtctaattttcataggtgcccatatcatccgcaacaatcacacgaccagcatattgctggccgtttttagttgtcaggccgactttgttaaaggcaaacgttacggttgtggccgctttcactgcgacccccataacggcccccgtatcggtgttaattccggaaggtacatcgacggcaactactggagctgcggcggtgttgatcgcttcgatcgtggttgcgtatgaggctttgacctcgcgatcaatgccaatgccgaagatggcatcgacgatcagatcggcggttgcgagcgacgctaggctggtcacctggggaatatggtagtagtcacaaatgtgagcttgagccagatgttcttcggaacggtgcgcgggggtgccgacttcaataatggtgacgtgcttacccgcgatttgaaggaggcggccgaggcaaagtccatcaccgccgttattgccagaaccggtgacaatgctgatctgctgggcgtccgggtagtcgcgaaggatcacatcgcggacggctagagaggcgcgctccatcagcaccaacgacggaatgccaatggtttggatggtgaattgatcgtaatgtttcatttctgctgcagtaactaatttactcataagggtcattcctttgctaaaataatgggactggtcgaacggcgcattagttcgggtagcttggccgttgtgaccgtggggtgcgcaatccctttaaaacggtaggcttgcgcgtcgatgtcgaggaccccgtagtagtgggtgtagtcgtggtggtcattttgcttcgggatcgtcatcgtttggagaaatttagtgagacagcttcgggtgaccagcgtgtcggagctatcgcgccaccgccaaagggtggctttgatgaagcggtcggtggggatggtccggttgggcacagccccatggtacgcttgcagtgcaagctgggtggtcaaccagcgccgatcggagggattcatatgaagaaactggttgagattagcggtttgcttggcgaggctcggtgtattggtgagcacgtccgtcggattgcgggtgatcgttaaagtgtgtgttgtcggttcaatgatgtacgtccccgtcgcgtccgcaatcagccagtgaaagggataaatcgcttcttgatcgtaccagggaacaccaatcagggcgatctcgggcagtcgttgcgcaatttgagcgacactgctattttgactgagtagccaagaggtgaagtcctgcggtgagaggttcaacttgcctgaaacgggctggtcgtagtagtgggcttcgacgggaaaataaagttcggcaaccgctaacccggcgctgttcacgccgtcaccaatcaggtagtgaccgtgggtggcgcgcataccaccgagcacggcgtactgaaaggtaaactcggtgggtgcggtgatgggctgccagtgatagtcgatgggaaggtaggttagttgccacggggtcttggtggggaaatccatcgttcggccgagtagtaagtgcgtcgcggcatcggtaattgtgaggctcgtgcacatgtgtgtcatctccaatgagtagtttgattgacgacggtaagcgaaatcctgcatatctaccgccatcatagcacgaatttaaaatggaataataattttatggctcgtttagatgacttttagtaagaaatcaattaagataattggtgagaggcggtgatcagatggacttggaaaagtatgttgaatatttcaagaaaatgcaaaaccgtgagatcccgtggacatcaatggacggtgaagatggaatcttgcaaatggggtatcccaagtatgatgagcaaatgctgcaatttattcgtgagtttagggaaagttctgattttgatccgcggtacaaaaaaacgttacggaagtggcacattcgggtaaaaatgaaccacgtcacgattggtcaagtaatgctggccaaggaccccgcactaagctgggccatgttgtccttgatcgcaacggctgaagaagtcgatgctggcagttgggcacgggctttacaagaaggatatttataccaaatttcaaaagcaattattaacacggaggctactagccaaccaagttagcacatgacgaggattgaaaccgagatgattggtttcaatcctcactttgtaggggagaaaaaatggcaaaaaaagataagtacgaagtgcatcgctatacgggattaccggtcgaaatggacaactcgggccgctatgaatttaaagtggatgcgcatggtgaagccaaggcccatgcttggcgaacgggaaagcacacaaaaggcaaataccaacacttgggccaactgttactgactgaaaataatttgttggtggcgattttacgagttgaagaaatggcgttcaaggaccggcatagcgaggtgccattacagcggtttacgaccgagttcattagtgatgacatggtagcacagggattgaagctactgaagtaacgcgggaataggcaagtttgccccatctcccggaagagtggtatattcttaacaactaattaagtggggtggaacaatgtacacaatttttacgatgcttaaaatgattagtgtcaatcatcgccatatcagtaatgcgcaggtcgtggtcacggatgaagcggggaaacccaatggcctgctgacggatctgttgcgcgatgtgattaatagtatcaatatctttgtcgacattaacgagacctattccgccgcggaactggtggcggccattagtgaccacaccccgttgcccgacgaagttctggaagaataccgcaaaattttggaacaggaaatttcgggggttaactttgcgacccgtaaagggcagatcgaattaataattgaaaggtgatgtgcatgaagacgctcgtagtggttggtcatccccgacgcgaggattccttcacccagcagttctttaaagaagggctcgcacaatttgaccatgtaacatggatgacggttgatgagcagcaatcagttaccgagcagcgccaattgttgatggcacacgatcgcattattctacaatttcccctttactggtatagtgcgccggccgaattgaagcggtggattgatacggtatttggggacacctttgccctagccccccgctatgttctccaagaaaaggagctgggactggtcgtaaccacggccacggcggccactgattttggcgctggccgggtagaaccgttcacgatggatgagttattgcggccgtttgaagcgctcgcgcaccgtgtgcaaatgacgtacttaccaccgttggccgtgcaccaatttgcctatatgacaccagatgagcagcaacggttgttggtcaactatcaacaatacgtgacggcccccacttttcaaacgctggcgggccggggtgcgtgggtacaggcgcagttagcgcacaagctggcaagcctaaccggagatgatgcgattaaggctcaagcattactgacgcagttgacggataactgggatgcattagacgatttacagatgaatctgcgattgatgaaggatgcgggtgacgacgatgaatgataccgattggatcgtgcaggccactgatcagttacgcgcccatgcgacgacgtatcaggatcaggccttttacctcgcgttgcaagacctattaatcgaacaaactaaacgacttgagcaggcccagggtgaactagatgggcgtgcttggggatgaaaaaagcgactaatctatagattggccgtttttttattgattgctgagcgaattcctaaggcgccattccatatcctatttgcgtccctgcatggtacaattaacccaacataatcgaaaccagaggggtgtttcacgtgaaacggggattgcgaataattgggttagtgttcatgacactggtgttgggattagtcatgacgacgcgggcggcacaggcgcgggactatacgatcgataaatatcgggtaaacgtgcaggtgcaaccaaatggggatgcaactgtggaacaacgtattacctatgacttcgatgggaccttccacggggtgtactacaaccaagacgtgaatggaattcaaggatttgccgatcccacggtcagtgtggtcaaaaatgggcaacagacgcagctgacgcagagtactagccagcaggcgaacacgtttttgacaacgaaaaaagatgataactacaagatgaaggtgttttatccggccagtgacgaaaccgtgacgttcatttaccggtaccggctgctgggcgtgatcaccaactatcaggatacggccgagatgaactggaagattatcgggcaggcttgggatgaaccgctgcataacgtcgcaattaaggtgcagttaccggcacaaaaaatagcccagctacaggcatggacccatggcccaagcagtggtcagacaaccgtgtcgaagacccgtggaacagtggtgatgaaggtcaaacaggtgccggccaacgtggcggtggaaagccatgtgctctttccgactacggtcacgccaactaacagtcgtgtgaagcagtccgatcgattgcaagcggcgcagcaacaagaagccaagctagcgaaacaggccaatcagcaacgtttaatctggcaaatcgtgttaatggccctgtttggagcgttgttactcgtcgggttggggcatctatggattcagtgccgctggtttagtaagcaccaagctggtcatgtgaccgagatcccattggtacaccggtgggacattcctgaggtgcctgccgcaaccgcccagagcatcttaacccgtgataagcccgataataaggcgtttagtgcgtggctgatggaactcgcggctcagggtgaactgacaattacccctgaagcgggcgtctttaagacgtaccggttaacccaaacggcgaagatgacggatgcgcaccgccatgaccagttgatccagtttattttcgaacggattggtcggtttgatcaagaaacacagcagccgacggttacgttgatggagatcaaacagtatcaagctcgtgatgacgatgatgacgatcaactattaagtacccactttagcgattggcaggatgatcagttcgaaaccgttgaagcgctcaactattttgaccaactaagtcctaaaattaaagcacacgcatggggcttgatcgtgacgaatgcgattttggcagtggggatgttcgttattagtccgttcttaccgggcaatgggctgacctggcttgggtttgctttgagcttggccctgttagtggtgagcgtcgtgatgggcggtcaacgattacgacacttaccccactacaccgaagcgggtaaccaagtcgcgatgagcattaaaggctttcgcctgatgctaaaggacatgggacactttgaacggtcacaggttggtgatttaattttgtgggagcaaattttaccgtatgcggtggcatttggacttgcgaaacaagtcgtgaagggcctcaaagccaactttacggatgaagaattggccgttggcttgccactggtttatccgctattcttttacggtgatttcggtaatcagacgtttgcgacccagttccatagcgactttggctccgttgtgaactcggaaatgagtagtatcgacggtggctcgggtggctttagtgccggtagttccggcggttttggcggtggctccggtggtggggcgttttaaaataaaatacaaaaaaatgatctcaaccaattttcaacacttggttgggatcatcttttaattattacgaattcttgtgaatttgtggttgtgctgatttgtcgaacagctgatgacggagctgtgattcaggcatatcggggtagttttcaaatccggtgaagggagttggatttttgtgggcccgattttggtaacgtgcgcccatctgcattgcccgtggaatgagtgagccgttttgcatgtgatcgcacagcaccgcactcggcgtcaggttggtgttatcaaatctcgcctgcatcatttctagaacttcttggtattcgggtccccagtgaatcgtcgcgccaaattcttgtaacttattcagtaagtcttggccctcgtcatggaagatggttttaaccttcggattctctagcgccaccgtttcgttcatggtcatgctccgctcaagatgggcttgcatctgttccttagtggttaattcatcagtgagcaggaagtaggtcatcatcatccgaatgaaccgaatggtagaggtgcgcacaccaagggcggtccccggatcgagatccagcatgcgaagttcaatatagtctacgcccgatgtcagagcatcttcaattggggcacccgcttttttaaaccgcacgctaccgtgaaattctgcttcatttagcagttccccgttttgaatcccctgttcaatcttggcaacgtagtttttgaccgatgaatagtcccctttaagtttattgcctaacccaaagtgagattcgcgcagactacgaacgggaccgtctggtttttgatcaccgtcttcaaagaagttggcttccgcgatcgggctactgccgaaaaggtaggtgatgagccattcgtaggagataatcccttgaacaattttttcgtagagatggttaatgaaggccgctttttgccagccccgctgctcagcaaccgaccagagtgtgttaacgaggttgtcgtttaggctaatgttcaggtgcacaccggtcggaattccggacgcgtagccatgaatctgagcccatttttcgtagtaggcttttttatcggcagagacgtccgagatcgggatctcgcgtttatccttgggtagtgccgggggcatgctgaggggccacaagatttcgtcgggcgccagagcgttgcgtagcgtatcgttgagctgcatcagatagtgcatggcatcataggaatgcgccgtggtgggggtaatgatttcagtttgcatctgaaggaaatcattttttatgtatttatttttacgttggttaccgattgctttggggtagggccggttacttaaatgaccggtcagatcaacgcggtgcatctccacttcgatgcccatgttgaaatcactagctgttgcaatgatttcattatcaaagacaatttttccaatttcatcaaacatcgcgtcacgctccttagaattctgtaaaactttaaatgatgattgcaggtattttactctatattactgctggtgacaatccaaacatgatatttcggtgggaaaagggatcggattaattggtgcagatcatcaattgcaattgcgataattcgtgctaaagttgaagaaactacttatttaaaaggacggaagcaaatgtcactctcatatcaatccctattaactgcagtgccgctgattctgcgagctggtaacgtaccgaacatcgtcggggaagccggtatcggtaagtcggcgctggtgacgagcgttgccacacagatgcaggccaagctatttaccaccgttgtgagtttgtccgaaaagggcgatttggcaatccccgtgccgccattaacctcggattcgtttgtgcaaacgaaagattacggtacattggcgaacgtgcaatttggatactcgcaaacattggttgatattattcagtacgctgaggcccatcctgatcaggcgattatttggtttttagatgaatttaaccgaggaacgcaggcggttcaaagtgaactcatgaatctggtcttgcagcgtgagattaattcgttgaagctccccgcgcaagtcaagattgtcattgcggaaaaccctgatagtacgatggcgggatttgagacgtcaaactacggtgtcacggccggtgatgcggccatcaaggaccgaaccgtgcgactagtaatgcgtgtcgatgtgccggactggcttgattgggcggcccaaactggtgtgcacgatcggcccaatgtgcatgatttggtgcggcgctatgttcaagaacagcctgaaatgttgcatcccacgacgcatggagaggatttatatccgacgccccgggcttggcaacgggtttcggataatctctatgaactcgatcaattggatgaggcaacacgggccatgattcagctcgacctgttacagggggatcttggtcaaaaggtgggaatcgcgttcaatagtttcattcgggaacaaaataatcagctaaccgtggccgctttgttcggtaaggcagatgtcagtgaagcctttcaggcgtttgaagcggcggatgaactacggaagcagcacgtgttaaaacagtgtctcgaccagacagaccagtattcgttggccgatgaacagacggcggggcgttttattgagttgttgcaaaaactcagcgatgacggccagtatgcgatcgtgcagacgatcggccggattgaacatcagcgtgatattttagaaccaatgtacgctcagattcaggcaacgcaagatgacgaaacggcggtcgccagattgtaccgatacttggcggtgatcgcgacaagaaatgataaataagggtgtggactgaggcgattagatttcgagcattaacgtgataaccatgattattcctgggcttggaatgatgatggttatcgggttaagcacaggaatttgtctcagggaacccaactaaaaaagggtgtggactggaacggtagaagacgagcattaacgttattatcacgattattcctgaacttgggaatgattgtgataattgggttaagcacagccttctgctccagggaacccaactaagtaagggtgtggactgagacgattagatttcgagcagccgcaaatagtcgccaaggaggttaatagatgaacaaacaaaagtttcaacagctcatggagcagctgcgccaagtaacgggggtcaatgcgaatcagttagccgaaaaattggtcagcgcggcggtgattgatctcttacaaaatgagcggttatatggtgaagtgctcttgcaactaccacgcgcttacgatgcgcaattaactggcattatgggccttcattggcaagataatggcttgcgattaacgattaatcccctgcggctggcgaagctccagtttagcgatgaattgccaacgttactcaagcatgaagtgcttcatattgtgtggcaacatcccctgcggtatcgccaaaccgcacaccaacataacgtcggtattgccaccgatgttgcagtcaaccagtatttatcggcggccccagttggcacgatgaccttaggcaagctccagccgctacttgaggaatcattgcccccgaaggctgattcacaacgctacctcgatattgtggaacgcagcgggttgaaccctgatgaccagcaaccatcagacgccaatgcgcaactggatcgtgatgtcgatgccgatcagtcgcaggccgaaccaggggatgataccggtcagcaggcagatacgcatgagggctgggaatccgatcaagatggcaatgagagtctgcaaacggccaatttgcagcaattgttgacccatgcatggcaaaatacaccagataagcagcgcggtttattaccgggagaggtttaccagcaactggaagcagtcgatgatgaaccacgactgaattggcgacaactactgaaaaaatcccttgggaaaatgcccttgggcaaaaaagactcctacgcgcggtttaaccggcgacaaccgctccgaatggatttaccgggacagattacaaacttggtggtcaacgtggccgtgtttgtggataattcggggtcgatgggggaacgagaaatcagttacctcctcacgcaaattcgcgcaattatgaaggtttatgaggctaaactgacagtgtatagctttgacacgcaggttcatgcgcaggaagcctacgaggtgaagcaggcgacccaaattcggttcgaacggatcggtggtgggggcacccgatttcaaagtattttcgattttctccatcaacaacacgcaacaaacaacgacaccctcgcggtcattctaacggatggttggggggaagcaaagttagagccctaccggtttagtaatgtactgtgggtgctgacgaccgagcgcagcgagttatccgtcactaacctgcagactcgcgtggcttcgttggcggacgatcctaattatcagaagattaaaactacaaattagattaaaggagaccattatgatgcaggaatacttatcgccagctgatatgcagtcggtgcttgttcatgatgtttcgtatacccgagcggtacgtctactttcggaaaactgggatacggaagacaaccacttatttagtgatcggattaagaccagtgacattatttgggcccgtaagttacagcgggctggattaattcgtggcaagcatgatttgtcgacgtatgaaggggcgcaaaagtttattattgcccacgatgactggctgatgccagcggctaaaaatgaattattgaaagattttgattagcaaacgctctcgaattgggaaaatcaattcgagggcgttttttggcacggacttggtcgatctgacgctttgatctaaaatgtaaatttggatccggtttcaattactaaaagtcaactttgagggtttacattcaatcacgaatattataagataaatatcgttcttttgttcgtatatttataaaagagagaaatggggactgaaaagtgtcatcaatcaataagtactttaaattagacgaactacatacaacgttccgtcgggaattattggcggggttcacaacgtttatttcaatggcctatattctattcgttaatccaagcgtcctcggcgctgcgggaatggataagggcgcggtctttactgcgaccgcccttgcgagtgcgttgggctgtatcttgatgggtgtcttagcccgttacccaatcgcaacggcaccggcactggggatcaacgccttctttgcctactccgttgtgattggcatgaaggtgccctggcaaacggcattggccggtgtctttgtggcctctgtcattttcttattgattaccgtttttaaacttcgtgaattaattattgatgcgattccgagtgacttgaagtatgccatttcaagtgggatcggtctgtttatcgctttcttgggcttgaacgatggtggcttgatcgtggcgaataagtcaacggtggtgggccttggctcattatcggtcggcacaacatggttaacgatttttggcttgattgttacggccattttgatggttcgaaaagttcccggtggcatctttattgggatggttttgacttcaattttaggattggtgactggtttgattcagatgccaagctcaattattgcttcagcaccaagtttgaaaccaacgtttgccgttggtattagccacatcggtgaaattaacaccgttcaaatgtgggtggtggtcctaaccttcttgctagtgacgttctttgacactgcgggaacattggtggggctggcccaacaggctggtttcatgaagaataacaagatgccccgtgtgggaaaagccttgatgtctgattcgacagccatgttggctggttcaatcttgggaacttcacctgtgggtgcctacgtggaatcatcagccggtatcgcggtgggtggtcgttcaggaattaccgccatctttacgggaattctatttatcttgggaatgttcttctcaccattgctgacagtcgtgacgacgcaggtaaccgcaccagcgttgatcattgttggggtattgatggcccaatcattgaagcacatcaactggagtgacatggaaattgcgattccttcgttcctgattgttttggggatgccactgacatatagtatttctgatgggttagcactgggggttatcgtctacccaatcaccatgattgcggctaaacgtggaaaagaagttcatccaatcatgtatctcttgttctttattttcatcgggttcatgtggattttaaatgttgaataattagcgcattgtgacaatatgcgtttaaaaaataaaaacgatactaattttgcctactggcggttagtatcgttttgacgtatagaggcctactggctgtcgtggactgcagtaactgagaactttgttccttcgaatgcggcgttgagccgctcctgagtcaaatcagtgccttcaatggtggcctgtccagcttgtaaatcgacagttgcggctgacacaccgtctaaatcaaggagggtatgggtaactttcattcgacaacgggcgcaccgcatgccggcaacggttgcaattttagtcatggtttcaccgcctctcacagttttgattattgtaccgcagaatccgaataaataaagccgtcattttttaggttgaattagcagtaaattcccagtcgtgagcgtataattgacaatcaaaaggaaccaaggaggatcaatatggcaattaatgaagcgttaattaaagatgatctatacgaagcggtgaatggcgactggattaaaaccgccaccatccccgatgataaaccggcaacggggggctttaacgacctcgtggatgaaattgatcaacagttgatgggggattttgacaccctgaaagagcatgcagagactgaatcagcaccgatgcaggaatttttaaagtattatcggttggcacttgattttgaccgtcgtgatcgggaacaaacaaccccgttgaaacaagtgttagcaccactgacggccatgacctcgtacgctgattttcagaaaaattgggcggattggctgatttcagggatgccgagtccactcgggtttgatattgatgccgacatgaagaatgcccaaatcaacgccctatttatcgctgcacccaagttgattttgccggataaaacctactatgccgagggaaatccacaggcagaccaactgctaaaattatttgcggccatgatgaagaagctcttattggcactggattatgatgagatcgcggcacaacggttgattgaccaagcgttagcgttcgatcggctattagtgccacacgttaagagtgccgaagaatcggcggattatagcaagatgtataatccacagacgtttgcagagtttaccgcccacagtcagcagttggacctcggcgcggtggttgaaagcctggtgggtgctcagccggagaaactcatcatcatggaaccgaaattcctcgatgcctttgacgacatcatgagtgatgagcactttgatgattttaagggctggatgatcgtcaagacggtttacgggttgagcagttacctgacggatgaactccgcattgtttctggcgaatacagtcgggccttgtctggcagtaaggctgccaagaagcggccaaagtttgcctattatctggcgatggggatgttcggtcaggtggttggtgactattatgggcgcaagtactttggggaaaccgcgaaggcggacgttcaccacatggttgaaaaaatgattagcgtttaccagcaccgactggctaacaatacgtggctcagccaggccacccgtgataaggcgattttaaagctgaataaactgggaattcaagtcggctatccggatgaccttgatccgttgtatcggaaattgcatgttgatccaacccagtcattgttggcaaacgccattagtctgacccgggtggcgaccgaagacatgttcagcaagtggaatcagccggtagatcgtaatcggtgggaaatgagcgcggccacggttaacgcgtactaccatccgttcaaaaacattatcgtattccccgctgctattttacaggcacccttctatagcctgaaacagagtagtagccagaattacggcggaattggggccgtaatcgcccatgaaatttcacacgcgtttgataacaacggtgcgttgtttgatgaatacgggaacttaaataactggtggacggatgaagactcacaacagttcaaacagttagccgcaaaaatgattggcgagtttgatgggttggagtttgccggtcaaaaggtgaatggtaaactaaccgtttcagaaaacattgccgatggtggtggcttgagctgtgcattagaggcggccaagtcggaagaagatgtcgatattcgggccttctttgttaactgggctacgatttggcggatgaaggctacgacccagtacatgcaattgctactgtcgattgacgtgcatgccccagcaaaattacgggccaacgtgcaggtacaaaacttagccgacttttataccacgtttgggattcagtctggtgattcgatgtatctggcgcctgaagatcgtgtgaatatttggtaggattttaaaatgtgggttgacgctttatccgagcggcaaaatacggtctagtaagagaccaactagtttcaagtaacacagggggaatcaacgtgacattttatgctgctagttattttacccatcaaaattttttcagtaagtatcttggatttggagtggcaattgcactggccgtgctcttagtttttttcttagtgcggtattttcaaaatcgaattacaactaagtatcgagatttgattctgattgttgcgttgttgattgtgtttattatcggtacacaaattggtaatcttgaacaggtcaaaatggtgaataatcaggcaacacaaatgaaacagtttattgaccgaatacgcgatgatcgcggagttaacaggcatcaggtggcagtgagttctaccagtctgaaggacggtatgcttgtgaaaatcaaacatcaggtataccgagtgcactttgatgattcgtacttaagctacgaattaacaaaggtcaatctgatgaatcacgatgtccagtatgttaagtaggtgagtaacgtgcaaatttattatgatgtgggtttaaaattggcattgggttttgtatgcctaattgctcagataaacttaacggggaaaggaaatttagcaccatcctcggctatggattccgtacaaaattttgttctaggtggcattattggcggtgccatgtttaatagtgatattacacttttccagttctttttgattctagttttgtggacattactggttttagttaccaagtatgcgaaagaacataatcgagtgattaaacgaatgatcgacgggcagccccaaacggtgattaaagatggcgaaattgcgctaaaaacggttcttcgtagcggtttgtcagcggccgatctaatgtttaaacttcggcaaaacggggtgtattcagtgaaagacgtcaagcgagcagtattagaacaaaatggacagcttacagtaaccgtgtttggtgatgatgccattaaattcccgttgattacagatggccagataaatcaagatgtgttgccgataattaatcatgatgaggcgtggttactggcgcaattgaaacaacagcgcgtggtactcaaggatgtttacctagccgagtaccgtgatgagcatgttgaaatctccgcctaccagttaccataattagatagactaaaaaaaaaaccagaattgcttgtatgtcggcaattctggtttttgtgtggcatcaaatttgatgtatttatttagtttctccattcccagcggttaaaaatggccggtacactggcatcaagacgtcagataggatgtggtcgaggcgtgaacgatctatcgttgtatcgtccgtcgcatagaaggcatccatgaggaccaatgctgggaggtcgtaaagggcctcgtcaaagtgcgtgagatcgacttcgccccgctcggaggcgtgttcgaaaaatgtccgcaccatttgactgataaagtttttacgcgcaaatttatcgaaataatcgcgcatcgagattccgcctaaccgttcacgcatgaggccaatgatattggcgtagtgcatgctggttagcagcgtgctaatccgattgaacaagtctcgtagatcgccttccaaagagccggtatccggagcttgactcatttttgcggctaggccagtcgtttgcgtgcgcaaagcggccagcacaatatcggccttcgagtcccaacgccggtaaaggacgcttttgtttgtatgggcgtgcttagcgatcatgtccatcgtgatcgcttcatattttgtttgttcgattaaattaagggttgaggcgagaatatcagcttccagttcttttccccggcggcggtgctgggtggtcgatgcgtttgatgcatcctgctgatcatgagggctatttgccatgaaatgacttcctttcggacgaagttgctactaagcagtatagcatgaaaattttttaagggggcggttgacaatcggcattaaaagatatagagtacttgagtacctaaaattagagactgaagttccttaaaaatagtctaactcattatcggaggtgtcacaatggcaactaacaaaaaaacagaaagtgcgttaccacgcgcgatcgttaatcaggcgtggatcatcgtgctgggtgcgattgcacccatgttggattcgacaatggtcaacattgccctcaacaaattatcttcagatttcaatgaatcattaagtaccgttcaatgggtggtcacgggctacttactggcaatggtcgtggcggtaccctttaccggctggctgaatgacaagattggtggtaaaaaggtcttcttgattgccgaagtgttgttcggcttgtcttcactggtggccgcgatgtctggcaatgtcaccatgctgattagtattcggtttgtgcaaggatttagtgctggtttgattacaccgttgttgacaacattgttagttgatgtggcgggagtcggatcgatggggcggatcatggccattgttggattacccatcatgctaggcccgatctttggccctgtgattgggggcgtgatcgtccagtatctatcatggcgctggatctttttcgtcaatgttcccgttgttatcatcgccacaattctcatttgggtgaagttaccggcaattgcccctaagaatccgaccgccaaatttgactggctgggagtaagcttactggctggcggttcggcagcgattgtctacggcattgttaaggctagctcaaaggccagttttaacaatagtacgacgttaagctatgtgggtgtgggaatcgccttgctggtgatttacgcgatttacgccattttccgtaagagtcaggcagtggtgccattatttctgttcaaacggcgcaactttaccggttcaatgattggactagttttggcggggattgtgaataacgggccaatgctgttactgccactgtttttccaaaatctacgtggtcaaagtgttgctgaagcgggattatcccttattccacaagggatcgggatgctgattgcccgaccaatcattggccgcttcattgatcgaattggggcgcggtgggttctaattgtcggcttgttagtgaccctaatcggaaccgtgccgttcatgtcctttgatcagcacactaatttctggttgctgatgggcgtcttatttgtccggggaatcggggccggagccatcatcagtccgctcatgaccgattcgtttgtcggccaagatcccaagtattctggccaaatttcgattgcggggcggattacacaaaatgtcggtggtgcgtttggttcagcattgatggcgacggttgcgtcggcgtatctcactagccacacgcatgaactgatgactaatcatttgaccgctgtggcgcacgcctaccaacagggatttatctgggcggtggcctgcactgccgtcgtgattatcccagcgttcttgctgactaacaagcttggtcaccagtccgacaagaaagttgtaccggcaccaacaactgaaaagtaaaagaaagtggtatgacaatttctgtcataccacttttttgaaatcagtaaaatgaaggtttatcgccctgcgtgccgggttgattaacacccagactttgccgagcatattgcccagtttgatcttgcagaatggcggtaatgagttgggccacggcttcgcggctaacctcggtgccaccaaatggctgaccactctgggtcgtttcgtaggctaactgatgttgatcgttgaagagccaggctagtcgtaggagggtgtagtccaacgatgattgggtgacgacggcggccgtctgctttcgtttcgcgatggaactagcgatcatcatagtgttccagtcgccaaacttaccggggacttcatcttcaatgccgagaactgttgcggcaattagggactgaacatggtgggcctccattgccctaacgaccgttgtcacggcagctaaatcgcgcatttcgtttagatagacggcatcgacgcctgtcaacgccggatcaagggtggcccgatcactaaaatcaccagtaatcacggtctcgcgttctggatcggtaaccgtgatgcgccggtctgcccgtcgagccagcaacttcaaatggtaatcagtttgtgtcagtaaggtttcggtgaggacggtcgcaatttgaccagcagcaccaagaattaaaacagttttcattttgaacgctccaatccaattattttgggatggttcgtgtccactataacgcaaatggcctgtaacgacacaaataacctattttagtagctggcgcaattcacgagttttacgaaaggaaactttgcaggtgctaccgtcgttgaagactaattgacgactggttcggttaaagctagccatgtgatcgaggttgacgagtgagcttttgtcacagcgaaagaaatggggatattcggtctcaatggcggagaggttaccgggaaaggtggcatgacaacggtcggcatataaaatgacagtgccaggttgttgtttgttggtgatgagcatcgtaatgtcgttcatcggcaccgagaagtattgatcgccaatttggtaccgaaagagacttgtgtggtgaaacagttcggcttcgtagacgtggtaggctagggaggtatcggtgatcaggcgttgtttgattatgcttccgccctcgtctttgagaatgtagtcgaacggggcgacccgccgtttgagggtgagaaaggataactcatcgtgggtcgtgataaagacaatttgtgcaaacgggaccgtctcgcgaattttgattgccagtttaagtcccgcctgaatatcggttccaatttccatatcgagcagaaataggccctgattaatatgagggagttgttgttcaaaatcggccacggtggtactggctgtgattatctgcatggcgtaatggttgatcataatggtattttcgacggtctgtttgtaaaattgaagttgaatgggatcgtcttctaagagtaaaacgggaaacaagttagtcctccttggtgatcacgagactcatttggagattatcgtgatcgagtgcggtattaaagtagaggttggggagctgatagacgagatcttgaacgttggctaggccaatgccatgatggccacccttggttgtggcaccgagtgtcaggagacactcaatgtctagatcagcactggccggattttcaacgatgatttcaatcgaatggggatggtcgatgaaagcacaagtgacatgctggtggctgtcggtggccgtgacgtgttcaattgcattatcgagcagaattccaagaatgcgaacgatgggaaccacatggttggggatcgtcaggtggtggcccatgacttcaatggtgagggtcacaccagcgttgcgtgcccgaaagtacttctggattaataggccgcgaacgggttcgttagtgatttggtcagcggccacaatcatctgggcattattttgttgggtgacaattgattgttgtcgtaactcttggtagtatgcacgcaactgctgggagtcatcgctattgatcatagtttctagcgacagtagtaaattattataatcgtgcttgaagcgtcgaaactcggtgtattgctgctcaatactcgtcatgtagtcttctagctgttgattttgatggctcatagcggtcgccttttggcgcgccgcgtaggcgcgcacaaaaattaccatttgatagacgataaggatggtgatcagtgagaacgtgacaatcagcacaccttggatgatggcggcaatggcgagtagttcgctgataatgaggacggtttcgagtgcaatgaagatccctaacgtcatgaaaaagatttgtttttcaacttgtagatcggtaatgagtgtcgtgagtcggttgagaaattgccagtagtggcgaacaagggtaactaagatgagcgttacgccgatttcagctaccgcaatgatgataatcaggggatgactgtactgcatggcagtatgaaggttgaaggagtgggtgcggataaggagaatcagacgactcagataggtggcgatgaagccaaaatcgatttggaccatgcacgcgataattaaggcggttaatggtatgtagttcacggtttcaaatcggtgactcactaagctaaatatgatggcaccggcaagtactagcagccaaatggtatcttgaatgtagagaccggcagcagcaatgccactagcaaggacgatgtctcgcaagagcacgaatccccgataatgacgatttaccaaacaatgacttaaccacagggttgtccacgcctgcacaaaaatgaccaatagggcctcagtccaatctacagataacaactaatcaccaacatgacacactcctcgaattaaaagtttttactatcaactaatataaagggtccgagaggcgatggcaatggtaacgaataatgggtcgtggtgaaattagattcgaagtatcgaataatcgtcaagataaccgatagttaaaacgcgtcaccacggaaaagtgacaccgttgttaaacgggactacgtatagattgaatacgaatataaagctcgctcagaaatcaaaatttttgtagaattgattattaacataccatttcattcatagaatcagctccttttttcttcattgtgccatataattcaaattgaaaatctaaaaaaatattaacgtccattagctgtcgattaacgtcaaacgttaattgatgaaaaatggacgttaatgattaatcaggatgtttgaagcacttggactatcggaaagtcatgtgctcatcaattcagataaagaaacggaagaagcaatcagtgaggagagataattaaattatgattaaactaaaaaaatgatgattccatgaggagtcaccatttttttgtttaatcatccacaacagtaaaccgttcgcgcggatgtgttggatgttcgatttcgtccagtacagcactggcgagattgccagtggtgactgtcgattgtccctcgctgttgaacatcacttggtccttgccaaggtggtaacttgtttttggcccgggaacaaagtcacgttggggtgaaattgccgtccagttgacgttatgaatccactggaggtattcatattcgtgagcttgttgtagtggtgtgtccacccaaggttcattggcggcagccttcaagattgatgcgagcagcgtggtgccatcggcctgtttcaaagaggccgcccctaggatgaagaagagacgtggttggggctggttgcgcgtcatggtgactaatttagcagcgaggtcgaggtgttgatagccatctccacgcgacgcaaatgcgttgatgacaacatctaaattctttaaatcatcccaagtcagtgcaaaaacgtcttttgccaaaatcgtggtggcggcactaaattgttgttcggctttggtacgattgcgaacgatcgcagttacctcatgaccacgagcctgtgcttcttgaacaagtgcgctaccagttcgaccggtagcaccaataatcccaattttcataatcgcggaccttcttttctaatttaatgggttgtcatgattgtatgctgttttgggaatttcgcaaaggaaaatgaattttcaaaagtaaaaggagcgtgattttaaatcacactccagaaatttagcttatttagcggtttttttaaatgaatcgtggttgaaaattaagtttaataccacggcggtgacgctaccaacgaccacaccattacttagcataatttgccattcgttggacatgtgttggaaaatttgagggtagacggttacgccaagtcccaaaccgatcgacatcgaagcgactagcaggttactgtttttactgaagtcgactttcttcaagatttgaaccccttgcacaccgaccatcccgaacatcacgatcatggccccacctagtacggcagagggaattgttgtggcaacggcagcgaattttggtaacaggcctaaaatgataaggaagaaagcagcgtagtaaactggtttgcgggtcttaaccccggatagcttcagcacgccgacgttttgtgagaaggttgagtatgggaaggtgttgaagacgcccccgagcatcgccgcaatcccttcagctcggtagccgcgcttcaaatcattggttcccactttttgaccggttacatcgctcaaagcgaagaatacaccggttgattcaatcatggtggtgagcgagactagaatcatggtaataatggaagatgtattaaaggttggtactccaaagtaaaataattggggcagatggaaccatgatgcttgtcccactggatctagtgagatgaggccaaaggcactggcgataaaggaaccggcaacaattccaattaaaatggcaatggattgaatgaagccctttgcgaaggcactgatgagcaaaatgatcacaatggtaatcccaccaacggcgaggttggagaagctcccgaacgactttgccgttaaatcaccgcccccaaggttttgaaagcctacgggaaccagggtgaaaccaatgatggtaatgagggatccggtaacaacgggaggaaagaggtttttaatgcgggcgaaaaggccggcgattaaaaagacgaagaacccagcacagataattgccccgtacatataggtaatcccaagggtacccccaattgattcgaggggggcaaccgcttgaacggcacatcctaatacgactggtaacccaatcccagtcaggggagttgttcgaagttgtaagagggtggcaattccacacatgaagatatcggcggaaaccaagtaggtcatctgagcggcgttaaagtgtaaggcccccccgatgagcaatggcaccaaaatatcaccagaatacatggcgagcaagtgttgaagtcctaggatggcggccttccagtttgaggtttccttggtcttggtatctttagcactaagagtaactgaagctttcaaaataatcctcctatgtgcaattgtctgtagtataaggatgcggaacaaggtgattattcctcagagtctgccttgtgcagtttaattggtcgaatgaaagagtagcgcgattcaagcaactaaaaaactctatctgcataggcaaatagagtcatcctcaatctgcttatagtccaaagtttacggctttgggtagaaacttaccgcccgtattgcggcattatataggcaactgcgttttaatttgtaactgaatattaacaccagaaaaatacgtaaacaagagaaagattcaaataaagggatgtaaacggtgacaaaattagaataaaatgaggataggaccaaacaaggtgttgcgagacgatttgcacaccgtgtgacgcccgcaaagattcggtgatcgaccgggccgtggggcctgatcgaacatcggttttcgtttcaacgaaaacaaggaggatgattgaatgacgatcagtgttgtgatggatgatattacagattgcaaggtagatgcaattgtgaacgcggccaataccacgttacttggtggtggcggtgtggatggtgcgattcacgcggcggcaggtccggaactgttggcagcatgcaaaaaattacatggctgtccgactggagaagctaaaatcaccaagggatatcaattaccagctaagtacgtgattcacactcccggaccaatttggcacgggggaacgcggcatgagaagatatttttacagaattcgtatcgtaacagcctgttgttagctgaaaaaaatgggtgtgaaacggtggcgtttccttcaatcagtaccggcgtttataattatccgattaaacaggctgcaccgttggccctcaacgaaatccatcagtttatggaaactgctaaggtcgtcaaagatgtcacgatggtgtgtttcgatgagcagacattcgctgcttaccaagctgcacttgctaatttagacggggagtaaactggcccacttgttggtagttggcgatggcggccatgacggatgacaagacgatgccgtatcgccgttcacgtggtgcgttgttggtatctagcaacgcccaaaaagtaccgcgggttgcaagtgcgatggcgcggtctaagggttcgcgatgaagcaaaaagccggttaagagggccgcaaaaacatccccactgccaaagaagtgacccgctaaaataggccggccgatgaattgaacgtgatggtggtcatcgagccagacgcatccttgttggtctgcgagggtgataccagtaatgatggcgtgaccgtccggctgaagttgtgcctggagggcatcaagaatcgggagtaatgactgaagggtgtccgtggctgtgacctgatggccagttaaaaattcggcttcggtcagattaggcacgatgaccgtcgcggcatggatgagctggcgcatgtggtctggataatcggctggtaggtcaggataaagtgctccttgatcacccatgacggggtcaatcacgaccagttgctcgttttgccgctgaataaattcagtcagctgatcgacaatttgattgcggcctaggtagccagttaagacaccatgagtttgaatttgttgggcttgccaatgagcgaaggtggctggcagccacgtggttaagtcggcactagcgggctggtcaaagccctcagtttgggttgaaagaagactcgtgggtaaaatagccagttgctgaccgaaggcggttagcagcgggacggcgacgcccatcgaaattgcgctcaccgccgaaagatcctgcgcaatgaggacgggggattgagctggtacagaaacgcgggtcatgcgagaacctccttagataattaagtgaaaactgcgattgaaagcgtagagattggaatgaggtggctgggaaaaaactcccagccatttttgtatctctgaattttaatagccgaaatcgggaaaaaaaggctgacttttccgcttagctacgaaaaccaaacgattcaaagtatgaatcattcggttttctaggctatgctcaaagtcagaccgcctttttttccactctcctcgttttgtgaatacgagttaatttaattgtataacgggtcgtcaagcacctaaattttgagggattttttgagccgcagtgcgattggcattccgataatcgcgccgacgaagccttgaagaaggttggttggaatcccgattagaccggttggcaccttatataggatgctatcggtaatgaagtagcccgcaaccatgattatgacccccgcaacgagggcgataatttgaagtttgcggcttttattataacctaaccacccaaagatgaggccctcgagcccgtgaacgatgagtgaaaagaacatgtattgcgcgtagccggaaattaagtccagtaagaatccggtcaaaccgcccacaatgagtccatctcgtttcccgtacaagaaggccgcaatgatgataccggcgtcacacaagttgatgttaccgtgagtcattggaattggaataataaagacgcgcgcgatgacgacggtgactgccacaagcattgccggaatgatgacgcgcttaacagaataactagatgccataattgtctccccatttctctctctagatcgtaactatactgaccattataaccgcaattagcaacgagtaaacgaataaaattagaattggattaaattattagaagtggggaccaccgtgagttatcaaaagcgccattttgacgacgatgatcccattttctttagcaattcagataaaagtttgtcaaattgtgaatggccctatccagtgggggagtaaatgtagtaggatgttagaggaattaacgggggaggaaagaaaaatgaacaaatatcgtttgcaagtcaccgtgtttgttttggtggcttttatgttgggatgtaatgaattcatggttgtgggggtcttgtcagacattgcccgccagttttcagtttcaatcgctacggtgggttacctcgtcaccgtctttgcaacggtatatgcggtcagcacgccatttatcacggtgtacaccagccaatacaaccgttttaaaacgctgatggtgcttatggcggttttcctaattggaaatacgttcagtggttttgccccgaattacctgtcactcatcgtttcacgggtgatcaccgcgtcggtatcgggggcgattatttccctgatcatgacgtttgcaagtacgattgccccacgcaataagcgggccggattagtctcatggatttactcgggcttcagcatcgcgtcggttattggggtgccaattggaaccaccattagtacaagctacggttggcgttacacctttatcatcatttcggtcgtgtcgatcatcacctatgcgctgctgttttggctactgccacacacggtaccacaggtcaaaagtacgatgatcaagcaattgaccctgatgaaggatagccggatttacgtcagtgtcgtgctcgtgttattatcagccgccaccctgtactcgtactatacttacattcggccgttattgaccgatagtctgggatttggtattcataacctgaactggctattgttcttgatcggtatcatgaacattgtgggtaatcagttgtccggtcggctggcggatcaccagggactcaaagcgatcccactgatctatatcagtgtggcgatcttactctttgttttcccatttacgttgacgctcaaatggcttggtttgatcattttgatggtgctgtcgacgatgaacacactcctgagcgcgccactgcaaattcactttttgtcggtggccgaacgggactacccacagtcgctggttcttgcctcgtcactcagttcgattttctttaactttggaatttcgctgggatcggccacggcttctgcctcggtcgacttcaccggtgtcggtaagttggcgtatatttcagcactgtatgcgttaggaacactggtgtttgcgctgttgcttaatttggtgattaaacgtcatacggcaaggaggacttctcatgaataaatttaggttgcaatcgattgtgttcgtattgaccgcctttatgctgggatgcaacgagtttatcatgatcgggattatttccgatatcgcacaccagtttaacgtgtcaattgcggtggtcggctacctagtgaccatctttgcgacggtctatgcgattagcacaccgttgatcacgatttttacgaaccggtttaaccggtttaaaacgttaatggtactgatgctggttttcctgattggtaatacggcgacggcactggcccccaactactttatgctggttgttgcgcggatggtaacggcggccgtggcgggatcgatcatttcgttgatcatgacctttgccagtagtgtcgcccctatggataaacgaccggcgctgatctcatggattttttctggtttcagcattgcctcggtctttggggtcccgattggcacggcgatcagtaccgcgtacgggtggcgcaacgcgtttttaattgtcagcgtgattagtgtgctcaccctcggattactattctggctactgccccggcaaattaagcaggtgaccagctcgttaggtaagcaattgtcactgatgaaggatccacgggtgtacgacggggtggtgctggtactgttcggcgccgctgcgatgtatgggtattacacctacattcggccgctcctgacgactgaactgggtttcagtttgtcctcactcaattggttactgtttttactgggcttgatgagtattttcagcaaccagctatctggtcaactggcctcacatggtgggctggtacacatgcctaaggtgtatattttggaaattgcattgctgtttatcctaccgtttacgttacatctggctattttcggcctcgtggtattacttgtgttgagcttgattacctcggtcctcaattcgccgattcaactgcacttcttaaacgtggcggagcaagattacccgcaatcgatcgtattggcgtcgtcgctgaactcgatcttcttcaattttggtatttcactggggtccgcgacatcgtcaacgatggtcgatgtggccggcgtgcacaatatcagttttggggcgggcgtctttgccttgattgcactcgtgatggtggtgctgctgaatcgagcaattaaacggcatcaacaggctagtcggagtcacgacgttgaattttaagttactaaaaaacatgaccagttacctgaaccggattaagttgcggtgggtgactggtcgtgttttttggtcatattggtgaaataaggtgatacccagccgattgcccgaatcaacctgttactggatcaaggagtgccgacaatgctgagcggatagatttctttgagcaaatgcacaagagcctcgattttgtggtgactgaacacgcaaaggtaaagccgtgatcacgaataagtgataaaaaagttcgaacaagtgaattaattgaattattgtacaagttattgtacaatggcgatgaaatcaattaatttttggagggatgcgtgatggatgcagtttcatacagtggttttcgcaaaaatctgaaaaactatatgcagcaagtcaatgaagacgctgaagcattgatggttacaagtcagagtacgcaagaagatattgtggtcatgagtaagcgtgattatgatgcgatgcaggaaaccctacgaattttgtcgaatcggccgttgatggaaaaaattcggcgaggcgaagaacaatatcatcacaatcagacccaccaacatccattgttagatgatgatggtgatccggatgattaaggcatggactgatgatgcatggaacgattatttatattggtatgagcagggcaatcgggcgacggtcaaaaaaattaatcggttaattaaagatattgatcgtcatccatttgaaggaattgggaaaccagaaccgctaaagcacgagctacagggaaaatggtcacgtcgaattacacaagaagatcgattaatttacgaaattgattcgcaagaagagactgtcgtgatatattcggccaaggatcattattgagaagatcataaaaggcgcctctttcacccagacagggagtgaaggaggcgcctcttaaatgagtgcttagattgatgaatgttgtaaaccgctagtgtgcttgctagtagtgcttagctttgcggcgtattcagtttcttccgcgatcaccttggcacggatcttcttgttgtaccatggtgaaacggtgaaggccaagacgtcgttgatcaagtaaacggaactgttgataaacatggctaacgtggccgaaccttgacggaatgagatgaaccagagaaccatttgggcgacaccggaggcaacccaccaaatgtattggttgttgaaccgcatgaagcaaatgacaccggctgttaagcagattgcaaagctgatagcatctacccaaggacgaggatcatcagtgaaggccccgattaggtaaccagaaacaacgtacacgatggcagttgagaccagtgcgatgacccatgttttaccagtaaacttccgaatctttgaggccatgttgacgttccagctggcacttaataagacagggatgtccaaggtaacaacgtatgccagttgttcaccaattgaaaggtagttcttagcagcgaatccggtaatgataaagcagatagctgacaaaattcctaaccaaccattgattgacttggcagcgttaatggcgagaacacataaaacacctaacgtggttccaataaatgttataatcgttaaaggtgtgatcttggtgctgaccaatgtcatgatttggcacccaagactaaagtagaataaatagtagttttgttgtggccaaccttttagttggtggcccaaaaatttgaaataattaaccataagtgcaactccctcaacgttattaaccacaatatatggtgtatgtagtggtttttgttttataatgacacaacatgttgtgcttactaattagcaacgttttctagtataacacgttatataaaaccttcaatgccaatatttttcaataatcattcgataaggccgatgagacgttgctacaataatgaatttaagggaataaaaaaatttcttattagcatattttggtaatattggtgattgtttactgatctactgaacaaaacatctgaaagcgttaactagatgattgctgtgcggattcgggtacggacacccccggatggtgataaagcaacgtgacaatggaggagaagaaaaggtgacagaaaaagaacagtactgcccaaattgtgggacgaagttaacggggtcccccaaattttgcccaaaatgtgggctgcaactgactcaaaaccaggacgatgcggtatccggggaatcggtggggacgacgaatcaggcaccaaccccgaaacgaccgcacaataaaaagaagcgcgtgatcatcgtgatcttacttgcgctggtcattatattagttattgtgggtgggtatctcattaagaagacggtttccgagactagtgtcgactcggaccagtcggcacagtctagccagtcggcgacgtatcagagttctcgttcacagcacagtagcgcctcaagtagcagtcagcaggaacaggatagtgccagcagtgactcaataactggcgacgatcagcttgttaaagcaacgatgacgccgaatcaaacagcggccgcaattgcggtttacgcggatcgggtcagcatttggccagccatcagtagtgacggcatggccagtcatttgaacgttgcgattgaaacgaacgatttcgatctttcatatgaaggacaggataacgtgcgctacgatgttcaagcaggtgacaatggcacctcgccaatgctgtgctatacgttgaagaacgggaccgttgcgctgtatacggtttacggggatgaagaaggtgaaatctcaccaatgagcacgaccaccctcacacaaattgtggactaccttaacagcgaaaacgaagcacagtcagtggaaaatctcgcgcaaaaagtagtgatcagtgatcaacgttagacggttacccgaataatcttaacgtcataacggtcatcgggagcgaccaccgttacggtctgaccgctggtgtggttaaccaagacccggcccaggggggaatcaaaggataatttttggtgttggatgtcagcttcctgtttaccaacgatcgtataagtttcttgaaagtgatcatcgagaaactcgatggtgacttgtttaccaatttcaatgatctgattatcacttggttgaacgatttgggcgtattggagttgcttattgagaaaccgtaaccggccctctagtcgacgaagatcccgtttggcggcactatactccgcgttttcagagaggtcaccaagtgcacgggcctcctgtagctgtttgattttggccggccgatcggccttcagagcttcgatttccgtttcgatttcttggtagccggtcgcggtcattttattaaaatagggttgcatcaaattacctcgaatttatagtggcggattaaccgccgttatttcacaggttgattataggccagaatgtgagtaatagaaaccatctgcgattgcggatggcttttttgagttgacaattgtaaaccacgggtgtagattagatttatcaattacatttgtaaacggaggtgcacgaatggaaacgacagaaacacagaccaaaattggtgaaattacaccatctgaatgggaattaatgcggattgtttggacgaagcaaacgatctatagtcgggaactaattgaattactgcaacaaaaacgggactggtccgaatccacgatcaagacgctgttacgccggttggtcaaaaagggattactcaccactgaaaaagaagatcgccggtttaaatacaccgcgttggtctccgaagcagacgcaatgaatgaaacgacacaacagctctttgaccatttatgtgcgatgaagcagggagccactttgtaccacctgattgaccacctcacactgagtcaggcagacattaagcaactacaacagttattagcaaccaaattaacgactgcgccagctcaggtggcctgcgactgtttaccggatgagtgtcactgtgattaacggaaagaaggctgaaaatggctgcacaacaatataaaattaccggaatggtgtgtgcgagctgcgcccagaccatcgagcgggccgtcagccagttacctggtgttaatgaagcaaacgtcaatttagcggccgaacgcatgcaagttcagtttagtgctcaagcattaagcccagcccaaattatccaagccgttgttcacgcgggatacgctgcggagctggcccaggaattgacgcaggaaagtgcgcaaaaagaacgccaagtcaagcaccacgcgctccagcaccagcgtaacgtggtggtgacaacactgattattgcagcggtgctcatgtacgtggcgatggcgggagacctacacttacccacgttaccatggctgaatcacatgcagtttccggtgacgacagcggtggtcgaactgctcttggtattgcccattttatggttgggacgcgattacctactcgctggcggcaaggccctggtcaggtggcatcccaacatggattcgttagtacttgtggggactgggaccgcatttgtggatagtttggttaatttaggcttcatgatggcgaccggtcggccacaagcactgtactttgaagcgagtgggatgattttagcgctgatcatgctcggtaagtacttcgaagcgttgtcgaaacaaaaaacgacggcgtcactgacgtcactactgacactaatcccccaaacggcgtcccaactcatgcccgatggttcggtacgtgaagtggcagtgaagacgctacaagttggcgaccgggtacttgtcaaatcgggtcagacaattccggtggacggtcaagtactgacgggccagacgacggtggacgaatcgatgttaaccggtgaaagcatgccgattacaaaactggctggtgaccccgtggtggggggcagcttgaataaaaacggacagattacgtatgaagcaacgcacgttgggagcgatacggcactagcccacattgttaaattggtgacggatgctcaggggtcgaaggccccgattgccaagctcgccgatcgcgtgtcgggcgtttttgtgccggtgatcatggcgattgcggtgcttggcgccctcgcgtggttactgagtggtcagtcattagccttctcgttaacgatctttgtatccgtactggtgatcgcatgtccctgtgcgttggggttggcgacaccaaccgccattatggtgggcactggtaagggtgcgcaaaatgggatcctatttaagaatagtacggcgctggaacagcttgctcaggtgaaaacggtagtgctcgataaaaccggtacgatcacgaagggcacaccagaggtcacgaccgttttgttgcaatccggtacgtcacaaaaacgggtcttgcaactggcggctagtttggagtattattcagatcatccgttggcaacggcggtgatcgaagccaacgaggcccaacgtgtaccggtggacgactttacgacacatcccggattaggggtgaccggtcaagtagatggccagttagtattggtgggcaatgcccagctgatggcgcaatcccaactcgatacaagtggcttagcagtcagtcaactcactgatcaaggcaatgcggtcatttacgtggcttacgcgcaacaagtgctgggtgtgattggcgtcatggatcccgttaaggatgatagccgacaggcggtggctcagttgcagcagcaaggtttaaaagtggtgatgttgacgggcgataacgcacagacggcacggaccattgcgcggcaggtcgggattactgacgtgattagtgatgttttaccagatggcaaggcccaggctattgcccagttgcaacaacagcaggcagtcgcgatggtgggggatggcattaatgatgcaccggctctcgtgcaggcccaagttggggttgcgattggcaatgggacggatgttgcggttgattgtgcggatgtgattttgatgaattcggatctgagctcgttggtaaccgcgcggcggctcagccaacgaacgatgaccaatattaaggaaaatctattttgggcctttttctacaatgtactgggcattcccgtggcacttggagtactgtatctttttggcggaccgctcctcaatccgatgattgcggcggctgcaatgggctttagctccgtgacggtggtgctcaacgcgttgcgattgaaccgattcaaagaaagaacaaacagaaaggatgaagttaagatgaaacaagtagcagttgaaggtatgatgtgcgatggttgtgcacaaacagtaacagagaaattaagtacggtggttagcgacgtcaacgttgatttggcggggaagcgtgccacgtttaatggggatgcgacgcttgaacagctcaacgcagccttggcagagacaccctattcagtgaaggctaactaatggtcgagacaattaatgtgaccgagctcgcagatttgttgcaccatgatatccagctgattgacgtgcgggaaccgtttgaattcaatgcggctcacatcgatggtgcggttaacctaccgctcggcgatgtggcacagtggcaaacgacgctcgatcgtgagacaacctactacgtcatttgccgttcgggccggcgctcacagatagcatgtgagcagttacgcgaggaccattttcaagccgtgaacgtcgccggcggcatgattgcatggcacgatcaaggtgttgatctacaccacgcttcctaatggcaaataatttaaaattaagcacataacaaaaccgttcctcatcatacgcaatccgttacgatatgatgagggacggttttgtttgtcattgtgaaagaaagggtaaaacacgtgaggccggtttggttttccgtgtccgcaagccggccagggttaatgatgggttatttgggttggtagtgaaatgacttgaattgagctttggcacggttatattgtcccatgtcgatggtatcgagggcaatgaagttccccgtgaagccgccagagagaaagtcaagggccacattgtctaaaacggtcacctgctgctcaccatcggtaaaggcgagtgtaccggttaagccgttgaccgtcacttgcagggtaatatcttggctatgaatggtaatggggtcggtgacaatctgaaaatcgcccttttgcgcctgtaagacggtgatacaacgccctaattgctcgtcatgggtaacggctaagaagaggtagttatcgatatcgaggtacagggccatcccagccagctgcatatacgtggtggggttaaatgcgacggttgtcgtggccgtgaagctaaaatcagtttgtcgtgttgcaaccaggtgctgatcaaactcggactgcagtgactgaccaccggcaatttcaagaccggtccctgtaaattgaagccagtcagcagtcggcatcttgcgaagcgtgttccaacgctcaaagttgagctcggggccaccaaaatcattatcaaaggcgtgttgaatcggtgtgacgggtgtgtcaactgggacttcgtagtagttcgccggttggttagtctggttactcaaacggagccaatcgtcagcggtccaagttacattctgaattgcagtttcacgtccaagcagcgtcacgtcatcgcgtagcggtcgggtggtcaaatgcgccatgtaccagttgtcatcgtcatcgtgcacgatgctggcgtgaccggaacattgaagggtcaatgttgggtcgtccttagacgtcaacattggggtttggggatccacttcataaggaccggtgatcactttggatcgggccacagtgacgcgatgaccggcttcggtgccgccttcggccgttagcagatagtagtagccgttatgccggtaaatttctggtgcttcggtcttttgggccgccgttccattaaatagaatttgaggggtgcccagtaaatcaagggtttgtgcgtcgagttcctgcatcaggatcccggctgatttattgtgcgtttttaaccggtagtcccagtattcgttgaggaagtaaacccgtccgtcgtcatcaaagaagattgagggatcaaaaccggaactgttgatgtacttgggcgtactccaagggccgttaatactatcagcggtgatgatgtagttattgacatccttgtagggaacccgggtgcttttcacgtcggtgtaaatgacgtagtacttgccgtcatgataggccgcgtagggtgcccagatggaacatccccgggtatttccggtgaggtcgatatcggtgagaattgatgtttcgtagcgccaattaactaaatcgtctgattgataaacccgaattccgggcatgaattcaaacgtggagacgagaatataataggaatcttttcctctaaacaagcatggatcggggttgaacccttggagcgttgggttagcaacttttaccatgaaatcactcttttcgtttacaaaatattgcattagttttcggaatctaattcctttgcgttgcgggcttggaggtcggcagaaatcttagcgtaggtttccttgtccaagttgtagaacttcattgagaagatcgcgatgaagtagatgatgattggtaagatggtagtggctatgacgataccgtgaatggcaccagcactttgatgttgagcagtggcaacgtaacccgtcatggagagtactaggccaggcaacatcccaccaagcgcgttcccacacttgaacacgaagccgataatggcataaatcataccacccatccgtttattggtcttccattcaccatattcaacggtttcaggaatgagtgcccacatgtaggcactgatcatcccattcccaacggaggcaattccccgagaaatgaagatgagggcgatccattctggccggcagaagaacaaaccagccatcccgatgatatcggcagaaacggacaaaatgatcaattggaacttcgatagctttttggcaagccatggaataaaggggatgaaggccagagcaggcagcgttccggcaagtgaataccatttaaccaagtcggcacggcccacatagtaggtcacgtagtagatcccagtagaactgacaacggatttaacaccgtagataacaaagaagaaaatacaaaggacaaccaatggccggttcacgtggaactggtggaagacgtctttaacagagatcttcaaatgcttggcgggggtcttcactcgttcgtgggtggtcccaaaacagatcagtaacaagacaccaccgattgtgcccataatgaccattgttaattgccatgcccgtgatagtcccacggatttagtcatggcatcggcgaggaatggtacgccgaaggcaacgataacttgaccaacgttggctaagaaagtccggaacgttgtcaaactaacagattcttgctggtcgtttgtcatggcggccgttaaggcaccataaggcacattgacgaaggtataacaaacggaaagtaagatgtaagtcgcgtaagcgtaaattaactttgtggcgccctgaaatgatggacttgagaaacaaagaatggctaacacggcaaacggaatggcaccgtacagtaggaacggccggtaacgaccgaacttggtgttagtgtgatcgatgatgaatcccatgattgggtccgagaatgcatcaacgaaacgaacaataagaaacattaacgctgcagctgcagcactaataccaaaaacattggtatagaaaaatagcagataactagagatacttgcatagaccaggttacaggccatatcaccgagcccaaacccgactttttcgccgactgagatttgaccaattgggcgaatcttcttagaactagcgtccatgtgacgactcctccttgtgagttgaaacaacatgattgatagaacaaacgacaaaagcgctttcaattattagcaaaaaaatatccccattgcaatggttaagagatatcaaaacaggttaacaagaaatgttaacgttaacatgtttttgacaatcacacagtaacatatcaaaaaataaaacacaagaacaagtttatgagttgatatagcgtattagtaagcgattacagtaatgacgctgttttgacgagctaagaaaataaattaaaatgttaacgttaacattttacgtaaaaacgtaaattggtgttgaaccggagtgcgatgaaacttactgttaaaaaaccaccctcaattgcgacaatgcaatcaagggtggttttgcttttttatcgtgattaagttggaaccttatccgttagttttgttgaccaattgattcacggatcactagtgctggcgtcatgaccatcgatagtcgttcttgatgaggattatcaatgattgaaattaaccgtttgataccggcactagccatttcttgaatcgggttattgatagtggtgagggaaggcgtgctcaagcgggcataggccacgttatcaaatcccatgatggaaatgtcatccgggaccttgacgccccgttcgtaacacgcccgcatggcgcctagcgccatgtcgtcattggcacagataacgcaggtggggcgggttgctgcggggagctgcaaaatctcggccatcaattttttaccagctgctggactgaagtctcccactttaacagcgtcgtcaacgagcaccaaatgattggcagcacagccgatttcaatgccccggcgccgcgcaatggtggcttcaaattcgggccgtccttcaataaaaccaattcgttggtggccctggtcggcaatataattgaccgcatccaagatggcccgctcgtcatcggggtagatgttatcaatttcgggattatccatttttcgcaagacgacgaccattggaatatggttcgttttcattttatagatgaactggttgtcggccgccgattgactgaccaccaaaattccgtcaaatcggtttttaaccttttgctcgatgttatcaattcgatcgatgccttcaacggataggaggtagttgtcgggaagggcatcatggatgttacttaaaatatcggacaaataggtagacatattggtgtgaatactagaaagaaagacgccaattacaaattttttgttagtgactagtccccgggcgctgatgttcggggcatagccaatgtcgttggcgattttaaatattttctgacgggtatcttccttaatgaccgccttcggattgaaggctcgtgaaacggtcgtcatggaaacccccgctaattttgctacttctctaatagtgaccacagttgaacctcccggccatgcgcggcgtcatggatttgtttatccctttaagtttatcatatttcatcagatccgcggtatcttaaggatgaaacgaaaattaacaaaaaagttacttagttaaaaaatagtaaaaaaagaaatgttaccggtcacattatgacgctaaaaaagcgcctaatatcgccgattgtaccggtttaccaaaaatgacagctcacttagcgtgttgctgattttactaaaaaatagccggtttgaatgccaaatagcgaaaaaaacaagttgacaaaagctggatatggtctacaatgtaaccgttaacaaaaataattcattgccaataaaccgaagcgcttcgtgtgacatattattcttgttaaatcgttggtttgttttggtgtttagagtttatattttttttgaacgaaatgttaccgtgtgcattttgtgaaaaaagggagtgaaaaaaattatgagtgacaatccaagtacagggcatcatcgcgaaccgtcactggctcaaaagatgaccgattctaactatagcaaacagattccggtaagccaaaagatcgcttatgggtttggtgactttggtaacggcttcatgtttgacttaggacaagcatacttgactaagttctggaccgatgctgctggtatcggcgccggtgtcgttgctgggatctttgctttcacaaagatttttgatgcatttatggatccaattgctggatcattaattgataaccggaaaaatatcggtaaacaaggtaagttccgtccggttatgatgctctcagctattattttaggaattatgaccgttgtaacctttaccatgccgatgggcttatccagcggcggccgaatcatttacgcatatgctgcatacatgatttggggcttagtttattcatttaccaatgatccttacgggtcacttgcttcggttatgtcacgtaacccgcaagatcgtagtttcatggcgacatcccgtcaaattggttccgttggggctcaattcatcgccggtgttgcatttattcctctgatggaattgcttggtggtggtatgggttctgcaaacgaacgccatggttacttctgggcagctgcaatctttgccgccgttggtgttttgatgttcttcgtttgtttcttaggaacaaaggaaaacgttaagattgaccgtacaaaggcaagcaagagtgcttctggtagtgccgcaaaagactacttaaaggttgtctttacgaacggtcctctgtttaccattatcttgatgacattgtttacgatttcagcaatgaacaccaacaacacaatgatggtttacttcgcgcaatacaacttaggtaacattaactatcaaccattggttaactcaatcatgatgggtgtttcgatcattgcgatcttctcaatcccattcttgacaaaactcttcggtaagaagaagaccacggttgtctgcttggtcattagtggacttgcaagtcttttgaactttgtaatgcctactaacccaacgacgtttattgttctggttacaattggttatgctgcaatgtgtattcctaatgggattacatgggccttcgtttctgacgttattgactacggggaatggcatactggaatgcgtaaagaagcaattacgtatgctgccttcaacttctcacgtaagatcgcgcaatcattagctgctatcgtcagtgctggtattcttgccatcactggttatgttgcaaatgctcaccaaacttcaagcactttgcttggtatcaagggtgcgatgacgctttatcctggcgcatgtatgattattgccgctatcgttatcggattactttacaagttgaacgacgaacacttcgaaagaattgcgactgacttggatgccggcaagtgggaaaaaggaaccatcggtgatcaagacaaaaaataatcgtaagtaacgattaaaaaaatttatggaggtaatttaatgagtacaagtaagtatattgatgacgcacaagagattttagccgcaaatggtgattattctaacctgagcgacaaggatgtatacgttccatcaattcaagttgaccgtacaaatgtttacttcatttcacatgctaatgacgacaagcatttggttgtttatgaaacaggaagcaccactggtgacttcgatgctgttgaatcagcagaagttggcgaaggaactggcaagaagttgctggttacggaattaactaaggttaacaacgatgcgttgagcaaacgcttcccatggttaaagccaatttcacgtcacggctacaagtacacattcggtcttggtgatcgtttaggcaacgcctcaaacgcccatctccgtttattcaagggccgtggaatcttccctatcttgggccaacaatcaattcgtgaattactattgacagaccgcactgaattagatgttgtgcaatcagctgcttgggccatcttcgaagaaggctggactgaaggctggggcgccgatggtgaccacgttaaggaaccttacgaagttgaatatgccgttgaaagtggctgcacgatgatcactttggatgcaacgaagaagattcacaacgaaatcgctgatctttctgatgaagaattggatgctaagttcaatgctttggatgatgactatgtgaagtactttaccgacacataccttgacaagacctttgatcttggcgacggtgccgaagtacacttcacgaagaaggatatggaacaatcagtattaatcttcttcgatgccgttctctatggcgaatatatctatcaccgcttcatcgaaccaaacagtttggactttgaaatctcaatggacgaaaccattgtgccaacaacgccagctaaccactacttcttcggtaacgaattgaatgttcgtggtattactccagaaacattggcacctaagttctatggtgaattccaaaaagccattgactacattggtgacttggaccgcttcgaacgtgaatacaagattcaccaagctatttctaagcactttggctaccgtgtaagtattcactcaggttctgacaagctgtcagtatacccaatcgtgcacaagttggacgacggtactggctggcacgttaagacggccgggactaactggctcgaagcaatgcgtgtgatcgctaaggttgatcctgaattgatgaaggaaatgtactcatatgcctacaacaaccttcaggatgttaaaccattctacgtcttcactgctgacaaggacaactcacctaagccagaaaccatcaccgatgataacgtaatgtcattgttaactgatgacaacccacgtcaaatcattcacacgatgtatgggaacctgttgacataccaagaaagcttccgttatgtcttccgtgatcgtttcttcgatactttgaagaagcaccaagatcaatacgatgactacttgaaccgtcacatcgcagaacacattgacttattacaaggcaagtctgcatctcgtgatgaagtacgggctaagtacgaaccaaaataagggtaacgtttagttactaatcggataagtcggtcattcctatcggattggcaggcttatcgtcatttgaaagtgagttctaacattttgttataactcagtaccaagtatcgccaaaaatttaagggagtgtgtatttcatggcattactagatgataactttttgctcaaaaatgacatggccgttaaactgtttaacgactacgcaaaggatatgccaatcattgactttcactgtcatttaaacccagaggaaatttatgagaacaagaactatccaaatatcacacggatttggattaacgaagatcattatggtgatcactacaagtggcgcttaatgcgggcaaatggtgttccagaagaattaatcactggcgacggcgacgaatatgagaagtttcttgcttgggctggaacgattgaaaaggctgctgggaacccattatatgaatggacacaccttgaattacggcggttctttggtatcaacgaaactttcaacacccaaactgcacctgcaatctgggaaaaggcaaacgccgaattggcaaccgacgccttcaaaccacgcaatttaatcaagaattctaatgttaaagcggtctgcacgaccgatgatccagcttccgacttgaagtatcacaaattactcaaggcagaagaaaaggaaaatggcttccgtgtcttaccagcaatgcgtccagacggtttgatccaaatcttcaaaccaaactacggcgaatacctggaaacgttaggcaaggcagccggtgtggaaatcaccgacttcaagagcatgatgaaagctgttcaccaacgttttgaatacttcaatgaaatgggtggccgtctctcagatcactcactgtggacctaccactttatcgaagcaggcgaagatgaaatcaacgcgatcatgcaaaaaggaatcaagaacgaaccattgacggacgacgaacaagacaagtacttgacggccttgcttgaagaactcatgaagtacaataaggaatttgattggaccatgcagttccacgttaactcagttcgtgacttgaaccgcccaatgtacgatcaattaggtgctgataccggctacgatgctgttgggacacaaccagatatcgcattgcacatccaaaagctttacacgaagatgcgcaacaccgaagacatccccaagagtatcttctactcactgaacccgaacgactggatggaattagccacaatgatgggctgcttcctcgaaggcggcgttcaacgaatgcaattaggtgccggctggtggtttaacgatactgccgaaggcatgcacgaacaactacgggtcttcgctcaagaaagcttattaccaaactttgttgggatgttgaccgactcacggagcttcttgtcatacccacgtcacgaatacttccgtcgcgtgttatgtaacttctacggtgaattagcagaagcgggtcgtgtgccagatgacgaagagtaccttggcaagatggtgcaagatatttcttacaacaacgcctacaacttctttggcttcttcaacgatgccactccagaagaattatttggcaaataagatcgcacaatcggatgtgcgctaatgacgtgttgttcaggataagtcagtttgaaaattggtcatgttgcttgggattgagcgttaaatttgattaacctgaagatggtcgttaacgacatctagtttaagaggctgtgactttgttgcagcctcttttgcttacataaaattggcaaataactattaaaacgccttcatttaaactataatttaagttaattaattctatgaacgggtaagggagttgactaaaatcgcctcaagtaagaaagatgccactattcgcaccatcgccaatattgccggtgtatcacatacgacggtatcgcgggcgctgaatgatagtccagcagtcaaaatggcaactaaatttaagattaaaaaaatcgccgagcaactcggctatgtgccaaatatcaacgccaaggggcttgcgagtcagcgaacgtacttaatcggggtgtttttcacgagtttggatgtcgggacttctgatagtttcttgtccgatgtcgtgcacgaaattaacaacaacctcccctcggaatattcgatttcgattaacagtatgcaggatggtgatcggtcgtcggccgtccaaaaatttgacggtgcgttggtggtgagccaagcgaagtccgatgaccgagccatcaatgaaatttttaagcgcaacttgccgatggtggtcttgaaccgccccattgatcgccgggatgtgccgaacattatcgtggatgagtacgtggggtcaaaggcgattacggattacgagattcggttggggcataaagacttcggtctgattcgtggtgaaaaacaatttgcttcgagtcacgagcgggagcgtggcttccgcgacgcactggccgaacatgggttaacggtgaatccgatgttcattgctgatgggaactacctccccaagagtggttacgcggcgatgcgcgaaattctgtcgagtagcttacacccgacttgtgtcttttgttcaaacgatgaaatggcgattggggcgattcgggcttgctcggatctgggatatcgtgtgccggaagatatttcgatttcggggtatgatgatacgcggtattctaaatatctattaccggcgttgacgacggttaataagcctaccgagttaatcgcgcgcaaaggcattaagctgctgaccaagatgctcaaaggtgagttacccgtgcgctcaaaggtccgcgatgcggtagagcccatcccgattattcgtaactcggtcgtggatttacgaaataaataggcggtgtcgcaatgaactgagtgattgagcttagtttgcgttggggatcccgttgaagtacgtgatcgggtatcataacagaaaaaagtgaggcggtcgaccaccatgcaagaaatgaattacgaacaaaatcagcaccatgcgacggctttttttgcgtcggcacactatcataaattatccgctaaccagcagacgcatgcggtcgcgattattgaacggtttaatcagttcatgcaacaagatgagcaccgtgatgatcagcactggacggcgaagagtgtgaaagccgtcatgctaggggagtttgcgactgatccagacgtggttgatcgtaaatttcaagtggccgtggtgccggttttaaaggcgtaccaagaatttttacagccgaataatttggcggtgatcatacggacactggatgaaaatcggtcgaccatgcaggatgcattacggcgggcgattgtggcatatcacctgaatgacttgaaccagcagcgcgatgaattggaacagctcgtcgctgatcatgaacgcaagaacgtgatcacgcgatttaagattaaattgcaaatggaattgcaatttcggagcgagtttaaacgtattgatgccgaccaagaggccaagatgacgattgtggacgcgttcgtggatgcgatggcactgcgatttcaacaggaaccccagcagtggagcaatccgggtgtcagtgttgtactgacggggatgttgccgttagatatgcggttgctaccggaagacgcagcggtgattgtaccggtcattcggtgtttggtgaactacttatccgctaccgaccagattacggtgaagcacgcagcgcagttgctggcgatgattagtgacgtacggccgagcgtggattacatggcctcattagacaacattgatcggcatgccgcgacgctggcacgaatgatggccgataagaagggtgattttcacgacatgacgagcatgatggattttgtgacgcaaaatcaagatgaagttttaacgtacatgacgtggatgcaaccctggctagatgacgaacaagaagaacttagtgccgaagacgttatttttggaatcgatgacgatgacgaggatgatatcgaactgaccgcagatgagctggatcaattgaagcagcaaaatcaggaaacggtcctagagttgctacatcagtttaagcagtcggcgcagtaccgagaattgactgctggtgatcagaaaatggtacagtcgatcgtcacttccgtggctgactggatgatcgacgcggccgaagaaattctcgacgattggtcaccgacccccatgtttgatgtattaacgtactatattccaaccaagacgactgccacggtcgattactttacccatgtcatccccgttatgcggcaatttgtgacctatgccattgatgcggatgcgatctttcttggggatcaggtgcttgaagcggtcaatgaggcggcggatcagattgtctcaaactcgcaagataagcaacagtggggttttgcgaaacaattagggatgcagctgatggaggctggcattgatccgagtgatgagcaggctgtgcagcaattcataacacaatacaacgaaaatctgaagcatcccgcatcagcagcaccagcggggaaaaaacaaccccggaaggtgattccgtttagtcagaaaaaacggggtaaaaagaagaaaaagaaacgttaaataaacagagattgagaaaagaacctaactttctcaatctctgtttttggatttgatttcaacgcctgagatataagatgatccctcctaatacgatgaggcccccgacgagttgccaaaaagtaacgacttcaccaaggaggggaatcgcgagcagggtggccccaaccggctctcccagcatactcatggaaatgacggtggtattgacgtatttcaggaggtagttgtaaatcacatgggcggccgtggggaagatggcgaggagccagaaaatatgccagtcgtgccccgaatagccaccgatcggggtctgagtgactaggttgaacaggttgagcgtgaccccggcaatgaggaagacgctgaagctatacgtccaaaacgaaatctccttcacgtggtgctggccgatgagcatgtagcttaccagcgcaatgatacataaaaatgacagaaggtcgccgagcaatgtggtcagatgatgctgaccaaaatcgccccatgccacaaaggcaatgccgaggatggagatgccgatggcaaggagaccgtgaatgttcgtggtttcatggtagatcaagtagccgccaagaagggcaaccaagggttggagggcggtaatgatcatggaactggcgaccgtggtgagtttcagtgattcgaaccagagcgcgaagtgggttgccaaaagaattccggctaaaacgaggtagccccattctttaaggctgagtttggcccactgatgacggtgaatccaagccatcggcgcaagtaacacgcaggctaagtacatccggtacatactgatgatggtggccggcgcatgggaccatttgacgaaaatggccgcaaaggaagaagccagcatggcgatgataagtaagctaatggttttacgcttcatgtaggacactcctctaatagttatattctattataataaattcttgcggaaagttaaggcccaaattgacgcaaccttagtttgagggctgctgatgagtagtgactgatgacgtgttagcagaaggcgatatttaagaaagttggattaccgaaaccagaaatgaaaaatgcgaacgttatccaataaatgacgagtaaattggcaattttggaagcttgaatccgctatcttaatcagattaatgggaggatgttccgatattacgacgtaaacgggtttaccgaaatccaaacattcacgatcttttttgtagatattgttaagaaaatgctttaattctgaaagctaatgctttaacatgttatgaggaattaaaaaaatcgtgaggatgtggaagaattgaaagcaactcgttatccgctggaaagcattgcaccaaagcaccggcacatgaattactgggatatgtttgcgacgtgggttggcgcgaacgccaacaacgggacctggtttattggtggtgtgattgctgcgtgtggcctctggggcggggttaaagcactcattgttggctcagccgttgcctatgtttttttggcattagtgggcctgattggttacaaaactggggtaacgacgacgggactctcccgggcggccttcgggattcgcggtagcgtgggtccatcggttgtcaacctgattcagtttatcgggtggacggccgtgaacacgtttattgcagccacatcaatttcttatttatgtaacagtctgtttggttggcctgtatatggcaagccgtgtgggaactggagtttattgtttgggatcgtcatcatgagtgtactgcacttgattagtgtgatggccggacaacgctccgtgcagttgatcgaacgaatcggcatgattttggtttttgcctttgtggtctgggaaacgatcgttgtgttccgacagacttcgtttcacgaaattagtaactgggtggtccccgttaaacaacggatgtcatttggctcagccctcgactcattagccgcctttaacttagcgtgggtgactgctggcgcggactttacccgattcacaaacaagaagtccgtggctaccacggcgcctttttggggcgctttgatcggggtactatggtttgcctttgtcgggctatttgcgacgatcagcattgcgattacctcaggcgtgtatgacgccaacaactctgatccaagtaccattgcggccaaactcggtttgggggcgctggccatggtcgtcattattttgacgagtatgacggcgaacgcggttaacctgcaagctgccggctccgccttgaacaacatgatgcccaaggttagtttgaaagtggcactctggattgtaacggtggtggccacgtttgtgaccatgattccaatggtggtcgggagcttccttgacacctttaccgccttcttggatgttttggggatgattttgggaccttggatgagcattatgtgtgtagacttctttattttgcatcatggacactactcgatggcagacttaaccaacgccgatgggcccttctggtatcgaatgggaatcaactggtgggcctttctgtgctgggcactgggtgtggtcttctaccttggtttgcaaaaaattacctggtttgaccaaacggtgggggctgcttacccagtaatgctcatcgtggccgtgatttattatggtatcatgaagataagcatgtggcgcaaagccgcctagtgtcgtgatcagttagttggggacaacggatagtattcaggaggggaaccatgttaatcaaaaacgtgcatattgaatcaaatgatcaggtgcaagatatccgcattgaagatggtcgctttgtggccattgaggagacgattgatgcccgtgatggcgaacgagtcatcgatggtgctggcaaattgttgctaccgccactgattgattcccatgttcatttggacgccacgcgtaccgcgggccaaccagaatggaacgaaacggggactttatttgacggcattcgaatttggagtgaacgacgcaagacgctgacaaaggcggacgtcaagcaacgggccaaggctaccattcgggaacaagtcgcaaatggtattcaaattgtacgcagccatgtggacgtaacggacccgaatttaacggcgctagaagccctactagaggtgcgcgacgaagtcaaagatgtggttgatttacaattggtggccttcccgcagtccggtattttgtcgtttccccatggcaaggaactgatggagcaggcggttaaaatgggggtagatgtcattggtggcattccccactacgaatttacccgggattacggggtggattccctcaagttcatcgtcggcttggcggaaaagtatgatcgcttaattgacgtgcattgtgatgagattgacgatccgaactctcgtaacctggaagttttggcaacgttggcgtacgaaaccggattgggcgatcatgtgactgcgagtcacacaacggcgatgggatcgtatgacgatgcctactgttacaaactattccggttgttacaaatggcgaacgtcaactttgtctgcaatccggaggtgaaccttcatttgggaggccggtttgatacctatcccaaacgacggagtatgacacggattaaggaactttccgaagccggaattaacgtttcatttggtgaagatgacattaaggatccttggtatcccatgggaaatggcaatatgttggatcaggttcaaattgggattttggctggtcagttgatgggctacacgcagattcaaaatgcgtaccagttcgtaacgaacaacgccgccaagacgctgcacattagcgatcactatggaattgcggttggaaaaccagctaactgtattttgctgaaccaaacgaatttctatgatgcgctaaatgagcatgctgaagtgctgtactcgattcgtcaggggcgagtcctcgttgaaacacaaccaaaacaagttaaattaaacttttaatcaaaaaaacaatcagcgcgtcaaatttttgactgctgattgttttttactatattaaagtccgaggatgcgtgcgaccgacggtacaacaagatcgacgacgaccccgatgatcacgacggcaatcgatgccatcgatccctgcacggagcctagttccagtgctttggcagagccaatggtgtggccggccgtccctaaaccaagaccagccccgatttcagattggttaaggtgaaagattttgatcagccaatcgcccagtgcgtaaatgatgacggcattgagaatcaccgccatggccgtgattgaagcattgccaccaatcgcggttgaaattggaagcgcgatggcggttgtggctgcttggggaagcatggccgcgatggaagtccgatcaaggcccaaccccttagcgacgtagtaaatcaggaataacgagataatggaaccgatgatgagggagaggagaatttcaaaccagtatttcttgacgatatcgttacgtttatatagtggaatggcaaaggcaatcgttgccggcgttagaaaccagaagacaatatcgccacccggcttatagtatttggtgtacacctcaatggtcgaagtgtgcaggaggtgaccgatgatcacgagcacgataatacctaggaccattccgacgaataggggttgaaagaggaagaagccctgaccaactttaaataaccattggccaattaggaaaacggctagtgataaaaagatcccgaataagggttgtgagagtgcttcagtcattattagaaacctcctttttgaatggcgagtggtgtttgaacgtggttgattgatggtctgaccgtgatgattgcaatttattgtggagtaaaattaagaaacgcgccgtataagcggtaatgaccagcatgagaacggtggaaatgataatgacgataataatttgaatacctgattttgccatggtatcgaggctagtagccagtgaaatccctgatgggacgaataagaatccgatcatactgatgagaaaactaccaaaattatcgacccattccagcttcacaatgtggcaagtgagtagcagatatagcaggatcaacccaatcacgggagtgggaaccggaaagctagccggaaataagggtgaaattaaactagaaacaaacaggacggcggcgaaaatccccatttgaacgagaatgggggccgactttgattggcttgaatcagtttgtttttgagtcataagaattcctcctatcaaaatagcgatctttactttattgtaagtaaaaatcgctatttgtgatgcttttcacggctaaataacccagtttacggttgaacaaccctcagcgggggatgaacaaccccgttacatgcctaaggccgttttcatggcggcaacgtaggcccgaccaaccggaattttatcgccgttgaccatggttaattcgtaggtgtgattgaagctcggttccgtctgaaacacctgatctaaattaacgatgtagcttctgtgaacctgcataaaccggtgagggtccagctgattttgtagatggacgagtgtttggcgtgtttggtatcgggcgctggttgtttgaataatcaaggcgccctgttccacaaaggcatagatgatatcggtcttattaatgatgtttgttttatcctcgctagtgatggaaatccggggattatgatcctgaaaattagggactttttgctgcgtggagaggcccttttggatggcttcatcaacccgactttgttcaaagggtttcaagatgtagtcgagggcgttagcgttaaacgcatcgagggcatattgatcgtacgcggtcgcaaaaatgatgcgggggcgggcagaaatatccttcagtcgtttggctaaggtaaacccgttatcggctcccaactgaatatccaaaaatactaggtctacctgttgattcatcaactgacgttgcgccgtggcgacatcggcggcttcaaaaatttgactaacgtgttggttttgttctagtaggtagcgtaactcttctctcgcaagcggttcatcgtcaacaattaaaatttgcattaggcatgctcctttaagggaatataggtggtcacagtggtgccgtgaggcgttgactgaaactgaaggtgactagattgtccgtagaggcccgtcaaccgttggttcaggttttgtaacgcggtgccactgccgtgggtcgaggcgatcggttgttttcccagttgttgaatgagggcgggattaatcccgctgccgttgtccgcgacttcaatttttaattgttgggctgcttgggtcacactaattctaatttgattgccactcgcttttccgataaaggcgtgtttaatcgcgttttcgacgagaacctgaatcgtaaagggtggcagcatgacatgctcgttagtttgaaaatcaaacttaatttggtatttatctgggaaccgggtctgctcaagggtcaaataggcattcacgtgagcttgttcctgtgccaaggtgatttcggtttcgcgcacgccaactaaattggatcgaaagtaggtgcttaattgaattaataagctccgtgctttttcggtatcgtgacggatagttgccgaaatcgtgttaatggcgttgaagaaaaagtgggggttaatttgagcttgaagggatttaatttccgcatctttgacgagtttcgactggttttctgcggcccccagcgcaatttggctcgaaaagatggacgctaatccacgcgcgagttgttcctcgaccggcgttagacgggcagcatcggtggagtacattttaagtgtgccaaccacctgctggttaacatctaacggaatgacaatcgcggcctccagcggacagtcgggatgggaacagccgatctctgctttgctgtgggcgatccggatttcgttatgttgaatggcttctgaggataagcgggtcacaatggcggctcccgcaacgtggtggtcgctaccggcgccaacgtgggctaaaatttccgtggtcgtcgtcaaactaatcgccgaaaaattcgtgtattccttgatgattttagccacacttgccgcggattgtgggtttagcccagcgcgaaaataaggtaacgtgcggtcggcaagttccagcacatcatgcgtttggacggcccgcatttcctgttcttgggttaaaaataggtcaataattgatagaaaaataaaggtgcctaacgcgttaatggtgatcatcgggatcgcaatgaatttgaccaactgccatccagtaggactgaacagtaaaatgaacagcatttggatgacttccatcgcaaagcccacgacgattccttgcgtgggactcatgagcatcattggctgcggcttcgaagcgcggcggtggtaaaagataccggcgaggcccccgatgatggcggaactcggaatataaaaccacgctgccaagcccccctgaattacccggtgaaggccagcgatgagaccgacaaccgcacctaccgaggggccaccaatgataccagaaacggtcacggcaagcaggcgggtgttggcaattgaattttcgtcaggcaggttaagtaaaattcccgttgaaactaagtgattttggctatcaatttcgataccggtgatgttagaaataatagcgaagaaagcaaaaatgataattaaattgattttattggaaatggtccgttgtgcgaatagtagttgccgaaacggtcgcacgttgacgaggagaaaggccaaaataatgacaattccgactcgttcaagcatgagtagcgataaatttagcatttgcatgaagcgcctcctgattaagactatcttatcaaaaaatcagaagttgtgacatcgcgcggcttaccaaagatcgtaaacgctgtacaccagtaggagtgcgacgcagccgttaagtaaccggtagtgggcctgataaaagcgttgaattaattggccagccagggtccaagttaaggtaccgagaatgccgattaaaatcatcagtgcaaatttagaggggaggctcccccagacaccggtaatcatgaaggtgctcatccccgtaacaaagtacaggtagcacttaatgttagtggtttgcagaagcgcgcccgtcaaaaaggggtgatcgccagccgaggcgttttctcccggcttagagatggcaacgtggtaagccagatataggaggtaggccgatccgatgagcttgagcattaaaatgacgagcggatagtgctgaaaaagcgatgagaacacggaaataatgcccccgataacgaggagcccgactaaaataccaaaattaaagacgagtccgcgacgaaagcccttcgtctgcccctccgtcattgccatgatggtattgggaccgggagtaaacgacataactgtgacaaacgttaaaaatccaaccatatgtagtaaccttctcttcttttaattgcatatgcaatgatatgtattattcgctattctagcatgctataattgcaattgcaatgaaaggagtccaattatgtttgatattattcggcgcatcggggccattacccgtctcattcagattgaatcgaaccagtattttaaggaccaacgattgaataataacctattcatctacattattcgggtggtggaacagccgggaatgtttttgggagaactggctgatagcatgcaaattgatcggacaactagctttcgcacggttaagaagctggccgaaatggggtatttgcggttggcaaatgatcaggataaccttaaaattaagcgggtatatccgacaaagcgtggtgaacggatttatccagaattgcatgcgtttgagcaacgaaagtcggatcaattgttagcggatttatcgccagctgaacgggaacagctgaaccagttgctcaataaactaaaggtgtagggagacacatttgtgacaactaaacaaaagggattactatgcgcgattttaggaccggtgttttggggtgtttcggggaacgtggccgagtacctctttacgctgccagatattacaccgcactggttggtgggcatgcggctcattggttcggggctgttactcctagtctggtgcctgctaactcagcggcgggagatgatgagcgtctggcaccagccaaagatgatcggccagctgctcgcgtttgggttgctgggcgtgctagtatcccaatatacatatttttcggcggttaaaacgagtaatgcccctaccgccacgattattcagtattcggggcccatattaatcattatttacctagcgctgcggcatcatcagttgccccggcgggtggatgtgatttcgattgtgcttgcggtggtgggaacatacttgcttgtaacgcaggggcattggaattcattggctatttcgccggccggggtctggtggggccttggggccggcgtgggagcggctctgtacacgttgctcccccgtgagcttttgaaacattataatgctcgaattgtgaccggctgggccatgctgtttgcgggcgttttaatgttcccaacgacactatttcagccctggcccaagctcacgatggtggtgctgctggggaccttgtttgtgacggtgtttggaacgatgggggcctatttgctgtatattcaaagtttgaaatatttggcgccgacgacggttgggatgctcggggttttcgagccgctcacggccacgtttgtgtcgatcttagtgtttggaacgcggtttggcgttgccgaaattatcggtgcgacactggtgttgatgaccacgttcttgcagacgctgccagctaaaaagcgcctgaaacatccggtaccacataatccgaacgtgaaactctaagttcaattgtgttcgttccctgaatacgctatcataaagttagaaatgagggatgacgatgagcgatatgttagtaacaactacggaaaagattccggggcaagagtacgagattatcggggaagtttttggattgacgacccagtcgaaaaacattgttcgtaacattggtgccggactcaaaaatattgtcggtggtgaaatcaaagattacacacagatgatggtggaggcccgcgacgtggcgattgaccggttgagaacgaacgcggccgcgatgggtgcggatgcggttgtgatgatgcgctttgattcgggatcgattagtgcagatatgcaatcagttgccgcatatgggacggcagtgaaatttaagtagtggcgtgaaaaagtgagaccgagtctcttgcggcctgctaaaacgagtgcgtgaatgcgcaaaagaaaaaacaatgtatttgaaccagtaataatcattgctggtaaaaatgcattgttttttttaatttatcacttagaataagagcaaagaatgctcaagtaggaggaccacggatggtaaaaaaagacggacacacgcatacccaattttgtccccatggtagtggggataacgcgcaacagatgattgagaaggccattaaaatgggctttactgagtatagcatcacggaacacgcaccgttgccaccggcatttaagcgcgtttttgagggagaactagaggggttggtcacggcgtcactgacggcagatcaggtggttccctacttggaatttgcccaacggatgcaggcgaagtatgcgcagcaaattaaagttaacgtcgggtttgaggtggattacttacccggttttgaggactggacgaccgactttttgaaccggtacggatcgcgcactcaggataatatcttatccgtccattttatgcctgggacgcatgataagttttggtgcgttgactacaccacggcggacttcgccaagggctttgcggctgatttacaccaaccacaaactttgtttcaccactttttgcagttggagtaccaagccgtgacggctgaccttggcgcctataaaccgcagcgcatggggcatttgactctcattcggaagtatcaggattggtttaacctcccgcgtcagtttaactcagcgaataagcagttaatgttgcggattctaaaggaaattcgcgatcggcattatcaaattgatctgaatacggccggcctgtacaaggaatattgtaatgaggtttacccagatcggtggatcattaagctggcacaggaaatgcaaattccgctggtgtttggttcggatgcgcatagtattcaagaagtgggccacggctatcatcagattgaacggtgggtcgcgccaacgagtcatgaatgagagattctcatatagcacggcacaattatgagaaaataaccgcaaatttcacatttaagtgcttgacaagcgttaaaatacgagtagtatgttagataaattaaatcaagattaaaaaacaatgaaaagttttgattagtctagtagacacggatcaccgcgaacagggagttttggtcatcgattggaagccaaagcagcgccccgtagtcgaactcacagctatgaaccgatcgaagttgttactatgatccggtgcgaccgttaccagcgttgacagtttttgccaacatgagccagtcatcgtaagatggttggaaaatgaggtgggaccgcgattttatcgtcctcgtaacagaattaagtttctgttgcgaggatttttttgtttttttattgacgaggaggaaatgaacatgatgcgtaaccagttgcccagcggggttcgagatgagcttggagcttcagcccagattaaggaacaaattgttgccaccattcagcgttactttgctaaacggggatttgaaaaagtaattacaccggttgttgagtaccaagatgtatttgaggactacgacgtcggccagaaaaagttgttcaagtttttagccgccgatggcaatatggtcgtgttacgaccggatttgacgttgccgttggcgcgggtgattagctcaaccaatattaagctccccgctaagttttactataccggcgatatttttcggattaaccgcgcgttgtccggatcacaagacgaaatgacccaggccggtgccgaattaatcgggtttgatagcgtgaaggcggaacaagaatgtctcgtgatgatgatgcagttgagtgatcgattggccctgaccggtgtgcaactggaactgggaattgcgcgatttgcgaagttaattctcgaatcgctggttgctgatgaacgtcaagtccatcaaatcgaggatgcgctcttccaaaagcaggtgacgcaatacaatcagttgattgccccgtttgaagaagcagcgttgtacccactgcttcgaatttggccccggttgtttgggccggcggcgacggttctcgaaacggtcagtcagtttaccttcccagcggttattcaacgagaactggatgaactacgacagattgttgcatggttggccgataagtttggggagcaggatgttcagatcgatctgagtgccaaggcgccccaggactactacacggggattacgtttcaggcgtacagcgatcattcatccagttacctgttcagtggtggccgctacgatcatttactagctcactttcaagagaccaacgtcgcggcgatcgggctgggcatcgatattgaacggctagttgaaattaagcaggcgacggcacccacgcaaccaatgacgtacatctactttgatgatcaacagtgggcgctggccgagcagaaattaatgacactggatcgtgcgcaactgtgtttggctgatagccgcgagcaagcgcagcagattgccgatgcccacgagggtcggttgttagatttaacgaaggaggcatcaatatgacagaccgcattaaaattgccctgaccaagggccgggtggagaaacaaaccattccgctcatggaagcagccggctttaatatggcgccggtaagggacaaacagcgaaaactgatttttgatcttccagacgatccgtacaccgttatcttggcaaaggggccggatgtgtcgacctacctgtcacaaggggccgttgatatcggcattgtcggtagcgatattttaaccgaacaacaaagtcaggcatacgagttattggatttggggatcggcaagtgtcaattcgtattggcatcgaccgccgatttcgaccccaaagcctccaaacggaaggtgatcggtaccaaatatcccttgattacccagcggtattttgctgaacggggagaagatgtcgaggtcgtcaaaattgaaggctccgtcgaactggcacccctgatcgggatggccgatgccatcgtcgatattaccgaaacggggaccacgcttcgtgaaaatcggttgcagatatacgaccgcttacaacccgtttcgacccggatcgttgtcaaccccatgtcgttaaagcagcatcggaaggccatttttgatcttgttgaccgtctcaatgctgtgattacccaacccgaaaacgtctaactaaagaaaggatctaccatgatgaaaattattactgataccctcgaaaaccaattacaacaagtgagtcaacgaacggccggcttgaccgatcctgagattgaacaacgggttcgtgccattatcgaaaacgtccaaaaaaatggtgatgatgccgtccgcgattatgaaaagcaatttgaccaagtcgacttaacccagtttcgcttagatgatgccactatcgatgccgcctacgaaaatctcgatcccgacctcaaggaagccctcgaagtggcgaaggccaatattacgagctttcacaagaaagaaattgagtacggctttgtagatgccgaaaagcccggtgtgattcgggggcaaaaggtgattccgttagcaacggtcggattatacgttcccggtggcacggcagcctatccatctagtgtgttgatgaatgccgttcccgcgaagttggcgggggttaatcgcttagtaatggtgacaccaccgcaaaaagatgggattaacccagctgtgttagccgcggcgaagattgccggggtcgacgatgtctttcagttaggcggcgcccaagcaattgcggcattagcctacggaactcagagtgtgccccgcgtcgacaagattttaggccccggtaacatttacgtggcaacggcgaaaaagatggtctttggacaggtcgccattgatatgattgccggtccatctgaaattgggattattgccgacgaaagcgcgaaacccaagcagattgcggcggacctcctgtcgcaggcggaacatgataaacgggcgcggccgattctggtcacgaatagcgaacagttggcgcaagccgtttctgtcgaagttgagacgcagcttcagacattaccacgagaagaaattgctcggaccgcagtggaagaacagggctttattgccgtactaccaacgattgatgatctctttaccctgatgaacgcgatcgcgccagaacatttggaagttcagttgcccaatcccacggactatttgagtcaaatcaaaaatgcgggttccgtcttcctaggtcaatacgcctctgaaccactgggagattacgtggctggtcccaatcacattttacccacctcaggcacggcccgtttctcatcaccagtcggggtttacgattttgttaagcggacccagtttatccaatacaccggcgcggcccttgcacaagaggcgcaatacgtgacgaagctcgcccgggttgagggacttgaaggacacgcacgcgccattgaagcacgggaggaaaactaaaatgagaacagcaagtgtgacacgtgaaacgaaggaaacccaaattaccattgaattaaacctagatgatcagtttgaaagccaaatcgacaccggtatcggctttttagatcacatgttaaccctgtttgccaagcacggccgatttgggcttaaggtccaagcaaccggtgatttgaacgttgatccgcaccacaccacggaagacgtgggcattacgttaggcgaatgcttcagagaggctctgggcaataaggttggcattgaacggtacgggagcgccctggttccaatggatgagacgttaggccgcatcgttgtggatttgagtggtcggccgtatctggtcttcaaggccgaattggaaaatccgcggctgggaacctttgaaacggagacggtcgaggacttttttcaaggctttgccttcacggcattaatgaatttgcacgccgaaattttatacggccgcaacacgcaccacaagatcgaatgcctctttaaggcgttgggacgggcaatgcgggcggctgtcacaattaatccagccattcaaggtgtgaactcgacgaaaggggttatctaatgattgccgtcattgactacgacacgggaaatatccgtaacttaattaaggccctcgattacgtggggctggagagtcagttgaccgctgatccggccgaaattttggccgcggatgggctcatcttaccgggagtcggggcatttgcgaaggcaatggaggcccttaatcagcgaaatctgatcccggttatccagcaggcggttcgtcgccagattccattgctggggatctgtttagggatgcaactcctgtttgaacgcagtgaagagtttggggatcatgccgggctcggcctacttcccggccgtatcaaggcgattcccgcgacggccgagttgaaggtgccagaaatggggtggaaccaaaaccgcgtgttcgataaagcaagccagtttgcccagtcggcgacggggcagtacacctactttgtgcattcctattacgccgactgtccccaagcaattatcacggccggcgtggactacggggtgctgattcccagtattgtgcaacaagataacgttgtggggatgcagtttcatcccgagaagagtgcaacggtgggtttgaatttactgacagatttcaaaaggatggtgcaaacgtatgtggattcccgcaattgatttatctaacggacaaagtgtccgtctttatcagggcgattttgatcaaaaaacactcattaacgctgatccattgacgcaggcacaggcgatcgaacaagccggcttaaccgccctgcacctcgtggacctagacggcgccaaggccggtaatccacaaaatttggcggtgattaagcagttggtcgcccaaacaaacttggcgattgagctggggggcggtattcgatctcttgagcagattcgccagtttttggaattggggatttcacgggtgattatcggatcggccgcaatcaaacagccagaaatggtacaacaggctgtcgctgaatttggggctgctaaagttgtcgtcggggtggatggccgccacgagatggttgccacccatggttggctcgatacggccacggtttcgatggccgagctgattgatcagatggttggatacggtgtccggtacttcatcgtgaccgatattgaccgtgatggcacgatgcaggggcccaacgtggcactgttagtgaaactgcaacagcaattttctaccgctgaaatcattgcttccggcgggattcggagcattgcggacttgcaggatctcaggacccacgggattcagagtgcggtgattggtaaggcgctggctgctggtggcatgaccctagctgagttaaaggcggtgaattaatgttagcaaaacgaattattccatgcttggacgtggatgatggtcgtgtaaaaaaaggcgttaatttcgtggacctgaaagacgttggcgatcccgccgaaattgcggcgaaataccagcaacagggtgccgatgaactcgtatttttagatattacggccactaatgagcagcggcaaacgatggccgacgttatcgaacaggtctcatcacaagttttcatgcccctcacggtgggtggtgggatccgcagcgtagccgatatgcaaaaaatgttacgggcgggcgccgataaggtatcgctcaattccgcggcggtacaccatccggagctgattcacgatggtgccgagaagtttggcagtcagtgcattgtggtggcgattgatacaaaatggaatgctgcgacccaccagtttgacgtggtgatcaatggtggccgccagaatacggggctgaacgcgattgactgggttgagcgcgtgcaacagctgggtgccggagaattattaattacgagtatggatgccgatggcaccaagcaggggtttgacgtgcggttgtaccaggcaattgatcaggttgcgacggtgccggtcattgcttcgggaggctgtggtcaggtaagcgattttagcgaaattttccgggatacccaagttgacgcagcgttagccgcctccgttttccactatggtgagctgacaattagtgaggttaagcagcacttagcagatgcgggggtgaccgtacgatgattcaaccacggtttgatgcccaaacgggactcatgcccgccatcattgtggataatacgaccaatgaagtcttgatgttggcctacatgaaccaagctagttttgataaaacgattgaaacacacaccacgtggttttggtcccgctcacgccagaccctttggaacaagggggagagttcgggccatacccaacgggtggtcgaaattaaaattgattgtgatttagataccgtggtgatcaaggtcgataagcagggcccggcgtgccacactaatcacgaaagctgtttcttcagaacgattgacgatccagacgaaacggtctactaaccgtaacacggccaagtaatacaacaggagggggtccaccaatgaaaaaaagtattagtcagttaaagccatatgtacccgaagaacccttagatgaactaaaaaagcggctgcaattgaaacgggttgtccgattatcagccaatgaaaacccgtatggcacgtcgccgcggattgcgacgatgcttcaaaccaccgcgtttgaaagcaatcgctatcccgatggggcggcggcccagctacgagacgcagtcagtgatttttacgacgttaatccagcgcaattagtgtttggctgtggactggacgaaattattagtcttttgaatcgaacttttttgaccgacggcgacgaagtgctggtcaacgtgcccaccttctccgaatatatgatcaacgccgagattgaagaggcggttcccgtcgaagttccaaccaaggatgatgggcagatcgattttgcgtccctactggcggcgattaccgataaaaccaagatgatttggttgtgtaatccgaataacccgacgggaacgtatgaaacaaaggctgacattaaacggtttgttcgtgaagtgcccgccgatgtcttggtcattgttgacgaggcctatctggaatacgttaccgatgaggccaatccatccgtcttggatttgcccggacagcaagataacgtcatcgtgctcaagacgttttcgaaagtttatggcttagccaattttcgggtgggattcggtatttttccgcttcggttggcgagctacattcaatcggttcggccgccttacaatttaaattctatttcacagacggcggcgctcacaggactgcgagatcaggactttgtgactgcgacggtcgccaagacggtggctgagcgggagaagtgggaagcctttttccgccaaaacgggattcagttctaccacagtcagactaatttcttgttcttcacggttcccgaagcagatcgggtcagcgactttctgttacaaaatggttttctcattcgtaacggattgcgtccgggatggcttcggctaacgattggagaacccgcggataatctacgaattcagcagttattgttacagtgtttaaactgaataaaataaatgaggctgggaaaaactcccagcctcttcctgtctccgaactttaatagccaaaatcggggaaaaaaggctgacttctccgcttagctacgaaagccaaacgattcaaagcacgaatcattcggctttctaggctgccactgcaacttatcgctttagcgattttagttgcgtggacaacggagtatgctcgaagtcaaaacgcctttttgcccactctcattatttacattttctgccagtctaacgaccacagcagacccatcgttttttctcccgtatgaacgctgatgacggggccgagatggctgatatcgacggggatgttaggaaactggtggtgcacggctgcgacccattgttcactaccggccggatcattggcgtcgatgacggtggcgcgtaatggatagttagtctgcgctgcggcggtggtcaaatgagtcataattttgctaaacgcccgcttgacggtccgttccttaccggcgacgataatctgtccctgagcgttgaaggttaataatggcttgatacgtaataggttaccaataatggcggaactatttgaaatacgaccagtccggagcagatgattgagatcgtcaaccatgaaaaagacgtcggtggaatcgcggagccgttggagcaagggaataatcgcctctgccgacatgcccttggcaaccagacggccggcgagcagggccatgttggcctcaccagcgctggcaattttggagtcaaacgcgtagacgggaattcgggtgtattctcggataaacatttgaaggttatcaaagaaaccggtaatgcccgacgagaggtgaattgagatgatttcatcgaagccagcgtcagcaagacgatcgtacgtggctttcatctggcccattgtgatttgcgcagttgtgggcaacaccttttcggtcctgagcttttcaaaaaaggtcggtgaatcgatctccacgttttctaggtaggggtggtcattaaaaatgacggtaatgggaactaccgtgatctgatattgggcgaccaatgccggatcaatatatgcggcactatcggtcacaattgctgttttcattgggactcctttcgtgtcacgaaattgtacgctccattatacgcgccgaaatcgcaaacgcaataataacgccatatgatcaacaaaagttgttataatggtgattagtgagtttaaggaggaaattagcatgagtgtggaagtaccagaaaacttagaagaagtggccatgcgcgtggccttactaaaaaaccgcggtcgtgaaaccacggaaaaagaagtgattaaccaagcggttcttgatgcactacaaatttttgtggatcaggaattggatggtcattatgatacggtcaagtatgacggggttcagctggtgatttttgatttaatgggtgaagaaattagtcgcctagatcctgaacaggctgattttgagcaggattttcgcacaaacgcggacaaaacaatgttgcgattagaagatctggctcatcgggtcgttggctcacggtagtatggggctcgggaaacactaattttaacaaaaagtaagtgttttgcgatgagtttttagagcaaacatggtattatctttacgtacgcgttgtttgcaaaattggcaacgccattataggaggaagtatcatgcacaagtggttaaaaacaattgggattatcacaatggggctcgcagtggcattggtgctcaccgcgtgtgggaaaacctctagcaacaaggcccaactaaaaacttctggcacactcaccgtgggactggaagggacgtttgcaccctattcataccgggaaaatggtaaattaacgggtttcgaagtggaacttgctagagatattgccaaaaaagaaaatttgaaagttaaattcgtgccaaccaagtgggattcactgattgcgggagttggcgacaagaagtttgatgtcgttctcaacaacgtgacggtgacgaagcaacggcaaaagaagtacgccttctcaacaccgtacatttattcacgtgaagtattggtcacaaagaaggacaacacgtcaatcaagtcaattgatgatatcaagggtaaggaaattgcggttgggactgggactaataacgagaccgtcgccgaaaagtttggggctaagattgtgccaaacagtgaattttcatcaacgttatcattaattaaacagggtcgagcagaaggaaccttgaactctcgtgaagcctacctggcctacttgaaggataatccgtcggctaagaatgactttaagtacatgctcgtacctgacagcaaggttgaaccagctaaggtggccgttttgatggccaaggataaccctggtttgaagaagaagatcaataaagcgctcaaggaacttcgagatgatggcacgttgaagaaactgtcagagaagtactttacggatgacattacacaaaaataatgggtaatctgtaacgtttcatgcaattaagcctgtccagactatgatcgtgacttgatggttatagcttgggcaggcttgtgcgtttcattgttattattgaaatatagaagggaaaccaatatgtgggatatcattgttagttcgactcccgaaattgtttgggccgggattaagtacaccattccgctggccgttatttcgtttattattggatttattattgccgtcttcacggcgattgtcagaatcaccacgccgaagggtaatccggttgtgctgtttttctggcgacttttaaagtggtttttgaatttttacgtgtggttgtttcggtccacaccacttttggtccagttgttcattattttcttcgggttacccaatgccggcattcagtttaatgcgtttacggcggggatcattaccttctcgctgaatacgggggcgtactgctcggaaaccattcggggtgcgatttcatcgattccggatagtcagtgggaagcggcctattcgatcgggatgacgcaccgccaagttttgttccggatcatctttccgcaagcgttgcgggttgcactcccaccgctgtcgaattcgttcattggcttggttaaggatacttcactggccagttcaattacgatcttggaaatgttcatggtgagccagcagattacggccaaaaattacgagccgttactgatgtattccatcgtggccgccgtgtacgccgtattctgtaccgtattgaccattttgcaacactatctagaaaagcggatgtcacggtacgttcaggttacgggggaataaacaatgattaaactagaacatgtggataaacaatatcgggatcatcacgccttaaatgacattaatctcacgtttgaagccaatcaaacaacggttattttaggaccttcgggggcgggaaagtcaacgctcctacgatcattgaacctcctcgaacggccgcaaagtggtcattaccaaattggtgacgagcaggttgattttagtcaagaaattccgaccaagttggtgctgaaggtgcggcggatgacggggatggtgttccaaagctggaacctcttcccccatctgacgatcatgcaaaacattaccgaaggcccgattcacgttttaaatcagagtaaggcgcaggccgagcaaaaggcgttggaattactcgaagaagtgggacttgcggataccaaagaccgttatcctagtcagttatcgggtggtcagcaacaacggatttcaatttgccgggcattggcgatggatccggaatatattttgtttgacgaaccaacgagtgcactggatccagaattagaggcgcaagtcttgcgggtcctgctaaagctcgcccagcagcaacagtcgatgatcgttgtcacccataacattgagtttgctcgacgggtggcggataaaatcgtttttttagaggacggtaaaattgaatttgaaggtacggtggatgaattcttcaaccatccaacacaaagaattcacgaatttttgaccggcatggaattttaacgggcgccgtttcgtggcccattaggacatcaatcgtaagaagtaatttcaaaatgactgatcgtgtgaacacgataaaataggaccgatcttgcgcctcggaggcacagatcgatcctatttttttgctagtcattcagttggcggagaccgttttgaacggcgcctaaaatgatctgaagggccccatattgttgctgtcgttggggattgttttgagcactgtacttttggtctaggttagtcatcagcttggcgtagtggtccgcatcggcatctatcattgcgatggcggtggtgattaacattgccaaaatgggcacttgtgccttgggctgattgctaaagtagacgtaggtttcgatgttatcgtaaaactgagtcacggtgtgtggtgcaaatggtgcttgagacatagtggtcaactactttctaattgtaagtagccacattgtaccgtcttctcgggagaagcgcaaaataaaccacttacgctagcgccagtcactgagcggttcggcgttttaaaaaataaaaagccgagcccatttggcccagcttcatcaaatttacaatcgtttggaaattttgtattctttcggatgcttttcatgatccttgggaagggcatcgttggcgtagaaaatagcgtattcttcgtcatcgtgccccttcgcaacgacgagttcatcggccgatttttcccgtttatagatttgacctttacgaacggcctcgttgtaatcatgaatattggcgatggaatcaccgggattaaagaaaatacgatctgccatgataatcagctcctttagttatgcacgacttacaatatcgatactggtttgttcaatgatgtgaccggcactggcatgataaaaggcgttgagccagtagccgtcggttaagtccaacttggtatccagtgcgtagacggttagcgtgtatgtgtgatcttgatctggtggtgtcggccccgtgtaatggcgggtaacggcgggattagtgctacccacgagactccccgcgttactgttatttccctgaatcatctcaaatgaatgctggcgactggcgtctgccggaaatgtagtgatgtgggggtcaatattggcggcggtccagtgaatccacgtgaacccacaaactggaatcgaatcatgatcgatcaaggtcaatgcgagtgatcgagttgaggttgggacgtcacgaatggaaaagggaaacgaaacaacaggatgcccatcggtttgatcaacgcgatcagcatacttaccataccgatcggccagttgcccgttggtagttggaacttgaatttgcatggcataacctccttagccaaattaaattgaggcgttgataaaacgcttgcgattaactttattataaccgttttgggggacgatcggccagtaatcgaccatttagtgcttgacttttaaatggtcacgagatattctactgttaatttaatattcgtccacataaaaccaatgaggtggagatcaaggtagccgtgcccgtacagagagttgacgatgctgagagttcaatcgaacgcagactactaaatggaccaccgagggagcagtgaaaggcgtgcgtcatgcacgaccgagtattctgttacgtcagacacgcgtcagttgtcaggaatgtgtttgcatttcgaaatggagagtagaagattttgtgtcgtcccacatcaaaaagtaccccagtaagtcaaacgggggctaactgaatggtctgggagacccgtcttctaaaataaggtggcaccgcggaagaatccgtccttatagcaaattaaatttgttatgtggacggattttttgattcccaaaaattgatgaaaaggggtaataccgatgcaaccatctcaagcaacgctccaaaactaccaaaatgactttcaatacgtccccgtcaagatcgaggccgaaattccagattttgacgtctatcaaattaccgattatctggatcaatactacgatacctgcacccaattgacgatcaataatcatgatcaacaaaaatacacctacttggtcattaatccaagtcaggaaattattgtggaagaagaccaggtactggtcaatggcaaacgccaagaacaggatgcgcatcattacattaagcaactgttggagacgcatcggaccccgaagatcaaggggatgccaccgtttagtggcgggttgattggctatttcgcctatgaatatatcaagacggcggtgactaagttgcagaaattgagacggcttccagatcaccagccactagcccggctcttactggcggataccgttattgcctacgatcacgaacggcaaatctgtgaactaatcaaggtgatcggcactgatgatttaactgccaattatgagcaggccgaaaaacaactcacggttctcaagaacatgttgactcaaattccccaccacgacttacaaaattttaacttactgactgattttcagccacggtttacgctctcgcagtacagtcagggggtagaagaaattcgtcgggaaatcgagcagggtgaggtcttccaactcatctactcgaacccgcaacacgcgcggttaacgggtaatttaattcgtgttgcccagcgactagcccgcgataatccgtccccctacgagttttactttcatcagggagactatcaggcggcagtcgcctcaccggaaacgttggtgcgccgcgaagatgacaagctattaacctacccactggccggcacccgtcgccgggggaagacggataaggaagacgtggccttcgaaaaggagctaacgactagtaccaaggaattgtcggagcataatatgctggtcgatctgggccgcaatgatctcggacaggtcagtaaaattgggacggttaaggtgacgagtcacgcccatattttacgattttcacaggtcatgcatttaggttccacggttgaatcagaagccatcgagcagctcacggccatcgatttattagacgcagtctttccggctggcaccctgtctggggcaccgaaagtccacgccatcgagctgatttaccaacacgagcgcattacccgggggctttacgggggctgtttcggctactttgacttcaatggtgatgtggacatggccattggtattcggctcgtgtacacgcaaaaagaccaggcgacgattcattcgggagccggaatcgttgcggatagtaacgacaagcacgaatttcaggagtgttttaacaaggcacgggcagtgaatttggcgattgtcaaagcagaggaggggtaacggcatgaaggttttgattgataactatgatagttttacgtataacctataccagcaaatcggggcgtttgatcctgaaattatcgtggtcaaaaacgatgagattacgcttgacgaccttaaggcaatgcatccgagccatttgatcctatctcccggacctggtcgtccggaagattcgggcattagtttggccgccgcacgctattttgccaaccggattcccatgttgggtgtctgtatggggttggaagttatttgcgaggcgttgggcggtcagttgaaattggcgaagacgttgatgcatggtaagtccggccaagtcaccctggatacgaccgatcccctgttccgcaactgcccaaccgaggccatggtggcacgctatcactcactagtttgtgacggcgattcactgccgggaattttcaacgtgccggcttactcagcggatggtgacatcatggcgctcacgattccatccatgcagatttacgggatgcaatttcatcctgaatcggtaatgaccgaaccgggcatcggggatcaaatgattcaaaattttttacaggcgtccattgcaagcggcgcaacgaactaagaatgagaaaagtaaaaaaatgaaaagaaaatgttgacaaagttctcataatgttttaatgtttatagcaacttaatattcgtccacaaaaaaccaatgaggtggagatcaagatagccgtgcccgcacagagagttgacgttgctgagagttcaatcgaacgcagactattaaatggaccaccgagggttttcccgaaaggcagtacgctgtcgagtacggaaaaacgtcgcggcatacgtcagttgccagaaatgtgtttgcatttcgtaatggagagtagagggtcataacgttaagttttcaagtgctgctaagttcatcgtttatttttatcaaatggcgaatggatttggatgccggatgacaggttacgctaaccctctaaaataaggtggcaccgcggaaataaaatccgtccttataacaaatctaattttgttatgtggacggatttttttgttgattgaatttaaggaggcaaacgcgatgcttatcaaaaaaacagccaaacgatggtgttttcccgtttaattaattgtcactcagccaactcaaactagaaacggggaaattaaccatgatcgaaacagcaattaaaaaagtcgccaacaacgaaaacctaacctttaacgaagccgaaagcgtgatggatgaaatcatgaacggcaaaacgaatgacattcaaatttcatcttacttgaccgccttgagcatgaaaaaagaaaccgtcgctgaaattgccgggagtgctaaagcaatgcgtgatcatgccttaccattcaacgccggtgaagaagtacttgaaattgtcggcactggtggtgaccacgccaacaccttcaacatctcctcaacgtcggcgattgtggttgcggccgctggtgttccagttgccaagcatggtaaccgagctgcgtcatcgaagagcggcgcggccgatgtcttggaatcgttaggaattaatatcaacctagcgccagaccaaagtgaacaactgttgcaacaagttgggtttagcttcatgtttgcacaggagtatcaccaagcaatgcgctttgtaatgccaacccgcaaaacgctcggcattcgaaccgtctttaacattttagggccgctcaccaatcccgcccatgcatcgcgtcagttgctcggggtttacgatgaggccttactggaaccactagccaacgtgctggttcagctgggggttacggatgcgttagccgttaacggacaggacggattggatgaaattaccctgacggcaccgacgaacgcaattgaggttcgacacggccaactcactaaattaaccattgatcctcacgattatgggttcgagtactgtgagaaagctgatttagtgggggggacgccagatgagaacgcgcagattactcgcgatattttagcgggagctaagggacctaaacgtgatgttgttctcctgaatgcgggggctgcgcttcacgttgccaaccctgaattgacgttcgctcagggcattgaaaaggccgccgcaatgatcgatagcggcgccgcattaaataaactaaacgagattattacgtttaccaaaggagcggtcgcatgattctggatgatttagttgctgccacgaaaaagcgggtggcggcaagcaaagcgaccttaccgctgacggtactggaacgcgaagcacgcgccttgccggttagtgagcaacggccctttgaaaaccgcctgaaacagccgggctttcacattattgccgaggtcaagaaggcctcaccttccaagggattgattgccccgcagtttccctatctcacaattgcgcaagaatacgatcgggctggcgcagatgccatttcggtactgaccgaaccagattactttcagggatcgttaacctaccttaaagaaattgctgcagcggtgacaacgccggttctgcgcaaggatttcacggtggatccctacatgatttacgaggctaaggtggccggtgcggccgccgttctcctgatcgtcagcatcctgaccgatgaccaattacgaaactatctggcactggccgatgagctcgggttgtcggcgctggttgaagcccatgatgaaactgaaattaaacgggcattggctgctggtgcgcggattattggggttaataaccggaacttgaagaccttcacggtggactttagtaatagtgaacgacttcgacggctggtgcctaacgatcgcgtgtttgtggctgaaagtggggtgaagcaggcgcgtgatgctgatgagcttcaacaacacaacattcacgtgtcgctgatcggtgagacactcatgcgggcaacaaataaaacacaactgattcatgaattgaaggggatgaaaacgggtgaccaaggttaaaatttgtggactgagcacggttgaagcggtccaaacagtgaaccaaattcaagctgatctggcgggcttcgtgtttgcaccaagcaagcgccaagtgaactttgatcaagcgcagcaactgcgccaagtgctcgagccatcgattgccgcggtcggcgttttcgttacaccagatctggctttgatatcacggttagcgcagacagcaaccattcaaattgtgcagcttcacggaccgcaagatcaggccgttacggatcgcattcatcaactggggttacgtgttactcaggtacttcacccaggggacaccctgacgacgacccccgattacgtgatgtttgacggcgttcatccgggaagtgggcaacggattgcctggcaagacatcacccaaatgcaccaaccgacgtttctcgccggcgggttaactcccgctaacgttgagaccgccattgagcgggtacatcccgactttgtcgatgtgagctcgggagttgaaacgaacggtattaaagatccaactaaaataattgaatttacacggagggcacatcatgcaggaaacgaaaacaacaactactaatgaagaaacaggtcgttttggggattttggtgggcagtacattcccgaaaccttaatgagcgaaattgaacgactgactgaagcgtacgaccactataagaacgatcctgagtttaaggctgagttacacgacttactcgttaactacgcggggcggccatcgctgttataccacgctaagcggatgagcaaggatctggggggcgcacaaatttactttaagcgtgaagatctgaatcataccggatcgcataaaattaacaacgccctcgggcaggctctactggcgaagaagatgggcaaaacccgtctgatcgccgaaaccggtgcgggtcaacacggggtagccacggccaccgtcgccgcactgttggggatggaatgtgaaatttacatggggaagctggatacggagcggcaggcgttgaacgtttaccggatggaaatgctgggtgctaaggttcatcccattagttccggaactgggacgttaaaggatgccgtcaatgcggcactgcaagaatggacacgacgggttgacgatacccactatctgattggctcgacgatgggcccccatcccttcccaacgatggtgcgtgatttccaagcggttatcagtaaggaaattaaggaacaaatcattaaggaagccggtaagctacccgatgcagtggttgcctgcgttggtgggggaagtaacgcaatgggagccttctacaactttatcgacgaccctgaagtgcggttaattgggtgcgaggcagccggtaaagggctgaacacggaacaacacgcagcaacgttggaaaagggccgtcctgggattttccacggcatgaaatccgttttctgtcaggacgatgatggtgatatcacggaagtttattcaatttccgcggggttagattatcctggcattggccccgaacatgcttacttacaagacattaagcgcgcggaatacgtcggaattaccgatgatgaagcggtcgacgcctttgactttattgccaaagaagaagggattgtggcggccatcgaaagctcacacgccgtagcctacgtgaaaaaattagcgccaacgatgcgaccagatcaaattatcgtctgcaacttatcgggacgtggtgataaagacgtcgctgcaattgcgcgttataagggggtagatattcatgactaatttacaagcagcatttaatgatccgcagacactagttgcgtttacggtggccggagatcctaatatcgacaaaagtatcgagtacgtggtggcaatggcgaacgccggggcggatgtgattgaactgggaattccgtttagcgatccgatcgctgatggtcctgtcattcaaaaggcaggcttacgggcgtttgatgcgggaatcgataccgacaaaatttttgcgatggttagtgaaattcggcagcaaacggacgtcccgttggtcttcttgtcctacttgaacaagctctttgattatgggtacgacgccttctttaccgaatgcgaaaaccgcggggtaagcggggtggtgattcccgatctgtcgtttgaagaacgcggagaactagaaggtgccgcccaagcgcacaatgtggccatcattccgttggttgcgccaacttcgggccatcgcattgccaaaattgttgcgggaagcaccggctttatctacctcgtgtcatcgctgggcatcaccggtgtgcgggacgataatcaaatgtctgccgatttgaaccagttggtgaccgagattaaaaagtacacggacgcccccgttgccgtcgggtttgggattcatactgaacagcaggtcacacaaatgaatcagattgccgacggggcgattatcggttctggcatcgtgaaattgattgaagaggatcctgaaaatgcgaccgataagattgtggcgtacgtgaaagcaatcaaggcctagaaacgacacaaaaatccgttctatacagccattagtggtgtgtatagaacggatttttaatgtcagtgatactgatacgctatacagggttagctaaattttaggtgaacactgaccgttagggcctgaaagagttgtgcccagtcggctgacttaaggtcaatcgaacctgcttcgatttttcttaagtcaccttcggaaaaatcaggaataatgtgagtgacctccgtcagggttagttgctgtttccgacggtagtgtaaaaaattccacgatagtcgatggttgagggcgaggttaagaatcggggtgggatcttcgtcgttaaccacggccgcgataattttagctgttgcttcgggggtaacgtctttttttgcgtggtcgcgtaaaaaattccattcgcgccaggtgagaacccctaaaatttggtcgtaatgttcttttgcgtcgtgatacgcgtcgctgccgaattcggcatcatcgattgtggcttgccaaagctgtaggtgcgttaatacatcttgataagtcatatcatcttctccagtgctgtgaattaagtaatatcgtctgtgtatataattataatacataacataagttaaaaaagatagataaacgtgcaacttatttaaatcataagcaaattttaaattttggaatatttttggtggttaattcatgcgaagggctggccgttcgctgaggaatatgataattttaaagcaacgtcatcacgcagcaaaaacggtgattatttatttatataatatgggaaacatgtggatagacttaagtgggctaaattaaggtggtagattggtttgatggggcaaataaatcaacagcaaaataacgctgatggcagaagtaatcgcttgcgaacgttgaacgagtatcgcgacgccatcaacgaattaatgagtgagaacatgcagacgcatcatcggtacgcggcacatgcgatcggtgccgagtcgcccgattgtaccgggtgtgcacgctatcaaattttagtacagattgaaaatatcattcggggattcatcaacgatgaaatcatgcataatcagcacttgacgttgacgtcgatgacagcggtgcattactattcggtcgttgatgagcggggcacacagcaaatttatcgggccccgagcattgatcggacgcggaaattatttgcgctgtacaatggtacctaccgcatgatggggatgccggctcgaattgaccgctgcaaggtcgaaattatgattaaatacctcattgctgacacccacgaaagcgaccggctggttcgatcactcgctaatgatcatatttttgccggattggtgattgaaaatgatgatcatcagttgatgcgcgtctttgaagatttagcagctcagctttaagcgacaactttgggaacagattacgcaattaacaattaaatcgaataaaagcgtctaatacttttttagtattagacgctttttgattttcactaaaaaaaagcgtcttttttcgcatgatgtttacaaattcatcatattttaagcgttgggagcttaaatttctcggttaatgtacttgtcagagtaacaaacgacatgtgagttggaggagttcaaatgaaattaacacatcaaaatagcacgctaatcgttgataaccaaaccgtcacctttaatcaccgcttgctgttgcagcaaacagatgaatcgcccatcctttttctgggacatggtgaagaaactgtgaccatgtatcggggcaactttgacattgatgatcaggtggacacgcgattggcgctcacaatcattaacgcctaccaagttgcggataagctggcgctcgaattcgggtttcaagatgttcactatttgacactggaattgacgatcgatgatcagggtcgtttggtgatgaccccgcaacaagtggcggcgcactggaatcggatttggctccgactagcggcgacggccgatgaaaaagtttacggtgctggagagcagatgtcccatttcaatttgcggggtcgccactttccgttgtggacctccgaaccgggcatcgggcggaataaacacacactcacgacttttaaggcggacgccgaccatgcgggtggagattattacacgaccaattaccctgaaccaacctttgtttcaactcataaatactactgtcacacaacttcttacgcctacgccgattttgattttcggcaccccgattttcacgaattacagtactggcaagtgcccacgtcatggacgtttgaaacggcggagacctatgtcggacttgtggaacaattaaccggcttattaggacggcaagcgccattacccgactggacgaatcaggggctggttgctggcttgcagggcgggacgactcgaattgaaacgctcaaacgacggtttcaagaccaccacgttgcgttggcgggcatttgggcgcaagactgggaaggcattcgcatgactagcttcggtaagcggctcttttggaactggcagttcgatgacaacctctatcctgaattacccgcgcaggtgaagcaatggcgccaggaagggctacggttcttaggctatattaacccgtacgtggcggtcgattctccaatgtttgcccagacgaatccagattactttgcgaaaaacaaacggggtgaagtttacgaagtagattttggcgaatttaattgtggcgtcgttgatttcacgaacccgtacgcattcaaatggtttaaatcggtcattaaaacgaatctaattgatgccgggtttgcgggctggatggccgattttggcgagtatcttccaaccgatgtcgtgcttgcggacggctctgacccgatggcgatgcataatcaatggccgatgctctgggctaaatgtaactatgatgcgattcacgaagccggcaaagaaaatgaaattgtcacctttatgcgtgccggtgcgacgggcagtcagcgctataatcccctcctctgggccggagatcaaagcgtcaattggagtcttgatgatggaattgcttccaccattccggctgcgttatcagccgggatgacaggcaacggcctgacacacagtgatattggtggctataccagtatgtacggtaatcttcggacgaaggaacttttcatgcgttgggccgaaatggcggcctttacgccgttcatgcgtagtcatgaaggcaaccggccggccgaaaacttccaagtatacgacagtggcgaagcactggatcacctcgcgaagtttacccacgtgtttcagcgactcacaccgtaccgccaagcggtaattcaagaagtggcggcgcatggcacgccagcacaacggccactctttatgcattacgaggatgatccggaatcctacagtattcaatacgaatacctctttggacgtgatttgctagttgcccccgtctaccaagcagagaagctgaagtggtcggtgtacctacccgatgatgactgggttaatttgtggaccgacgaatcgtttcgtggtggacaccacgaagtcgatgcgccactcggccagattccggtgttctaccggaaacaatctagttatacagatttatttaaaatactcagacaagcttaacttattagacaacttcacgaattcgtcacacaattcttattttgttagcaaaatgatcactacttttccattagtgatccataaacagaccataactatttagtaaaacagactatgaaagatttattattcaaataatgaatcggtgaataaaggagggcgagtaaaatggcctatcaaattataaatcccgcaacgggaaaaatagaacaaacttttgaaccagctgataatcaaatcattgaagcggcattgaatcgcagcgctacctattaccgcacccaacgacaagtcacttttcaacaacgggccgcacaactcgccgaaattgctcagatttttcgggatcacgtggctcaattagcctcggtggcagccactaacatggggaaacgatatcaggaaggcattggcgaagccacagcggcggccaatattgcacagtactacgtcgatcacggcttaacagcgttgacggcgcggcagtatacctacctcgatggtaaaaaagcagttttgcaatacgaggccactggtacagtactcgcggtggaaccatggaactttccgtacacacaagtgatgcgcgtctttgcccccaactttttactcgggaatccggtgattttaaagcatgcacgaattgtcgcgggatgtgcggacttgttcgaacagttagtttgggcggccaacgtcgatcacggggccttccaaaacctcttcattaatagtgaacaggtggcaacgatgattgccgatgcacgaattcaaggggtggcgttgaccggttcggcgcaggctgggagtgctgtcgctgccgaagccggccgggccatgaaaaaatcaacgttggaattaggtggcaacgatgcctttatcgttttaaagggtgccgatattgaccaagcggtgctagatggcgcgacgtcacggttacgcaatgccggtcaggtttgcacgtcggcgaaacggtttatcgtagaacgcgatgtggccgaggcctttacggccggaatgatcgcccaatttagacggcgacaactgggggatccattagacgaaacgaccacgttggcccccatggcgtcgaaagccatgcaactaaatttgcagcaccaagtagacgtcgctgttgaaaacggggcccaggtcttagttgaaggtggcgcggttcttgatcggccaggcaactttttcaagcctgtcttactgactaatttgacccctgacaacccgatgtacgatgaagaatttttcggtccagtgggccaaatacacgttgtcgataatgaagccgcagcgattagtttagccaatcgctcgcagtttggtctagcgggtgcggtgtacgccaaaacggtgacggctgcgaaacgcgtggcggatcagctagaaactggtcagattttcttaaatcaaccttctaacggctacccagaattaccgtttggcggtgttaaaaattctggttatggccgggaaatgagtgacttagcgttgtatgaatttgccaatcaaaaaatgattgcgctgggatagaaaggagcgactcacaatggagaatcgagaagtggcggccgcgaccgccaagaatgatgttgcaccacgaacgttaacgtttaaaaataaaattgcctatgcggtgggggatgttggaaacaactttctcttcgatatggggcaactctacctactaaattactttaccgatcaagtggggttgcctagtgcggccgccgggacggtgtttctagtggcgaagatctgggatgcctttgcggatatctcagtcggaacctggattgataaccgaactaatattggtaaacgggggaaattccggccattcattttgtgggccgcgattccactggccatgttgttgattgccaactttacgacccctaacttctcggtcaccggtaagttactgtgggcctacattgcctacatgttattcgggacctgctacagtatttccaacgtgccatttggctcaatgattccaacaatgacgcgtaatagtcaggaacgttccgaactagcgtcatatcgtcaggccggctctaactttggtttgatgctcgcaacgattggctttatgccgattgtgaccgcattgcctaataaaaatattgggtacacggtggccgtcgttgtctttgccatcttcggggtgctatgccagtggttctcatacgcgaacatcaaggaaaattatccgacccctgtcaaaaagaaggtcagcaaggaagaaattaaggcgtcttaccgggcgctattgaaaaacaaaccgttactcgttgttagcctcgtcaatatctttacgttctcagcctttaacctgaaattggccgtgcaagtttactactgccaatacattttaaagaatacgacggccgaatcatggctgggtttcttcagtattgggatggttttcgtttccgtcgccctgacaccacttttgaccaaaaagtttgataaaaagatggtctacattctggggtgtgcgatctgggctgttgccgatattctcgggttcttctttgccaatagtaccttcatgctggtcttcttgacgagtattgcttacctcggggatggctttaccagcgccctgaactgggcactcatttcagactgtgtcgaatacggcgaatggcaaagcggaattcggtctgaaggactagtttattccttctttacctacttccgtaagttgtcacaggcgattgctggatttatccccggcattgtgttggcctgggttggctatgttccgaacgcgacgcaaaccgcaaccgcgttgatgggcattcgggggctgatgtttatctattcagctgtgctcgcggttgccacgattggggttatgctttggctgtacccattgacggaaaagcggtacaagaagattgttgcagacttgacggttcggcggcaaaacaagcaattagcgcccgaatacgtagtttcggactagcaaaggggagtttaacgatgaaatattttttagatagtgccaaattagatgaaattaaaattgcttatgaacaatatggctttgatggggtgacaactaatcccaagcacattatgaacagcgggaagtcctttaaacaagcaattacggacattgctaactacgtggccgataagccagattttccggtctcagtggaaattaatccccacctagaaacggcacctgaaatggtggcgatggcgaaggaaattagtgcgctctcgccaaactttgtaatcaaggtgccgaccaaccagcagggcattattgctgctcggcaactggaacagcaaggcgtgcggacgaacatgacgttagtgttctcgccggcccagtcgattatgcccggtaaaattcatgccaagtacgtctcaccatttgtgggatggaaggaggattacggggatgacggcttagcctacgttaaagacattgtggatctttatcaccggtatgattttgacactgaaattattgttgccgcgattcgaacggctaagcagctccaacaggcggctatttacggagcggatatcgtcacgtgtgcgctgtccgtgtacgaagctagcttcagtaatccgtataccgacctcggattgaagacctttcaagacgcctgggatcataccaagggtgctcagtaacccgagtgagtcacacgaattgacaggtgatgagccacgcttcctgtgggactaattgagccaacaggcaaagtcgcagtaaaacttttgtgaatcgaaaaaggaggagggggaccatgacaaccttagaaaaaattcaacaagctaatccatctttaaccattcattcggtatttgatgacacgtttgccctttacggacaggtcatcacactacctcatcaggatgaattaaaccaaaatttaacgacgttaaccactattccggccactcaaaaccagtacgttcgtgatgccccaaccctgttagcagaggttaagaaagcggcgattgcacgcgaattttacggggaacagccgattgaaattggctactgcaacggcaacagtgatcatttgaacgcgtttgaatggcataattgctcggagctgaatctggcagcgactgatatgattttatttttggcacaccgacgagatttaagcggaacgacgattacgacagatcgggcgcaagccttctttgttccgcaagggacggcgatcgaagtttatccgacgacgctgcattttgcgccatgccgggtgtggcaagctgggtttaagtgcttagtgatcctaaccgagcggacaaacacgccactagcgtctgggcatgccgcagacgagcccctattccaatacaataagtggctgattacccatgctgaaaatgaacgcatggtcactaaaggggccctgatcggggtgaccggaacgaacctgatgattaagacaattgattaagcaatccaaggaggactgacgatgagtaacttattatatttaccagttgtgcggcgcaaatttgatgccgcgacggctgaacaaatcatgcaaactacgcttaagcaactcgcagattatgacctcattgcgcctaaagaggcgctgggtgatccgtctgaactaggtgattttctcagttcgattcaaaacgaatccgtggccggcattattttccataatacgacctttacggatgcggagtttattcaaatggtgcaccggtattatccgacgacgcccattttgttactggcaccgcgtgaacccagcattcacggttggctgcgcctgaacgcattgaccggtattattagttcgggtaattatctggtcagccaacaccatgattttgagcatatttacggtaatccagatgagccggcggtcgcccacaaaattgcctcgtttgctaaagcagttcagattaaggccgatttgaatgatttgaatattggcgtggtggggacctatccaccgggattctttttctctgatgcggatgccgcagaattgaaacaacattttggaacgacattgaagcattacgaaattgataccgcctttgatcaggcggctgcattgacacccgaccagtatcaagaccagctcgactacgcgatcgcgcactttaaagggctggatgctgacggggatgagacgattcggtttgtgaagtttgcgacgctcatgcggcaatatcagcaacgtgatcagctcggcgcattggcctcccgttgctggccagacttttttgacaagtatcacagtgctcccggagcggtgtggtcacaacttagcgaccaacaactcccgacagcgatggaatgtgatattcatggcgccctctcgatgtacattttgcaacagatgacgcaacaacgtgatgcagtatttttgggtgatctatccagcatggatccaagtgataataccttaaccacgtggcacgattacggggcctattcgctggccaacccgaagtatggggttgaggcgagtgttcatcctaatcgcaaggttcccgttagtccccaaatggttttgaaaccgggcgaagtgaccttcttacgagttcattacaacgctgatggctaccagttgatcgtgactaaggggacggtactagatacggaagcccagtttaatggggcttctggccgggttcaaatggatcagccggttgcaacgctggtcgatcagtttgtggaacacggctacgaatcccactttgccgtcgtctacggtgactatgtggctgatattgtggccctaggcaaactattaaaaattgagaccgttgtatactaattgcaaaaactctcctgacaggcacttgacggtgtccgttcaggagagtttttagtcgagatagcgtttttgtaaatcgcgcatgttttgtggtgtgattccgaggtaggctctcagatagtgacgaatactaccgtagtcgtgatcgataatttgcagggcggtaccgatgtaatcgggggagacgctcattaaggaaagggtgttttgagcaaaggccggtgacttcccggcctgagtgatttttttaacaaccccgtcaaggagcgcttggttgacttggttggttaacaggtagtcgttgatcgaagtttgacgatccacattgagtgcggacaacagcaagatggcgcccatccccgtccggtcctttcccgcggtgcagtggaagagaacggcactttctgggtcactgtcgagtaacaggtcaaagaagtgttggtaggccgctttggctttgctggccgttaccatttcgcggtagacctgcaacatgtggtgatagccggcctgaggatcatctgaaaattccgcttcgatttcttcttggctatgggaagcatcggtgcgatcagtctgaaagacggatagctggtgataggtggcggtgactgggacgtgatcgggctgtgccttaatttcaccaggggcccgaaagtccacgtcgagggtgatgttgagactggctaataggtccagatcgggttggtccagcgtgttaaggtgacccgaacgaatgagccggtgccatttgaccgtgtgaccatccactgtgcgatagccacctaaatcgcgaaagttccgtccgttttttattggtaacagccgattagttgtcatgagatgcccgcctttactttgatttctacctattcattgtagtcaaccttgcgaaaaaatactagatatagggtcgcaatacttgtgctaaccggcgtccagcgatgtctgaaccgtgctgatcggggtggagacgatcggtgtaggtaagggcccagtcggcggtttcgatgagcgtgattgaaggcagctcatgaatgaccgctcgaaaaacgggggcaaagacttgtgcgaagggcaccatgaccatgatgggcgcggcaaaacagtcttgaacctgatgtaagaaggaccgcagagcactctcgaaatcgtcagagaagtattgccggtcgttgaccccgaggttaatcaccactaaatcggtagccgtgggttgccaaacagtgtcttgatcaagatgggtcagaaattgaggggccgcgggaacatgaccggtgccaccgcggatgatgccggcggccgagtaggcaatgcgacagctatcgcacgctaagtgatcactacactgggcggcatagttagtgtcggccgcgtaatcttgagccggtcgtcttccgtggacccagcacccagcagtaatcgaatcaccgatccaagtaagatgtggtcgtggtggggtgggctgaatctgggcggttgcgtcagtggtgatggactgcagggcaaagccttctcgttccagccacacgttgtcgagatcggtgttgccaaccgtcatgatttcaatcacgtggtgggctgcggcaaaatggatggtggcgggcatgtggttggccgcaaagtgttgccacgggtgatcatccacgcggatgccgatgacctgcgcggcaccaaagggattgccattattgaagaaatccacggtcaacgtggtagctcgttgaatttgaaagcgaagcatactgcccaggttggtcgtgtagagggtgtcaaccccgtgacagggtttgagtttccagcggccgagaagtctagtgtgggtcgtaagcagggcggcagataaagtttgagtgagcatagttaagtttccattcttttcgttaattattggttaagatcggcggagattcgattaatttacgattaaggccccccggtgttaatggtgaaatggtaaaataggagcatcatttaggaggtacgaaatcatgaagcttatcaaacgcttagcgttagtgatggtgacattattattagcagcaatcgtggtgcccgcagtaacggcgcacgcggatacgacgaccacttcttcttcagatactactgatgaatcaagtagcagtcaagcggtccaaacgaaagccctgtcgagtgcgtacgtggtgtacggggctggggtggcccaaagcgatcgttcgtcgattggcagcgcgcttggaatcagcgacaattacaagacgctgacgtcaacggcgagcgattacaatcaatatattggtaacgggacaacatcggacgccgcgatgattagctcggtttccattgcaccggctgatccgggaacgggtgtgaaggtcaacatcgtcaaatacgatggaaacagcaacattaccaaggttaccgcacaacagtatgcgatggtggctaccatggccggcgtcaatgatgtgatcatcaccgtgacggccaacaaggcggtttctggtgaagcagctctggctggggtatacaaggcgttggctacggacgggatccaactgagttcggaaaatacgtcggcggcgaacagcgtgttggaagcgacccaaccagcgatcgatgctaacagtgatgacagcaagtatcctggaaaattaatggccgcagtggggtcagtttctaaggaactagctcagcaacggcaagatgacaatgattatgcaaccaaggcagaagtccaagaaatgttggccaaggcgttgaagaagtacggcattgatgacagtaccccatctagttcacagacaacgattgtgaacgcgttgattcaggtgcaaaaagcaccggtatcgtcatcgaaaacgtatatcagtaacgtcacaaacgtgacaaagtcggtaaaaaatagtgttgggagtgccatggctaagttgagtgactttgcgaacagttcggatggcaaggcgctaatggccaagtatggtaacctcttccaaagaacatgggcgaagattgtggcgtttgtagaagggctctttaattagaaacgctaattacctgaattttttgcaaatttaaagacgagaattctgttatgaattctcgtcttttttaatgaattgatatttttttcgaggcagtcctttaaacctatttattggtcattggtacaaatcgttcgtgaaaagattcatgtaccgctccttctagaatatattagcctggtcgtgttggtattcacagagggttcggtcggtagcacggcatgattgaaattgactgctacttaacctgtcagacgctattcttcatttagttcaacatgtaattctgggatttcttcccataccgtatgtgttaacggggatgagcctggaataatcatttctttgaacttttgggtatacccagcggccttagaatcgttttgtgctgtaaccatggaggtagcgtaagcattatgattctgggcctcgtccataaacatccaaatttcttgatccggatgttcgggatctactcggaaccacgtccgcgatagtgagtaatgaattaatgtgggatgttcacgttgatattgcactgcttgtgcaagcgcggctaccatttcttgatggttttcctttgcgacacgatattgcattgtttctacttttttatccattgttatcaccctatacgtttgcacgtggatcaatacgacccatataattgtattcgtaaagcatcgtgccatcactttcagttgtggtaccatcgagtgtcaatttcacgccaccatccgcaaagaagcgcaaataggtaggctgaattcccattttatcgtactgctctttggttccaccaattgctttttgcatgccggtgataccagcctgcttagctcgttgtgcggcttcttgtgcatctttaggggcgtcaccgtacatatcacgagtttcaataatgtcacgccaagttactgtaaattcggctttgtcgttgccgttgtcgaatacgtatcgactggttttggggaaaggtttgccaaccgtagtgtcttctagctgcgtctcaacagaaacgtgaccatttgtggtaaaaataatttttcctgtctgattatccgcgatcatgaagaatggtaggcgtttaaatccaaagtgctctgtggtcacaaagtcatagatgtagatcacatatttttctgtatacatgcgtccccacagccagtgatgaaaggctgctagtggtgtaatgttcatccattgatgatcatggtaaccttgtccgtgaacgttaatagtttgaccatcgtaggttaacgtccccgttacttcacacttggggacgctgagatcggtatagaaatactcgtcattatcaccaagggcaagactggatgttccttgacgaaatggttcaactagggcgcggtagtgcaagtcacatgcaataccttgggtgctttcgatatgaacatcgtattgtttgaaatcaccggtacagtagtcagggccgaagtgaacatcacatttttccttgctcatactgttgttagccaactttgcaaagctaaattcttgaacagtttcaccattagggcgcgtgattgcaagattcaaatttggctcatagccaacggtttgcatggcaccaactgttttgggacggaacgcggcgatcactttgctgccatcatcaaagtctgcatcaaagtaccaaacttcattagtaccaacgccgtcagtattacgaatcccatcttcccaaggagcgacaacgttaggatcaataccgaactttgcgaaatcttttggttggtccattaaacgtgcatttgccataatatcaatctccaatctaataattataaattaattgtcatttgttacggaatatctataatatagttagatattgaggggatttcaagagatgaaatatccgacaatatcaaataattgatcatttttgctaatttattacgctttgttggagggcaaacaaatatgaaacctagacgcaaagatttacgcaccgaaaaaacctatgcagcattattttccgcatttgagcagctaattcgcacaaaaccttttgaaaaaataacggttactgaactttgccgagtggctcaaacacgaccagctactttttataatcacttctccgataaatatgatttttttgctcacatgattcggcagttggaagatcaaaattttaaagatgcatctattgaggccaacccagctgatcctgaagcatatctcaatgagtggctgacattaggatttaatttcatcgatgaacatgcagcgatggttgagagcgtccaagcggatacgttacttactacgattatgcagacaacggctgaacgactaactgggataattatcagccaattgcctgaagtggaacacactaatattgatacagaagtacgtactcaagttatgatcggtgctctatttcaaacctcgcgctggtggctagcacaccgtcagtctatcgacaaacaagatgtgttagatcagttacgggtcgttgttaaacaaatttttgccatgtgatgattcaccaaaaacaccagtcctacatagtgcgtatactggtgtcattatgggttatttgttttggtgtgcgtacgcgtatctagcagagttaatgatttcagccgcaaaatgtaacttgtgaccgtctgcaattgcttgtggtgccttaccagggcagaagaacgtcgactttaagataaaaccagttgctgttggtcgaacttcgtggcatgcaccaacgtgaattggggtatcgtcactttttaataagaactgaccatatacggtaatcggataggttggatctttctcaaaaggcatgttggccggaatttcctgtccagcaatgccatgaacgtatacgggttcgccaaacataccgaacgcttccattccacgttgcccgttagtaatatctccaatgatgatatagtgttctggatgtacgcttaacgccgcatcggaaccaaaactgccattaataatagccattgtctcctgaaaaccaatcccattaacctctgtcaaagttgtaccaatgtgggatttcgcagcgtcgtaatcaacgttatattctttccaacgacgttcagtatcggtttctacatccttgaacaacgcgagcattcctttttcaccgagggcagtacgagctgtataggatactttagttgcgacggctggtgctagccagttcaagtcagaatgattcaatgattgaccatctagacgtaagtcaacgcctaaacctttgagttcatgcaagacatgcagtgtgcgctcatattcatagcggtccatctgggtttgcgtgtagggagtaccgtcaatagttactttataggttaatttcgtcatgataaagcctccttgctttgtatattggcattatcaggaataaaagcattcgaaaccagtacagtcacgaataatctgtatgattgtggacagtaattacttttttgtcaggtttaggaggtaaagataattaatactcaattaaatagaagccagcgtgatattcagtcagcatttctagcattgttgcgaatatgtgatttcgatacgatcacaatttcggcgattgcgaagcgtgcacaaatttcccgtcaaacattttatacgtattatccgagtatatttgagctgacaactcaaataattgatgaatacctagttccaatacaacaagcaatagacgctcgaatagacttgatacgccatcctggaaattttaaatcgacgtatgccaccattgccccgatgttagctcatcggttaattgataaccgaatgaattaccttgctttacgtaaaatacagttggggaaaaatggatttaatgcacgacttgagattgttcttactcagaaactacggcgggcttacgaatcaaatttggatgagctaacgcaaaaatttattgcttatttattgttggctgaactagattacatttttgattcagggaaattgccgtcgcctgagatgataaacgatagtattcgtaagattcagaatatctttagaggataactaacgtttgtccacatggaattaggaaaaattcacgtaaaaagttatctcaaattaggatttcgtgctatcattcaaccaataacaaactggaggtaatacaatgaaagcaattggcatttaccaaggaacggatattgagtcgcagacgtttacaacggaaacgcggcccgttccaacagcgcagggcacggatgttcttgtgaaggtccaggccgtatcggtgaatccggtggatacaaaggtgcggcaggtcacggatcagaccgagttgaaggtgctcgggtacgatgccgtcgggacaattaccgcggttggtgatcaggtcacggcgttcaaagtgggcgatcgggtcttttatgcggggagtaatcagcgtgatggcgccaatcaagaataccagcttgtagatgcgcgcttaatcgcactggcaccggccaacttgtccgatgaagatgcggccgccatgccgcttaccttactgacagcgtatgagctactgtttgaaaagtttcataatccgtttgctcagggggccaacggacaaaagacggtgctgatcatcaacggcgccggtggtgtcggttcggctgcaattcagttggctaagtgggctggttttcacgtgattgcgaccgctcatcgaccagaaaccgtgacctgggttcagcagatgggggccgacgaagtcattgatcatcacgaaagtttgacgaagcaactcgccgatcggcaaaaccaaattgataatattatgattctgcacaccacggaagcgtattttgaagctgccgcgcaattagtgaagcccctcggacacgtgggttcgattgtggagtctcaacaagcactaccacttggaatgctcaaggataaagcagccagttttgactgggaatttatgtttgcaaaggcaaaatacggcgtcgacatgaccagccagggacggattctggccgagatggcgcagttacttgatcgtggcgcattgcggtcgacccgcacccaaacgattgagacgatgacagctgaaaccctgcaccaggggcatgaaattgttgagcggggcacgatgattggtaagttagtcctaaaagcctcgttttaaagagaataatcatgaagaaagcttgacaagtcgcggtaattttagtaaaattttactaaaatgtaaccgctttatttggtaggaggaaaaacgatgaataaggaacaattgttacaagaatatgagcaagtctttcatgaagctggcaagagtgtgtatttttcaccaggtcggattaatttaattggggaatataccgactttaacggtgggcacgtgttcccatgtgccatcagccttgggacttatggggtgtacgcaccacggacagatacgaaggttgaaatgtcgtcagctaacatgactgacagcccgattgtttcttttgatatcaacgatgccgaacccgaaaaaggaaacggtaaaacgtgggccaactacctaaagggcatgatcgtgcaactccgtaaggcgggatacacctttgatcatggctttaacctgttagttcacgggaacctcccatacggggcgggtctttcctcgtcagcttcgatcgaactattgatgggatacattcttaaggcggaatacgacttggatgtcgaacaactgacactggtcaagcttgggcaaaaggttgaaaacgactatatcgggttgaactcagggattatggatcagtttgcggttggaatgggtaagaaggacaacgccattttgttagatgccaatacgctggcctacaactactatccattggaactgggtgactacattgtggtcatcatgaacacgaacaagaaacattcattggccgattccaaatacaacgaacggcgcgcacagaacgaagaagccgttagacggctgcaaccagccctcgatatcaagtatttgggcgaattaacgaacgatcagatcgatcaatactcatacttgatcggcgactacacgttgattcgtcgtgcccgtcacgtggtacttgaaaatcaacggaccttacaggcgagagatgccttgttgaacggcgatttggaactattgggtcgcctaattaacgcctcacacgtttcattgaaaaatgattatgaagtttcgggtgttgaattagatacgcttgctgagacggcatggcaacaaccaggcgttttgggcgctcggatgattggcggtggcttcggtggtagtggcattgcgatcgtgaagaaggaccaagtagcggccttcaagcaaaatgttggtcgggtgtatgaagacaagattggttacaaagcggacttctacgacgctgaaattgcgggcggtcctcaacaactataataatctttaaatagatgaccgagattgtgccaagctaatttggcacaatctttgatttacagcacttttcatggcacactagtggttagcgtaaaagatgagtaagagggagtaataagatgaaattaattgaacagtttgcagaaacggtgattcaaagtggcacgtatgacccgatggatcggttctatgtgatcaataagatccgggcgctggtgggggatcaagacgctccggtccaagacggtacgcaggtcaaggatcaactcatcgatttggccgttaccaatggtaaaatcgagggcacgattaccgaccgtgaaattctcaacgatcaattaatggatttagtgacgcccacgccggcacagatgaaccgtgaattctggcaacgttacgaagcagcgcctgaagatgccacgacttatttctacgatttttgtaaacaaaatgactacatcaaagtagcggcaatcaagaaaaacgtcgaatttagtcgggcaacgcagtacggtgatttggagattacgattaacctttctaaaccagaaaaggatccgaaggccattgccgcggccgcacaacaaacgagtgcacagtatccacaatgtcagttatgtatggaaaatgaaggttatttaggccggttgggttaccccgcacgaagcaaccaccgtattattcggatggaagttggcggacaggaatggggatttcagtactcaccgtacgcctacttcaacgaacactgtatttttctggatgcgaagcatgaacccatgcaaattaacgcacaaacgattaaaaacttaattcaaattgaacagactttcccggcttattttgtcggtagtaacgctgatttgccgattgtcgggggatcaatgttggcacatgaacattatcaaggcggtcggcatatctttccaatgatgaaggcgacgattaaaacgccgttgacgtttaccggctttgagcacgtgacagccggggtggtcaattggccaatgaccgatattcgcctagtgagtgccgatactgaccaactcgtggcgttgagcgataaaatcatgacggcgtggaagcagtatagcgatccaagtgtcagcgtggtcgcaacgaccggtgatatgagtcatcatacggttactcccattatgcaccgggaaaaagagacctatgtgttagaccttgttttgcgcgacaacaatacgtcggcacagtatccgaacggtattttccatccccacgatgaagtcgcccacattaaaaaggaaaatattggcctaatcgaagttatgggtcgtgcaatcttacccgcacgacttaaaacggaaatgcaagaggttaaaaagtactggctgggtgatgccaatgaaattgcggcctaccaccaaccatgggccgatcaaatcaagacccagcaggccattacggcaaccaacgtggacgacgttatggaacaggcgctggcagatgtctttgctcaggtgctagaaaacgccggtgtctttaaaaatgacgataaagggcaagaagcattggcaaaattcgtgcagacaatatagaataaggatgtagcgtgaaagcggttaggcatttaagcacgctgcttgccgatcattattttagagcaagttaaaattatcatgtaaagaagaataatcaaattccagaaaggggtgatctacaatgtcagtaacgttaaaagatatcgccagtaaagctaacgtttcgttagcaacggtttctcgagtgctcaacaatgatcagaccctttcggtaaatgatttgacgcgtaagaagatttttgaaattgccgaagagcttaactataccaagcataagcggccagctaccaagacccccagtaagcggattgcagtagtgcagtggtacacccaaagtcaggagctcgatgatctgtactatatgtcgattcgaatgggcattgaggaacattgccagcaggtgggttacaaagccatttcgatttacgagagtagtctcgatcaaattccagcgggcgtggacggcattattgcgttgggaaagtttagtccaaaccaaattcgccagttacaacggatttccagtaacgttgttctggttgattttgatgggctttcgcacggctgcgacagcgtcgtgacggatttcgaacagtcagttgatatggtcattgaccgcttccagcaagccgagatcaatgatattgggatgatttacggtaccgagaaaacgacggaccaaaaacaaacgattaatgatcaacgttatcattacttcgtgaaggcggtcacggcgctgggcatctataaccctgattttgtcttcgagggtgattttacatcacaagcgggataccaggcgatgaaacacgcaatcgaaacgctgggtgatcggctcccccacgccttttttgtggcgaacgatccgatggcggttggggcgcttaaggcgttacaagaagccaaaattcaaatcccggaacgggtcagtttaatcagcttcaatgatacgaccattgctaattacgtctatccaggcctttctgccattcacgtggcgacgaaggacatggggcaaagtgcggtcgaattaatggttgagcaacaaaacgctccccgtgactttactaaaaaagttgtattagggacgcgattaatcgagcggcaaacgacgaaataaacacttaatccttgttaacgggcagatgacaatctgtctccttagcaaggatttttttaaacccattaggaggtaatcatcatggcacaatcggttttacaggcgattattgtgattaacgcacagagtatcgatttacgaattgtagatttaaaatcattgcaaacgattgagcaggccagtgcaccagtcgtcttaggcgaccatctttttacctcgggcggcattgatccccaaatggtggacgaggcgatcatcaagttacgggatttccagcagttaattcatgacgatggcgtcgagcagacgcaagtagtcgtcagtcacgcggtttcgcaagctgaaaatatcagttttgtgcaggatcaaatttacgttcaaaccggtctgacgatgacgccactgacggttaacgaggaattgatgtatcgtttccaagcgagtgccgtgttgttgccccactttaaaaaaatggccagtaaggggaccatcctcattcaaattggggctagtgtcatcacaatgatggtgtgcgaagaagagcgggtaacactggttagggaactgccattaggccccctacgagttgctcaaattttggcaggcatggagcggcaggtggcctcctatgaggaagtgctggatgattacctttcctcaaaactgatggatatttggcgcatgatgcccacccaccactttgaccgggtgattttgatgggctcgaaattgaccctgttggaagagatgattcccacacacaagcgcgataccagcattacgcacgaccagttcgatcagcggtttagtgaggttatgaaacagtcggatcaagacctcgccgaacacctcccgcaaatggaagtcgctgaagtggccccgacgttcctgctgctggaccaaatttttgatcacctgcacgtcaaggaaatttgtttaacggatattaagttgatcgacgggctaatggtccatttgagtgatcaaaaagggcatttaaagacgaactgggattttaatcaggttgtcatcgatgaagccaagtgcattgctcagcgctaccgggtggatcaacaacaccaacaacaggtgcttaaattcgccggtcagctatttgatcgtctaaaaaagttgcatgggctggggaaagaagagcgcttattactgcaattggcagcaatcttacaggataccggggtttttctggatgcccatcgtcattcgtttcactcggaatacattattcttgccagtgaaattttgggattaaaccgggccgaacaaacggtggttgcggctgtagcgcggtatcacagtgcaacggcgccctcgcttgacctcagccagatgcatcaggtgagtgccgcagaccggctccgaattgcgaagctatcggcgattttacggcttgccgacgcacttgatgatagtcaccaggccaaaatttccaagattagcctgcatttggatacggatcaggtggtgatcaccgcacagtcaacgcgggcgatcacccttgaacagtggacgtttcagcataaggccaactttttccggaaagtttatgggttgaaggccgttttgaagagtaaccgcttaaaaggatagggaggcgttaggatgtcatatagaaaaccagaatattttactaaccgtgagctaagctgggtcgactttaacgatcgggtgctggatgaggcccgtgataaacgcaatccactcctggaacgcgttaatttcttgggaattacgcaaagtaatttagatgaattcttcatggttcgggtggcgtcattacgaaaaatggaggccgttaattatgataatcatgatgcggcggggatgttaccagcagagcagttgaaggcgctgagcgttaaaattcaccaacaggttttgaaacagtattccacgctgtcccgttcgttaatgccacagttaatggaagctgggattgagctgctagattacgaaaacctatcgaaacggcaattaatgtatgtgagtcaatattttcatcaggacctgtatccggtgctaaccccgatggcggtcgatagttcgcggccgtttccgtttattggaaacaatgcgttgtatctagcggtacggctggcgaaaaatagtttgttattgcccgaagacgataaaaaagagcgacgttacgcgctcgttcaggtgcccgatgtctttaatcggattgttcagttgcccggcgataatcaatttttactgctcgaagaggcgattaagcccttcattgccgaactttttacggggtacaaggtcaaagaagttcggacgctgcgggttatccgtgatatggactttgacgtcgcacagaccgacacgtctaatctgatgaaagacattgtgtcgcagcttgccatgcgggagcataccaaggtgatgcggttggaactggaggccaagacggggaaaaacttgcggaagtggctgaccgagcaactagatgttcgggaagacgatgtttacgaaattaacgggcccatcgatctgcacgccatgagtcagcttgcaaaggcggtcacggatcacgctgatttacggtatccgccgtttcacccattcttacccaaggccctacaaacggatgatctatttacgaccatttctcggggggatgttttcttacaccacccgtacgacagctttaaaccggtggtcagctttattcagcaggccgcccaggatcccgatacgctggcgatcaagatgacactgtaccgggtgtcgagtcgttcccccattatcaaggcccttggtgaggctgcccaaaacggcaaacaggtcaccgtgctagtggaactgaaggcgcggtttgacgaggagaataatgtgcattgggcgcacgaattggaaaaacgaggctgtcatgtgatatacggcttaaaaggattgaagacacactgtaagttgttgctagtggttcgtcgcgaaagtgcgggcattaagcgctacgtgcacatggcgacgggcaattataatgatgtgacggctaacttttacacggatatggggctcttcacggcggatacccgcattggcgtggatgcgtcgaatatctttaacatgctgtcagggttctcggaaccgcgccggtttgaaatgctcaacattgccccactgacgatgcgtgactttttgggtgaacgtattaaagatgaaatcaaggcggcccaagctggccggccagcaaaaattcgaatgaagatgaattctttatcagatccgcgaatcatcgatcagctttatcaagcatcagctgcgggcgtaaaaattgatattattgtgcggggaatctgctgcctcaagacgggaattaagggcgtcagtgacaatatcacggtccactcgatcgtcggtcggttccttgaacacagccggatttattatttttacgccgatggacaggagcgcctcttcttgtcgagtgcggatatgatgaaccgcaacttgtcacggcgggtcgaactgctatttccagtcttgcaagctgatattaaagcccagatcatccaaatttgcgattggatgtggcaagataatctgaagacccggatattaatggcggatggcacttatcagaaggtggatcggcggggcttagatccgtttgaggtgcaggcagcactgatggctcaggcaaatgcagcacgagtccatgaggttaaccaggccgtgaagcaggaacggaccacctttgagccgcttcgtaaaccgcaggataaatttgactaggaggcacacacaatggaaaatttggcagtcattgacttggggtccaactcggcgcgcatgacggtgaccgagattcatgatgatgggagctatcaggtggctcaacgaatgaaacgcatggtccgattgtcagaaaatatgggtgaagaaaagaccttgaaggattctgcgatggacagaaccattcaggccttaaaggattttcaagaagtttatcagcaattacctaacgtcacgctgcgggcggttgcgacggcggccgtacggatggccaaaaatcaaaaggaatttttggcccgcgtggccgcagaagtagatggcctcaagttggaagtcattacggggacgatggaggcccattacgattatctgggcgtcatcaatacgttaccagtgaccaactgtgtcatcatggataccggtggcgcaagctgtgagttggtgctcgtgcaaaacgggaaggcccagaatctagtgagcctcccgattggggcggtgaacctttccgaacagttctttaagaaccggacggatgtcctccgagcacaggacttattctgggaaacgacctttgtgaaccgcctctttaacggtatttggtggctccatcgtggtcagaaccttcccattgtggccctcggtgggagtaaccgcaccctggcgaagatctatcgtaaaaaggttaaggcactagacttcgaggacattcatggataccgcatggcggttgaccagattgagacggtgtatgctgatatcattggtaagaacctggctgagcggcgcgacattccgggattagctcgcgatcgggctgacattattgccggaggaattaccccaattgtgacgatcctgcgctatctggattccgatcgggtattcttttctcaaaacggggtacgggaagggatcttattcgaacacattacagaacgtcaggatcacgatcagctaaagtagttccagtgcggattcatcgttaatctggatttgtttactaccagtttgggtgataatcccgcgttgttcgagctccgctagtttgcggctaatggtttccggcgtcgtaccgagataggtggccagatccttctttttaagtggtaatttgaagttttgactctcaaattgggcggcggtttccaccagataatcggctagccgtgattcgacggacgtggttgccgtcttggtggtccgtttttcaagatctgtcagccgctttccaaactcgttaagcagattcaggctgatggtcggatacttctgcattagtcgctgaaattcgggccggttaatctggcagatttgcgtcggcatgagggcctgggcaaaagaattgtggttagtttgagaaaacagggccgtttcaccatcaaagtcgcccgtggtgagcaggtaaagaagttgctccttaccgttagcggccaattgaaaaactttcacctgaccactggcaacgatcattaaggcgtccatggggtcaccggcggcaaaaatggtttctccagcctgatagtggtgacggtgaacgatagattcaatggtggcctgttcggattcagttaactgactaaacagcggcacgagcgaaacgcaattgtgatgtggcatattgacccttcctttcaagtgtttaatgcaagcatagcacgaaatgaaccggatgtggagtaaagcggctagcgtaaaaagccggcccgtgaaaacaaaaaacagtggttcttccaagcgccggcttaggagaaccactgttttatattatttctgcttatctattgtatgcttctttgaacaaagcaacaatatcttcttttgatcccttacgagggttaggaccggcattgccgtccttcaaagcattttctgctaatagttcgaagtcttctggcttagcgcctaattgcttaacggtccgaataccaacaaggtctgacatccgttggagcgcatcaatggccttttgggcggcatcccaaacgcttagaccatcgacgttttcgcccatgaagcgtgcaatgtcagcgaaccgttccggtgcggagacgatgttccacttttcaacggttggcattaaggctgcacagcattcaccgtgaggggcgtcgtattggccgcctaattggtgggccatggcgtgaacgtaaccgagatcggcgttgttgaaggccattccggcgagcaatgacgcttcggccatcttcgtacgagcttcaacattgtgaccatccgcataagcctgtggcaagtacttgctgatcagcttgatgccttgaatggcttgggcatcggtgatgtcgttgcggtgggttgatacatatgattccacacagtgggttaaagcatccatcccagttgcagccgttaagccccgaggaatgtcaagcattaacagtggatcattgaatgataccaatggaacattacgccatgaaatgacaacgaacttcagcttggtttcttcgttagtaataacggcgtgacgggtaatttcgctagcagttccggcagttgtgttaacagccaagagtggtggcaatgggttttctaaggtttcgattccggcgagttttgtgatgtcgtcaccgttagtgagcacgataccaatccccttagcgcagtcgtgtgatgatcccccaccaacagaaataatgctatcgcaattgttgtcgtagtaggcttgcttacctgcttcaacgttccgaaccttaggatttggttcgacttggtcatagaatgcgtagtcaacaccggcagcctttagtgatgcctcggtttgtttaactgggccgttttccatttgacgcaggaagggaccggttacgattaatggtttcttcatattgagcatcttggcacgatcaccaattttgctgatcacaccggggccaaagaagttaacgttgggcatcataaagtctgtattaggttctaccattataaaattcctccagaagttaattattggaaattaattcacaagtacggtgaaaattaactgaaataggaaactatttcatgcattattttcattacgtttgtattgtattatttataattacatttttcaacccctatttatcactaaaatatgcaaattttttcattaaaactagaccaatttaaataagatgaaaattgtgtactgatatacaatagcgagcatgcaatcgtttgcacgatcaaaaatgaggaattgaatagaccaatgctaaagaaaattaaaattaaatggcaatttaaagcgcattcaaagatatagggtatatactgttgatttataagtgtgataaacttgtgaatgttcggaaacttacatatatagcaataggaggaaaagttgctcatgcgtcgctatcgatcaatgcgtttaagtttaggatggcaaattgtcatcggattgattttaggaattattgctggggttattttttaccataaccaaactgcgattacggtcatgtctaatttaggaacaattttcattagtttgattcaaatgatcgtgttacctatcgtggtgtcatgtttaaccgtcgggattgccggaatgggtgatattcataagttgggccgggttggtgtgaaaacgctggtctacttcgaaattatgaccaccattgcgattgctattggactgattgtggggaatatcacgcaaatcgggacctttatcgacatccatcaattacaaagtacggatatttctaagtatatggcgacggccaaatcagcgtcacacacgggaatttgggacacgctgttgggtattatcccgaccaacttcttcaaatccctttctgaaggcgacatgatgccagttattttcttctctgtcttctttggtctcggaaccgcagccattggtgaacgcggtaagattattaccgactttttacaggcggtttcggaagtcatgttcaaggtgacaaactgggtcatgaaatttgcaccaatcggggtttttggcttgattggaatgacgctggctgaaatgggaattagcgcattattaccattaggattgttcgtgttagttacttacgcaaccatggcctttttcatcgtagtcgttttgggtctggtggcacatctgttcaagtttaagttctggacgctgatgagcgtagtgaaagaagagtttttgattgccttttcaacggctagttcagaagcaacgttgccacggttgatcagcaaaatgcaaaagtatggggtcagtgaggggatcgtatcgttcgtgattccaactggctatacctttaacttggatggctcggccatctatcaatcattggccgcgctgttcttggcgcaagcctatggcattcatctgacaattgggcaccaaattacactcctcgtggtgttgatgattacgtccaagggaatggccggggtgccaggagcctcattcgtggtcttactagccacggtttcaacgatcggtgtgccgatgtctggcctgacctttatcgctgggattgaccggtttgttgatatggcgcggacatccgtcaacgtggtcggaaactcgattgccaccatcgtgatcggtaaatcagagcacgaatttgatgctgagaaaaataaacgatatttagaagaaattaaaaacgcctgaaaggattgatctggattggctgagacaaaacaattaccaaaccgtagtgaagttgctgatgagttgaagtgggacttaaccctgctatttgattcggatgatgaaatgagagccgctttaaagcaaacggttgccttagtgaccgactttgtgaagctagaagggcaggtcggaaaaagcgcccagaacctgcttaatgcgcttcaagcggaaaaacaaattgatgagcaactggaacgtgaatatgtctacgcatttatgcgccgggatagcgatacaacggatacggcggccgtaagtgtgtttggggaggctgcgaacaccctcagtaaactgggagcccagatggcgtttttggaacctgaaattgtggccattagcgatgaacagctggcgcagtttcaacaagctgaaccccaactggctgaatttaactttttactgaaaaaattgcggagtcaacgggcccatgtcctttcggatgttgaagaaaaactactgagtcgggcgcaaaagtcactggacgcctctgaagaaatttacaacacgctcaatgacgcggatcttgatttcggacaggtccacaatgacgatggcaaactcgttcagttgacgcatggtaatcggagtcagtttaccgaatcgcaaatccgtgaggttcgtaagaaagcaacgttagcttacgaaaaaccataccaaaagttacgaaatacctttgcccaaacatttaatagttttgttgattcacagaacatgcaggcgcaaattcggcattatgacagtgcccgtcaagcggcgatgtcaggtaatcacatcgatgagagcgtttatgatacgttagttaaaagcgttaatgaccatctatcattggctcaccggtggtacgcactaaaaaagcgggttctcggcttagatacgatgtacaagtacgatttgaacgttccgttggccggttcggatatgctgaagaccacctttgaggaaggcaagcaaatgaccttggatgcgttgagtgtgcttggaccacgctatacggcggggctcaagcaggaatttgaccatcgctggattgatgcggccgaaaataaaggcaagcggtctggcggctaccaaattagcgtttatgatgcgaacccgtttattctactgaactggaccgataagctgtatagtacgtcggttttggcgcatgaatctggtcacgccatgcatagctatttttcatcgcaggcacaaccatctgaatacgccgatgcccccatttttctggcggaagtggcatcgacctttaacgaaaatattttgacggactatttgttagagaagtatcaagatgatcggcaaaaattgatctttattttagaacaatatattactggtttcattggtacgatttatcggcagacccagtttgctgagttcgagcatcaagcctaccaagcgcagcaggcgggcaccacgctgactgccgattacctggatcagattagtggtgatttggtcaataagtactatggcccatcagtcaccgaaaccgggacgagaacgcagagctgggcgtatgttccgcacttctatatgaactactatgtctatcaatatgcgacctcccaagcggtgtcaacggcattgtcgcagcgagtctggcaacatgaggaccacgcattagaaaactactttagctttctagaggccggtggctcggactacccagtgaacatcttgaagcacgccggtgttgatgtgacgaccgaccagtatttgaaggaggccttcaaggtctttgaacaacggttggatcagattgaatccctgctattaaagtaaaagaaaaaagcctcacgaaatttcgtggggcttttttactgcaactatttagcagcgttcttttcaatttcaggggtattagcagtggcgtcgtcaccaagctttaagccacgccgattgacgctcgtggaaaagacgatttgtgtgctggtcttaccaaaggaactctgcaggccattcacgaattcatcaagggcggcagtggattcaaacaccacttctaagagttcagagtaatcacccgtgacgcagttacattccaagacgttggggatggaacgaacataaggatagaagtcttttttttgcgtcgggtcgagttggagacggataaaggctttgacatggtaatccaacttttcgtaatttatcgtcgtttggtagttcgcaatcacgccttgtttttcgaggcgattgatccgtgctgcgatggcgggggaggaaatgaaacagtgttcagaaatggtctttaatgaaatccgagcattttcttgcaacaggtttaaaattttacgatcaatttggtccatgcgatcactcctttaaattaaaagctattttaccattattatgaaataaaacaaaccggatcggggttatgagagctgatctgattaacattcttaagctgttcgaaattgcgactgtgttttgacgtcgttacttctctggataaaattagcgaaaagcgcttgagactccttattatgcttgtacatgttttcaggatgccattgcaccgccaaaacttggttgttttttttcgactcgatggcttccacgacaccgtcatcggccgtggcgaccgtgtggagggaactcgccagttcatggatggcctggtgatggcgggagttgacgtagctgcgcttactgatcagcgtggagagtaggctatcatcttggacggtcacgtgatgggtcggtaaattaccgggtgcaagctgactatgcttaagtcgcgcctgagggtcttcagacaggtcctggtataacgtgccaccgagggcgacattaatgacctgcatcccccgacaaatccccatgacggccttaccagcatcaattgcagcttttagaagggcaatttcaaacatatcgcgttttcggtaagtttcccccagctcataatgcggttcttcgttaaagaatgttggatcgacgtcaaagccgcccagcatcaggaggccgtcaaataaatcgatgtatgcgggagcatcagctggatcaatggttggtagaatgatcggaatgccgcccgatttagtaatggcctgaattgcctgataaggggcaaattcagcgtttcgctggttgatgatattagttgcctcagtgaatgtatcagcgggcaaagcgattcttggtttcaatatgtgatccccctaagagttgtgtgattggtaacggtgtgatatgtaaacttttaaattgcaagaattgtatgctaaattgctaaggatgtcaaccaaatcagaactacaagtgatataaagcccacagtgaacttttgattattaacttgagcgggattattttgaattaagacttgattacaaatccatctcttagtaaagttaataagggttaactattgcgctagtgaacattttgctgtaggaggtcatttaatggaagacgagcgccaattattcgatgcatttattaattcatatttattttcgttgaaatacttacaggattttctatcggctccggcggaaaagtacggggtttcgtttgaccagttcctgattatgcatgaaattaatcaggcccacgataatattaccttgatggagttgtcaaaggcgcaccaagtatcacgatcggcaatttcacggcagattagtgggttactggccaccaattacgtggcgcaacagactgacttagatgatcgacggcggcggattttaaaactcacggcgcaggggcgtcaagtagaagataccctattcaaagagggcctcaagaaggcccaaagtacgttaaatgtttttggggccgataaattagcccacacgctcaaatttattaatgactttactgatgaaattatggtcaaggataatgaccagttgttcgaaaaaaacaagcataagaatttaatatagtaactggtaggctagccgtggtgatccgtcgcgttgaatcgtgatgatcccacggtatttaaatccagtcgattcgatgaggtgttgcatggtgtggttttgctggtgggtgtcgattcgaaggtcgcgaaagcccagttcataggcgcgagttacgagattagagatgaacaggcggcccaaatggtgcccacgaaattgggcactgatggcaacccggtgcaaggttgcatagtgttctggcgtagtatagcggccccacgcaccatcgatcggctggtagttcgggtcgggtgtttgtaagagagcggtgtagcccgcaagttgttgatcgacaacgaaaacgtagccgatttgttgggcaatatcagcctgaatagtcgcttgattagggtgaccatcttgccactgagggatgccctgttgcgctagcagttgacgggcactttcgatgattggcatgatggcgggcacatcagttggccgggccagtcgaatataggggatggtcatgagaacacttcctttaagtgattgcaaaaattataaacccgaatgtggcgcgatacaatgctgatagaggattcttgaagggttctaactggtatttcagtcaaacttctttataataagtaacaataaaaaaggagtgatgattatcaaagtatttgtaattggtgcccatggccaaattggtcagcaccttatcaagttattagctgctcgcggtcaccaagtatttgccggggtacgcgatgtgacccagttagataaaacaacaggaatcacccctgtgacgtttgatttagaagctttgccagcaacgctcgccaccccgctaaagggaatggatgccgtcatttttacggccggttccggtgggcaaactggtgctgataagacgatgttggttgatctggatggcgctattaaaagtatgcaggccactgaagcggcgggggttgcgcggtttatcattgtgagtgccctatataccgacgatcgaagtaagtggttgggtgcaatgaagccgtactacgccgctaaatactatgcagacgaatggcttcgccaccatacgaatttagcgtatacgattattcgaccgggggggcttactaatgatcagccgattgataaagtacaacttgataccgatcaagacgttgccggaaagatcgcgagggctgatgtagcaacggttatcgcggatacgttggaaaacccgcggaccgtcaaacggaccttcaacgtcattagtggtgagaaattaatcaaaaatgcaataaatgacttataaaagtagtgtgatgtaagcgcatttatggtacaatataatcaacaaacggatatatattgaagggatgattgcttatggatcaagtatacaaaaacattttagtgccggtagacggttctaaggaagcaaaattagctttagaaaaggcggttgcggtggcaaagcgtaaccatgcccacattgatttattaaatgtgctagataccagggcagtcacctataactatgctggtatgtcagatggcagcatcacatatcagctggttaatgaatcgaaagaatatttaagcaagttagtcaaccacttgcgatcgacggatagctttaccgatgtagatatccatatccgtttgggcaaccctaagaccgtgattgcctatgattttcctaaagatcaccaggttgatttgatcatgatgggggctagcggcctttcagccatgcaacgggctgtgatggggtcagtaacgtcatttgttaaccgcaatgcgattgtggatgtgttagtcgttcggacctcagttcaaaacgaacaggttgataaataaacaataagtgattatcagaatataaagaacggtagccgagggttaccgttttttgttggggttaatgtgccaaattgtattgcgctacggtatatcctgacgagttggtggccgtttgtgcgtcagacctttccgtttcactccacatccggtcttgtttatgctaatataatatcaactcaaatttggagggatatttattttaacaattcgtaaagctgagccggacgatgccggccagatagtgccgctgatgtctttgatttatgatgagatggaattagaagagttcgagtcagttcctgacgaggacccccagcgaatgatcgaaaacgcctataaacgccgggcgctattaggatatgttgcaaccaccctggtggccgaagttgacggccaagtggtggggatggcgtttggatatccggatacgaacgaaacagccgtcaaccgtgtgtacgcacaggctgcgcaaagtattccgtccatcaaggacgtggatttttttgccgacccggaatcgtttgatgatgaattttatctcgactcgcttgccgttgacgctaactatcgtggctatgggattgccacgcgcctcatcgatgcgattgcccaacacgcccatgaactgggatatgacatgttgggcctcaatgttgacttcactaatccgggtgccgagcgtttataccgccggctagggtttgaagatgccggtaaaattatgattggtgatcaccactaccgtcacttacagatggacagcgatcgtcagattttagttcactaacgataatgtttaaatagcgtaattaggttctgttatagaatctagttacgctatttttagttattgaatagataactaaatgtttatttttacaaaatttcattttattagtttacaaatgttcagattcctgttaagcttgatctatcaaatatgaaaggggtttcacaaatgaagctttcgaacgcagaactcgcaaaatatatggatcatactcttttaaaggccgatgccactcaggaacaggttgagcaaacactggccgaggcgaagcagtatcatactgcctcaatctgcattaatccttactgggtcccgctcgcaactcaagtactgaaggataccgacgtcaatgtttgcacggtcattggattcccactgggggccacgacgacggcaaccaaggtttttgaggcacaagaagcaattgacaacggggctgttgaagtcgatatggtgattaatatcggtgaattaaagcagcatcatgatgccgctgttgaagcggacattaaggctgtggcggatgcggcgcatgcgaaacatgctattttgaaagtgataattgaaaccgctttattaacggacgaagaaaaagtacgggcgtgtgaactctctcaaaaggccgggacggactttgtcaaaacatcgactgggttctcaacggcgggagccaaggcagcggacgtgaagttaatgcgcgaaactgtcgggcccgatttaggcgtcaaagcgtctggcggcattcatagtgctgaggatgcctacgccatgattaatgccggtgcgactcgcctaggggtgagtgccagtgtcgccattttaaaggataacgagcaatagaattaaagggagtggaatagcatgaaatacaaacgcatctttggaatcgtgttggattcagttggaacgggggcagcgcccgatgctgctaagtttggcgatgtgggctcggataccctcggccacgtgggtgacttttacgatggaaaattggcgattcctaatttacaaaaactgggaatttctaatctccgcgatcaaccgattaagggcgtcgcaccggcagaaaagccattagcatactttggtaagatgcaggaggtttcagctggtaaagatagtatggatggtcattgggaaatgatgggattacccgtcaagcacgcgttggcattattcccagacggattcccagatgaaattattgacaagctcaaagccttttctgggcgtgatgtgattgtcaataaaccctattcagggacggacgtcatccatgattacggcgaagagcaaatgaagaccggtgccttgattgtgtatacatcaggggattcggttctccaaattgcggcccacgaagatgtgattccactaactgaactctacaagatctgcgactatgctcggagtctcgtgaatgagccaccatacgtggtcggccggattattgctcggccatatgtggggcctgacaaggatcactttacccggactgcgaaccggaaggacttcaccttggaaccgactgggaagacggacatggatcgcctacaagatgctgggtacgaggtaattggcattgggaagatcaatgatattttctcaggccacggcattaccagaggattccataatgaaagtaaccatgatggcatgaatcacgttcttaacaacatgaaggacgattttaccggtttttcattcactaatttagtcgattttgatgcgatgtatggtcaccgccgtaatccgaagggctttggcgctgcattaatggaatttgatcaacagttaggtgaagtgttggctaatttgaaagatgatgatctgctactcattacggctgatcatggaaatgatcctggtttccgtgggaccgaccatacccgtgagtttgtcccattgctggcttattcaccaagctttactcaggtcggacaatcattaggaattcggagtccgttctctgattttggggccacaattttagataactttggcgttaaaaacgtggttggaacaagcttcttagacgaattgaaatagtcattaaacaaggaggaagaacttatgagtactcacattggtgccgaacccggccaaattgcaaagaccgtcttatttccaggggacccgctgcgggccaagtttattgctgaaaattttctggatgatgttgttcaatacaacacagtacggaacatgttcggttataccggtaagtataagggtcacctgatctcagttcagggaagtggaatgggaattccgtcactctcaatttatgcaaccgagctcatcaagttttatggtgttcaaacgatcattcgggttggtaccgccggcggaatgcgcgaagatgtgaaaattggggatgttatcctcggtcagggatcgacgacggattccgccgttacagccaatacctttggtgccggtatttactacgccccactgtccaattttgaattattggatagtgcttaccatgtggctcaggagatgaacgtacccatacgcgtcggcaatatctttgcggccgatcgtttctataacgatgagatcgacatgaagaagctagccgattatggttgtgtggcgaccgaaatggagtctgcgggcttattcttgattggtgctaagtacaatatcaagacgctcagtattctgacatgtagcgacaacctagtgacgggggaagccgcttcagctaaggaacgggaacaatcctttaccgacatgatgaaagtatcgttagaaactggcattcgtgcataagtttccattgagtgggaaccatgaccattttaatcatttcgcccgagggttataattaacgatggtcaaatccaggcaaagtaggtcatgcaattgaacactcaaaatagtaaaattcaacagagcattgaagtggcacacctgtattacgagcaagaactcagtcaaaatcaaattgccgcacagcttaatatttcacggccaacggtctcacgattgcttaaaagtgccaaggaacaaggtctggtgcgcatccaaattatggatcccttggaaagtgccgaagttttggagcagcgaattagtgagaagtacggcgtgggtgaagtgcatgtcgttcccattccgatggtgaatagtgccgcagctttggataccgttggcaactatgcggcgcactacctggaagacacagtaactgataatgatattatcggaatcggttggggcaaaaccattcataaaattgccagttatttggatgttaatgaagaggttaaaaatgttcaggtcgttcaattaaagggaagtgtctcgcattcaaaacagcacacctatgcttacgaaagtattaattcgtttgccgcggcttttcgcagtatcccacagtacttgccattgccagtgatttttgaacagcagattacgaaagacttagttgaacaggaacgccatattcagtatttaatggatctgggacgaaaggccaacattgcggtatttaccgtgggaacggttcgtgacagtgccctagtatttcagctcgactttttctccgaagaagaaatgcagtatctcaaacagcatgccgtcggggacgtcttttctcggtttattgatcaaaatggtgccattgtttcggataaaatcgaccgccggacaattggtattcaattagatgatttgcggcaaaaggaacatgcgattttggtggcggctgggagtgccaaagtaccggccgtggctgctgcattacggggcgactacgccaacacgctaatcattgatcagcatgcagctcaagagttggtggataaccaacttgattgagaccgtaattgaataggtttggtgcacgttggccgaatctattttttatttttaacaattgaaaccggttacaaaaatgggggctattataatgagaatgttagatatcattgatacgaagcgcaacggacacgagctaactgacgagcaaattgatttctttattagtggcgtggttgatggctcaattgaagactaccaaattagtgctttgctgatggcgatttattttcaggggatgaccgctcccgaacaaactaagttgacgatggcgatgttgaactcgggtgatcggctggatttatccgcgattgacgggataaaagtggacaagcactctactggtggtgtaggggataaaacaagcctccctctagccgcaatggtggcagcattaggtattccggtaccaatgatttctggtcggggactggggcatactcgcgggacgctggacaagcttgaggccattcccggatatcgggtggcattatccgaaacggaattcatccatcaggtccaaacaattggactagcgattgtgggtgcgaccggagagattgcaccggcagacgcccgaatttatggattacgcgacgtgacggatacggtagactcgatcccattgattgccagttcaattctaagcaagaaactggcttctggaacggacgctttggttatcgatgtgaagacgggggccggcgcatttatgcgcgaagaacgagacgcacagaaacttgcccatgcattggtggagattgccaatcaagcgggggtgaagagtatggcgattatttcggatatgaatcagccactcggcaataagatcggcaattcacttgagattgaagaatcgattgacgttttgaaaggcaagggtccggctgatctggttgatttggtgctcacgctgggatcacagatggtggtgttggctaatcaggcaccagatcttgaaacggcccggctgatgctagaacaaacgattaaggatggatcggcactggagaagtttaagcagatgattatcatgcaagatggtgatccggcggtgattgatgattatggggtgatgccccaagcacagtatcatattccgattgtggccgagcgtgatggtattgtgactaagatcgctgcggatgaaatgggaattgctagtatgcggcttggtggtggacgttcagccaaggatgatcagctcgactatgcggtgggactggtgttgcaccataaagttggtgacaaggtgcgacaaggggaaccacttgtgacggtccacagcaatcaaaaagaaattgatggtgttgaaaaacttattcggaccaattttaccattggtgatcaagcaccaacgatgaaactaattcacgaagtaatcaccaaataaatacaaaaaagccttatcaaaccgaagtttgataaggctttttgaatacgcggtgcgtatcctattgttcttcgtaccatgaatagtgaaagttacctgggcggtcaacacgttcgtatgtgtgggcaccgaagtaatcacgttgtgcttggagcaagttagcaggaagcacttctgcacggtatgagtcgtagtatgtgacagcagcactcaagctaggaactggaacaccagccttgatagctaaagcaacaacttcacgagtagcactttggtacttagctgaaatgtccttgaagtagtcatctaacaagaggttagttaacttaggatccttttcaaaggcatcagtaatggtttgaaggaattgagcacggataatgcagccttcacgccagatttgagctaattgaccaaattggaggttccaatcgtattcttctgaagcaaaacgtaattgttcgaatccttgagcatagctcatgatcttaccaaagaataatgcttggcgaaccttttcaacgattgtagacttgtcaaattcaaccttttcagttgggccggcaagaaccttgcttgcagccacacgttcgtccttcaacattgagatgtaacgagcgtaaactgattcagtaataactgattgaggaacaccgattgcaagggcatcttctgatgaccacttaccagttcctttgttagcaccacgatccaagatagcgtcgacgattggcaagttcttgtcgtcacctaagtcatctttacgagttaagatgtcagcagtgatttcaacaaggtaactgtcaagttcgccttcgttccattctttgaatgtgtcggctaattcatccattgaaaggccagcaacgttccgtaaaatgttgtagctttcatcgattaattcttcgtcaccatattcgataccgttgtggaccatcttaacgtagtggccggcaccgttaggaccgatgtatgaaacacatggcttgccatcttcagctttagcagcgatttgttccaagataggagcaaccaagtcataagcttctttttggccacctggcatcaatgaaggaccttgaagggcacctaattcaccaccagaaacgcccattccgatgaagttaattcctgacttgtccaacttagcgttacgagccattgtgtcgtggaagtttgtgttcccaccatcaattaacacgtcacccttgtcaagcaatggaagtaattcgtcaatcacggcatcagttggcttaccagccttaaccatcatcaaaatacgacgtggtgtttcaagtgagttgacaaaatcttcaacagtaaaactaggaaccaatttcttttcagaatggtccttcatcatattatcggtttttgcacgggaacggttgtaaacaccaacagtgaatccacggctttcaatgttcaaagccaagttcttacccataacggccagaccgacaacgccaatttgtgctttttgatcagacatgtgctaactctccttcgttttaattaaagtgttttcatgactatagtaccattattttctaaaacatcaaactgtaaatgcaaaaaaagcaaaataaagttacaaatatcacaatgcacgcatattgtaactcattttgcttcgataattcaaattattggttcaagcgatagacccatgagcgcccatcacgctgcaacaattcgtctgaggcagctggtcccatggagccgggaacgtagtttggaaaacgtggttcttcaatgtcccaaagtttccgaatcgcatcgacaaatttccaagcgtaggccacttcggtccatgaggcaaagttcgtactattaccttcaagggtgtcgtgcaaaaggcgttcgtagggttctggcacttctttttctttgtcagcatcttggtagaagtcaaggttgatgggttctgtttcaaagccttgaccggtactcttagcgttgacccgcagtgaaaagcctgattgtggttcaacataaatcgtcaaaacattggatgacaaagcggcatcttgattttgtgggaaagcaaagatatcgatcaatggctttttgaagacaacatcaatgcgggtaaatttatcggctaatttcttaccagtccggatgtagaagggaacacctgaccaacggtaattatcaaatagtaatttgccggcaacgaaggtctcggtggttgatccttcagggactccgtcttcatcacggtaggcgttgctattgtcactggcatcgtactgaccacggacaaagttagtagcagcttcggtcgggctatagacgcggagactccgaagggccttcactttttcaacccgcacatcatcgtcggtaaaggcgacgggttgttccatcgctaactggcttacgatttggagaatgtgattttgcaccatgtcacgaagggcaccagatgtatcataataggaagcacgttcctcaacacccagtttttcacttaacgtaatttggatattatcaatgtaacgattgttccacattgattcaaaaatagtattgccaaagcgtagtgcttcgatgttttgaatcatttctttaccaaggtaatgatcaatccggtagatttgatcttcttcaaatgaagcagttagggcatcatttaattccttagcagacttgtagtcacgaccgaatggtttttcgatgactaatcggttgtacccttcgtcagtaattaagccttctgatttaaggtttaatgcaatttggctgaagaacgaaggagccattgagaagtagaacaggcggttacccaacgcatcatattgtttgttcagcttggtaatcaaagcatccagtgcggcatagtgcggcttatcagtgacatcatgtgcaatatagtagaaatgactcacaaatttagcggcttggccggctttttcttctttaattcccttaattgcttcagcaacaattccttgaaactgatcgtcggaccactttgcccgggaagtcccgataacagcgaaatgttccttgaggtagcccttttggtaaagcttaaacaacgatggatatagtttacgtttggcgagatcacctgatgcgccaaaaaatgtaaatacggccttgttttcttttgtcaaaactttcactccttttggtcaatggtagaacactaatctaacaaccacgattatatactctcttgtgacattgtgcacgccctaaaagacagcgttttcagtgattaaccccattaaaggaaatctacggtaattgggtaggattaacgaaagtaaaaatggtggttgtttagtaaagttttaacgaattggtatagatcgttaattttctaaaactttttttcggaattaaagacgaatttgcgtttttcgctccatatcccagctaaggagaacaaaatagtgattagaatcatgactaggagactggttccccaagagtgagtgaccgattgaagcgaacctgttaaaaccggtccaacggcagcgatcaagtatcccaaggattgtgccattccggaaagactgctagtttcttgagacgtcttggttttgagtccaaagagtgtcatcaagagggagaaggttgcggaagtcgcgaggcctaaaatgatatttaagaccacaaagtaggttaccgaatgaatcgggagcatgagtcccaaaagaccgataatggtggcggcaccggccccaaagacgatcggcttgcggttggccatcttttcggcgagaacggggattacaaacgatgggggaattgaagccagttggaataaaccggctaagaggctggcggtattggccgaaataccggcattgattgcaatcgtggggagccacgcaatcagtgtgtagaacacaaatgaggatagtccaaagtagagtagcagtaaccaagcggttttattggtccagggattgggggccgtcccctgctcggttggggtttcccgtttgttaaagcgaatattgggcagccagagaactaatgtgatcagtgccagtaacgttagaatgataacgacaaactgccagttaatcgcctgagcgagtggggaactaattccggcgccgatggaactaaaagtggccattgaaagaatgtacaagctggtcatggtcccaattttagtggggagattatctgtaatcagtgcgggcagcaagacgttgatgaaggtcagcgccacaccgacaagtaaggtcccgataaataagctcgaaatattgaaaatccgaagatatgatccggctgtcaggagaatcatggtgagggcaatcgtgacttcattgcccagtttggcactgatttttggaacaaagggtgaaatgagcccaaaacagattagggggagcgtcgttaaaattcctaaactagttgatttaaccccaatcccgtcagcaatactgttcagcatcgatggaattgaagtaatgggggttctcatacaagcgcccagaagaaaaatacctaaaattaaaaatgtgctatgcttgcgatttttcaaacaaacacttcctttcttgactgttaaatgacgaaaaatagatggttaagaataattgatttaatcattgttaaaacgttttacctgatcgacgaatggaattaaatatttccaattcgtattataacaaaaataatttaatcttgggaagcaggtttaaacatttgggtggctgagacagcattttgccagccacgatacagacgatggcgtttggattcagccattgctggtttaaatagttttccatcgtcaaggacatcccgtaattcatccgtattatgccagtagtcaaccgctagtcccgctaagaaagcagcccccaacgcggtggtttcttcttcggctgcacgatcgacttcggtatttaaaatatcggcctgaaattgcataagataggtgtttcgtgaggccccaccatcggcttttaaggtcgggatggagagcccggtatcagttttcatggtctcaataacatccttagtttggtacgcgatggactgtaaggtggccttgatgaagtcgttacggttagttccccgtgtgagcccaaagaccgaaccccgggcttcggggtcccagtagggcgcgccgagtccagaaaacgcgggcaccacatacacctcgtcttcgttagttgaagctaaggcggcctctcgcgattcaaaggcgttgttaatcatgcccaaattatcttggagccaatcaacggcctgcccagccacgaagatacttccttcgagggcgtaggtgactttgccattaatactgtaagcaatcgtcgtgatgaggttattttgggatagttgcggctgatcaccggtgttcatcacaataaaggaaccagggccgtaagtgtttttaacggttcccttttcaaagccggcctggccgaacaaggcggcctgttggtcaccggcaattcccgcaatcggcacctcagcaccgtaaaattgaaatgttttcgttgtcgcataaatttcggaactggaacggacctcggggagcattgcggcaggaatgttaaggaggcttaaaagttctgaatcccattgtaatgtgtgaatattgaacagcattgtccggcttgcattcgagtagtcagtaacgtgaactgcaccttccgatagcttccaagcaatccatgagtcgatggtcccgaagagcagttccccggcttcagcgcgttcttgggccccagcaacgtgatcgagaatccagcggattttggtggctgagaaatagggattaacgtttaatccagttttgtcacggaattgttcgttatgaccactggcgatcaattggcgggcgattttggcggactgctgagactgccaaccaatcgcatgatagatgggttcgccggtttgacggtcccaaacaacggtggtttcacgttgattagtaatgccgattgccgcaatgttttgcggctgaatgctagtattgataagaattgtcgcgatgacttgttgcaccgcgttccaaatttcgtttgcgtcgtgttccatccaccctgactgtggtgaaaaacttcgcagtggccgctcaatttcagcgaccttgaagccggtctggttaaataacattgcccgggtagtcaaagtgccttggtcaatggcgagaatatacttacttggtgattttaatgccatgaattgctcctccaaaacataactagtaagcctattttaacagtaattgatggcgttttcaaaagatgtggtccttaatttgctaaaactagtttgacgcatccacgaaatacaaatataattaatacgttagtgtatcggaggaatgaatggatgacagcaaaattgtatccgtatatcacgtttacaaacgcgaaagaggcgttagcgtactatcaagaaatttttggtgcaaccgatgtttttcgggagccagtatcagaagaccaggccgagtattacggactgctcgatactaatttgactgacaccacgtttcatggcggattcagtgttgctgggacacaggtgttgtgctctgatgcgtttatggccgatccccagccatcatcaattatctcgatcctgttggattttgatgaggatgatgctgacgatgtacgtacagcccaggacttgttcaagaaagtgaccgactcagaaacggttcgggtgaccctgccatatagtacccaaacctttggcggtaaaatggcgcagtttgttgatcgttacggaattacgtggattatccgggtcgacgaacgggaatcgtagcgttattaaggagttttatgaaaccagcaacagaagtgaaaatgaagtgggttgtcctcgcgagtttttttaacaacgcgggggcagcttttttatggccgctaactacggtctacatgcataactacttacaccaatccttagccacggcgggactggtcttgttcatcatgtcatgtgcgatgatcgcgggaaactatctcggcgggattttatttgatcattggcacccctataaaaccgccattgcgtcggtcagcattgcgacgcttgccgtgataacccttattttttggcatagctggccggtatttgccgttttattggtcattgtcggttttggggatggcgcgaatattacggtggttaacgcctacgccgcttcgatcaagggacaaagtgcgcgctacgtatttaatattttatacatggcgttgaacgtcggcgtcgtcgtgggtaccttgctagtcggctttttactcgatctaggggtaacggtcgttttcgcggtgaccagcgtgtgttacatggccttccttgtgttaaccgtgctgacgtttaacgtgacggttaaacgcacagaggtcgaaaaagtgaccgccacggtcgccagtaaggcccaccatgaaaagttggtgtggttaatttgtctcgtgaccaccacggcgtacctcagctatgtcttatgggaaagcgtcatggcggtccatctcaccaacatgcatattccgttttatgcgtacagcttgctatggacgatgaacgggatcctgatcattgttggtcagccgtttgtcaataagctagcgccctacgtgaaactgcgccggcaaattgaaattggcatgttgatctttgccacctcgtttttcctattgatctttgccaaaacgttttcgttttttatcgtggatttcttgattttgaccgttggtgagatgctgggattaccagcaatgccggcgttaattgacgaaatcacggaccccagtcaaacaggaaagtatcagggcatggtgaacatgtcaatgtcgattggacgggccattgggccgctttacgggggcctgattattgatcatgcgaactactcgatcctatttttgtcggtgacggtaatgatggtggttagtctgatcgcgatgagtgctcgggcacggattgaaaaccaatagattaagcaacggcgcggccaatttgggctgcgttttttttagatacctttattgtgcgtggttgctttcgctaatcaaagatcatatgattggagacaaacgaagtaatgaggcgaggagaatgagtatgttaaaaatgggatttcgatggttcggcgcccaagatgatccgattacactttctcaaattcggcagattccagggacgactcaggtagtaggggccctatatgatgtcccggtgggagaagtgtggccgttggagaagattcaggcgctaaaaaagcaggtgaccgacgctagtctgagcctggaagtgatcgagagcgttaatattcatgatgatattaagattggcaagccgagtcgggatcgctatattgaaaattatcaacaaacgattcggaacttagccaagtgtggcatcaaggtcatttgttataactttatgccgatttttgactggattcgcacggatcttgcctatccactcccagatgggtcaacggtcatgaggtttgagcatcagcaagtggaaaagtcgccggaagaaatgattgcgacggtgcaaaataatgccaatggatttgaattgcccgggtgggaaccggaacggttggcgcgggtacagcgattgtttacggattatcgagatgtggatgcggccaagttgcgggcaaacttaaagtactttttggatgcgattattccagtttgtgaggaatgtgatgtaaaaatggccatgcatccggacgatccaccaatgtctttgtttggattgccacgaatttataagaatcgggatgacatgcaacaaattttagcaatgcatgacagtccgtataacggattgacgatttgtacggggagcctcggtgaaaatcctgcgaatgacttacccgccattattcgagaatttgtttctcgggaccgagtgccattcatgcatgttcgtaacattaagtttaccaatgagcagggagactttcacgagtcggcccatctgtcgcgtgagggatcactggatatggttgcgattatgcaggcgctgcatgaaaaacattttgacgggtacattcggccagatcacggtcgcaatatttggggtgaaactgggcgtcccgggtatggactgtatgatcgggcactgggaattgcctatctgaatggcatttgggaaacccttgatcatgaaaagtaaaaaagtggtatgacaatttctgtcataccacttttgttactttcctggagcgatatcgtctgtattgtaaggcgaagggtttaatgcaaattggtcatcggcagggatggcggattcgttgatcggttgatctgatttgtggagggtcacggtaccccatgcgggcaccgtcacgcgttgccatcgagcaccatcaccgtttattgtcacggcagcttgaataggggtgccagttggattgtacaaatgagcggcgatagcgccatcggaagcgaggaaggcgacggagccaagaccgccggtgaagccatcgggggtgtagtttgaagattgaatgagctgcgatccgacggccacgtcttggccgaagttacgtagcataaagtactcgaggcttcgctggacttttcccgtcgtatggtcaatggtgaccacaccacggcgaccggtagaatctgccgcgttggggagcccccgttcatctagcgcaaggttccagagggtcaccatattcagcccattgcgaacgagccagttaccgatgatgccgaacatgatgtgagcggcattttcgggcgtttcttccatcatgcagcggcgttccgtcatgattaatgaccagttgggaaaggcccggttggcgtgatagaggttttcgtagggcccagagtacgtatgcacagcgagcccatcaaaggccatggcctgttcgaagggaacgtcgtcggtaatcggtttatcgagggcgtggaaactatcgtctaataagtacattttagtatccgggaagctctgattcagtgctggtcggagatagtggtagccaaaatcggctagttcggacactgtccagatcatggccggccagtgagcggcgtttgaaggttcattttgaatcgtaaccccgtagattgggatgcccaacttttggtaggcctcgatgtagcgcacgaagtagcgggcgtagatggcttcgaaccggttttcatcggtgtaaccatttcccgtaaactcgccaaagcgaaggcgaccaccaaacgtcagatggccggtgtccttcatccaagccggtgctgaccatggggaagcaatgattttaaccgccggattaattcttagaatttcttgaaggacgggaacaatgtgtttgagatccttggtggcatcaggtgcaccgggcgttccttcaccaatcgaaaagtgttctaatttattgtcgtgttcaccataggggacatcatcgtaggtgtagtagtcctgactttgaaaatcacaggatcctaacggcacccggatacttgaaaaaccaccttgagatggatcaaacagttccgtgagcagtgcatgacgttgcgcggcactctgattttcccacaggagttttgcggcggagtcggtaatcgcagcaccggcgccaagccaatcctgttgtttaaccgtcggatcgatgatgatttttgtggcctcacccggatcgtcgacgaccgctggaattgtgagcggtgtgcggcgttgcgtgagatccccagaagtgacggtccaaaattcgtgttgataagtcttaaacaaatgagtcagccccttttttgattctggatttcatcaaggtaatgagtaatgatcgttacacaaggtgatataccagttaattcatgaatccgctttcaatatagcataaaaatcgaattcgtcaaatagtgtgcgatcgttggacagttataagcaaaagtaaattggtaagtaacttgctttttgccgacgtaattaagttagttgttaatttaaactaattctatttaataagatcataaaaatagtcgttaaacgtatctataaaaatacggttaacgactatttttagattaatatcctttagttagatcaacttggtttgttttaaaggtcccatcggttaagtactgcttcaagttaggcaaaaacagtgctgcttgggctttcttgaagtgggtaatgacgccggtattgtggggcgtaatgagcgtatttggtaagtgccaaaaaggactgtcggcaggcaagggttcggtttcaaagacgtccaatgctgcgtgttgaatgagaccactgttaatcccatcaatgacgctggtggaatcaacaactggtccgcgaccgacattgacaaataagaagaggtgcgcaaattggtcgaataactcatgattgaaaaagtgatgggtggtgtcagtcagcggcatcacgtttacgacgacatcggcttgccagacgcgactatccaagctttgaatgctaatggtatcgtcaaagtattcagcaggatggccggttgtgttgaccccaatcgtgtaacccccgaaggactttagtaaccgtgcgatttgttggccaatgtgaccggtcccaaaaatgacgtatttaaagtcatcaatcacgtggggtgtttgatcatcatggtgagcccaatgctgtttttgttggttgtggcttgcaatgtccaatccacggacaaaatagaggattgaagcgagaacggactgactaattgcttgggcatgaataccggccgcattagtcagcttaatcccccgttgtgcaaaggtggccagggggagtgagtcaaccccggcagagatggcatgaacccattctaactgggactgaggcgcggcaagcagttgctcaccaatggcggccttccagccatacatgatgttgatagcgctgggcgcaactcggtggttgaggtcatcaagctcgactaggttaacccccgttgctgcaaattgtgcgcgctgagcatccttaataggtgaaacgataagtaaatttttcgtagacaatcacatcacatcctcgattaaattggctttattttaaatgaaatgatcgagaaaagccacctaaagcgcccaatttaacggttatttacgcgagtgagcaaaaaagtgtaaaaaaactttttttccaaataggacatgcgagaaaccgcttgcagcaacgcttgagcctgtctcaacagtttttgaacaaaaaatgttaccgtgtgcatttttagaacgcgttgacaacgctttcaaaacgaattattatcctagtgtactgaatatctgatataccacttgacgggtatttgaagtttgaattctagtgcaaaccagtaagacgagacggtatggttgtttttgacaaatggaggagattcaatgaaataatccgatctggggttcgttattttatggattcatagtttgttgcaatttttcagattatatttttataaatcataggaagtgaagaatatggataaattacaaaaaacgataacagttaaagctgcaccgtttggcattaaagataagatcggttacatgttcggggatattggaaataacttctcatttaacgtggttaactcgttcttaatgattttctacacgaacgttcttggtttgactggggcccaagtcgggatcctgttcattattgcccggttcgttgatgcgttcgctgatattactgttggtcgtttagttgataacagtaagttacacaagattggtcggttcaagccttggatgaaccggatgcgttacccactcttgatttcattggttctgttattcgtgccaatcgtttcaagttgggccttaccattccggttagtatgggttttcgcaacctatcttgcatgggggatcttctactcatcagttaacatcccttacggttcaatggcctcagctattagttcagaccctaacgacaagacgtcattatcaacgttccgtgccatgggttctgctttagggagtgcgattactagttacatcatcccaatgttcatctacatcggcgcttcacaaaagatttcaggaagccgcttcttctgggtggttgttgcctgcgccgtcttgggctggatttgctaccaattgaccacacacatgaccacagaacgtgtgcggactgaaaagagcgaacctgttcctttgggtcgcgtggttaaaggcctgtttgaaaaccgtgcccttttgatcttggttttagttgatatcgtgatcgttattaaccaaaacttgtcaggaacattgatctcatacttgttcaacgattacttcatgaacaagactgctatgtcaattgccttgatctttaactttgctaccgttattttattagcaccattcagtaacttcttaactcgtcgttttggtcgtaaggaaacctctatcgttgccttaatcatcggggccttaatctacggaactttgatgattgtgcacacccatagtgctggtttctacctagttatgttattctttggttcacttggtgccggaatgttcaacctgatggtttgggccttcatcaccgatgttattgataaccacgaagtgatcactggggtccgtgaagatgggatcgtttatggtgtgaactcattcgctcgtaaggttgcccaagcaatcgccggtggatttggtggtttcatgttaacctttattggttaccaatcatcaactggtggtggtgccattcaaacgactgccgttgttgacaagatctacatgttagctactggtgttccaactgtatgtttggctgccgccgcattgatcttgctcttcttctacccattgagcaaaaagcgtgtgaacgaaaacgctgctaagcttgaaaaactgcacaatgccaatgctgctgaagaagcttcagaagaaaaataataactaaaaaatgaatgaaaaaaccgatcggtatttattatctaaggtttcttcacgtcaaaaagcgtgattcaacaaattaggtaaggtgctcgttttactgaaggttttcggtaaacgggcacttcacttttaccagaccactcacacacagaaagtagggaaatccatgaagttaagtacaaaattgttagagattgttgatcatgacgatttcttggaattaaaaaccaacggtgcgcagtttagagtctatctgttggatgaaaacatcattagaatgcgcggcacgtttgatgatgaatttgccccagaagagtcttacgcactggcgaaaacggcttgggatgaccagactgacgagttattaggcgatgaaagaacccgggttcaagcattaccaacgcacttgcaaaccacggatttcggttacgcggtttcgaccggcaagtacacgttgaacatttacacagaaccattcatgttcgaaattgtcgatcaaaatgggaatgtggtgcataaagacttggcaaaacgcgcctttgcacaagatgaattaggacgttccttccattatagtgcgatgggtgatcataattacttctacggctttggtgaaaagtccggtgaattaaataagtacaagcgccgcatgcggatgcataataccgactcactcggttggaacgccgctaagtcggatccgctctacaagatgattccgttttatattgatttaaatggtgacaacaacgttgctagtggtttattttacaataactcgtatgattccgtttttgatatggatagcgagcatagtaactattggttgcgctacagctacttccagtgtgacggtggcgatttagacgtcttctttatcggtggtcccacgattaaagatgttgtggaacactacaccgacctcactggtaagagtgcaatgacgcccctggcttcgttggggtacatgggatcaacgatgtactatacggaactggatgaacatgctgacgatgcgatcctagatttcgtggatacctgcaaaaagtatgggattccatgtgatggcttcttcctttcctctggttacactagcggtcaggacggcaagcgctacgtctttaactggaataagacgcgtttcccagatccaaagcagtttgtggcagagctaaagaaacgcggcgtcctactgtcaccaaacatcaagcccggcctgttgacaacgaatcctttgaccgatgattttgaagcacacgacgcctttgttaagacgccggatggtagtgcctcacaacttgatcagtactggggtggccccgcgcacttcgttgactttactagtgaagccggtcgtcaggaatgggccgatcacatgacggaatcgttattgtcgattggaattacatcattgtggaacgataataatgaatatgaaattaacgataacgaggcccaggtcgacgccgaaggactcaagaagaagattggcgccgtaaaaccaattatgtcgaccatgatggcaaagacggccaaggatgcgttgcacaactatgaccctaatattcggccgtacctcactaaccgagcagggtttgccgggattcaacgatacgcgcagacctgggctggagataacgggacgagttggacaaacgtgaaatataatgtgccgacgatccttggaatgggcctttcgggggttgccaaccaaggatgcgacatcggtggatttgatggtcccgcacccgaaccagaactctttgttcgctgggttcaaaatggggtcttccaaccgcggttctcgattcattcctcgaatacggacaacacagttacggaaccatggatgtatcctgaatacacacaatacattcgtgaagcgattaaattacggtataccttaattccatacttctactcactgttgtttgaagcttcgacgaagggctcaccgattatgcggccactcgtttacgagttccaagatgatcccaaggttgcggaagaaagttttgagttcatgcttggcccatcgctattggtagccaatgtcttggacaagggacagaccgtcaaggatgtttacctgccagctggtgcatcgtggtacgaattaaagacctcgaaatactatgagggtggtcaaacaattcatattccggtggacatttcatcagtgcccctcttcctgagaacggggagcattgtcccgcgtagtccggaagtacaaaacttgcataacgatccaatcgataagttgaacctattgattgagccaagcacggcaacgagctttacggtctacgaagatgatggtcggacgaatgattatcaacaaggcgaattcttaacaaccacctatgcggttacgcccgctgaaagtggggtcactattgatgtgacgaacaagggtgattacaagacccaggttgaaaagatggtcttatcagtaatctgtccgaaggtggcgccatttagcattgcgattgatggacaagccgtaccacagttcttgaatttcgataagttcaccaatgcggcggaaggctggtactttaacggcgaaaaccgacaagtcgaaatccgatacgccaacaagaaagtggcccagtaccaagttcaaattagctttagtgtcaaggacctcatttcaatttaggtgtcacattcaactaagatgattcaaaaattaaaattaatttatgcaaaggggaacgatatcaatgagtttactagatcaagatttcttgttaacaaatgaaatgggtaagaagctgtttcacgaccatgccgaaaagatgccgatcatcgattaccactgtcatttaaatccaaaggaaatttatgagaacaaaaactatccgaacttaagccggatttggatcaacgatggcacgtttggtgaccactataagtggcgcttaatgcgggccaacggggttgacgaagaattcattaccggtgacggcgatgaatatcaaaaattggtagaatgggctggcaccattgaaaaggccattggtaacccactttacgaatggacccatttggaactccaacggttcttcggtatttcagaaccattcactaagaaaaacgccaagatggtttgggacaaggccaacgccttactcgccactgacgacttcaagccacggaacctcatcaaaaattcaaacgtgaaggctgtctgcacgactgacgatcccgcctctgatttgaagtatcacgttttgttgaagaaggaagaagccgctaacggctttaaagttttgccagctatgcggccagacaaggccttcaacattgctgctgacacatacggagattacctgaaggaattaggaacggctgcgggtgtcgaaattactgacttcccatcattgattgccgccttcgaacaacgcttcgaattctttaatagcttgggtggtcgtttatcagatcacggattaaatacattccactttgttaaagtttcagatgctgaattagcagcaatctttgacaaggggcggaacaatgaagccttggatgcccatgaaatcgatgcctactcgaccgctttgatcgaagctttgatgcggctaaaccacaagtttgactggacgatgcagttccacgtcaatgcggtgcggaatgctaaccgaccaatgtttaagaagctgggtgcggatactggtttcgattcaatggggacacaacctgatattgccggccagctggtcgatctattgacggacatgcaagacgaagacaatattccacggacgatcttgtactcacttaatccaaatgactggatgcagctagcaacggggatgggcgacttctatgccggcggtgtgacccagaagttgcaactcggatgcgcatggtggtttaacgatacccgtgaagggatgcaagaacaactgcgggtaatggctgaacaaagcctattagctaactttgtcggaatgttaaccgattctcggagtttcctttcgtatccacgccatgaatacttccgtcgggtgctctgtgactacattggtggcctcgttgaacgaagccaagtaccaaatgacgaagactatcttggtcaaattgtggaagacatttcatacaataatgcgtacaactactttggtttctttaaagaacaataattattagtaactgtcctatcagcagttatgaatccggagaaaagggttgggaaaaattcccagcccttttcgagttaatacctcgcatcgcatttctgattcgcgtgtagctgcgtcaaggcgacgattgtgaggcagaactagggaaaagggggaagacaatgcagattaacattctaacgcaccatccgtttgaagcactgcatcaaaatgcaactaaaatcattcaagctgcgattgatcgctgttttgcggccggtggtggtgaggtggtgattcccggtgcgggcacctatatgattgatggcattcaattaaaaagccacgttacgctacggctggaaacgggagccgttctcaaggggaccggggatgaaacgcgctacattaaacgcccgggacctttcgaactcatcaagaatcaaacaccgattaccggattaattacggcgaccggggcgacggatattgcgattgtcggtacaggcacaattgatggacattatgaagcgtttatttacccacatcagggaaacgaacaacatctgaagttttaccattatccgcggcccatgacggtgtatctggaagcctgtacccatgtcaaaataagtggtgtcaccattcagaatgcaccgttttggacagttcatctggtgggttgtgaggacacggagattgacgcgattaagattcataacgaaatgcggatgcccaacaccgatggtattgatgtggatcggagtaagcatactaagattcacgattgtgagattgtaacgggcgacgatgcgatctgcccgaagtgtacggaagaaactgcacggtatggggattgcacggacttaaccgtgacccggtgcacgctaatcacccgtagttccgccgttaagtttgggagtagtagctttggtaattttgaaaattgccagtttagtgatttagtcattcgcgatacgaaccgcggcattgcctttcaattacgtgatccaggtagtgcgcgtcatatttcgtttcgcaatatttcaattaagacgaagacgttcactaaagaatggtggggctcaggtgagccgatttacgtgaccttggccccgcgggaccgagcaacggatttaaccggtcaggtaatcgaagcaattcaatttgaaaatgtgacttgtgaggccggaaatggcatatttgtgtatgccgatggtggaatcgtccgtgatctgacgttcaaaaatgttaaactagcattaacgagaccatttagcacgaccacgcagtttgatttacggccgaatgaggttccagaaaccgtgacggctgaccatatcggtctgaacgttgattcaacgagtcacgtcacctgtgaggacgttactttaaccgattgtgatggtgcgaagatccaatattaacgaatggaggaatggcagttgaagcaaacagtattgttaggtggttacacacgaaaaggtggacaaggaatttacagtgcccacttcgatgatgaaacgggcactttgacaacgccccagccatactttacggcgttagggtcaccaacttatttagctatctcgcagcgtcaagtgatgtatgcgattgatggggatggtgatcaaggtgggattgcggcaatcgatatgagtggggcacacccccgattgatcaataccgcattgaaacccggcagttcgccagcccatgtcagcttggacgaacagcgccagcttgtctttgccagcaactatcatgctggtcggttgaacgtgtacaagattggcgcggacggggcgattaccgaaacggacgaggttcaacacgatggtcgtggcccgcggcccgagcaggaatctagtcatgtgcactttgccagtttgacaccggataagcggttggttgccatcgaccttggcaacgacagaatttatacctacgatgtcacggatgatggcaaattgaatcatgagcaatggttacaattaccggcaggatatggtccacggcatattcaattccatcatcaacggtcgattgcctacgttttgggagagctctcaagccaaattagtgtgcttcgttaccaagatgatggcacgttccaactcttaaatacccagtctacgattccagccgactggacggcgcataatggcgcggctgccattcgattgagtgcggataaccggttcttgtacgtttctaaccggggctataacagcattgctgtgtacgcggttagcgatgatggcctgacgctgaccctcattcaacagattagtagcgaaggagattttccccgcgactttaatctggatttgacggaaaagtatgtgttactggtgaaccaaaatacaagtaacggcacactttatcagcgaaatgcacaaacgggcattttgacgctgagtcaaaaagagattgtgacaccagaagcggtcaacgttaacttcttggcgcaataaccataacgttaagcattaaatagtaaaaaactggttctcagctcgagctcgagaatcagtttttttgtaggctaaattattttttgtagccttgattaggaatgttgttccaccgttctgataggtaatgaaccaccattttaggttcgcgtgaacgggtgaacaaccccttcttgtttccttgcactcgttgaattccaaatttagtttggaaatcagcgaagttccaaacctgttcgccgacgaagtgtgggacgcgatcaaaggcggtactgtactgcttatagtagtcaacctggtactcttcggagaatggttcgttgtaggggctgtggacccccgcaatggtatccgccccgtattcagtgtagataatgggcttgtcgggatacttagcctgccactgttcgagttcgtcttggacggtcttcgtgacgtcgctcaagtcgccgttgttgaggtaccagccatagtaacggttcaacgaaatcacatctaccaaatcggtgcaccggtcggtttcaggaagtgtcatcataatggcaacgtacgtacatgggcgtttctgaggatcaagctgacgagctaagtcgaagaggggcgcaaaatagtcatgtgcaccgggagcatagtgcgccgattcgttcgaaatggaccacattaccacgcacgcgtgatttttgtcacggtcaatcatttcttgaatcacctgacgatgggcggcagttgttttgagtgtcgaccacgtttgatccttgttgagaccgtccatcttattttcaatgtcgaaattaaagttgagcatcagccccactgctggggtttcatcgatgacgacgatgccttcgcggtcacaaagacgcatcatttcgtcggagtagggatagtgggaggttctaaaggaattagcgcccatggacttcatcaacttaatatcgaggacgttgtaggcttcgttaagccccttcccattcacataggtatcttcatgcttaccaaagcccttgaagtaaaatggcgcgccattaattttgaactgaccattggtgacttcgatttgacggacgccaaagggctcttcgtaggtgtcgacgacctgaccatctcgcagtcccgtaatctgagccgtgtaaagataggcgttgagaggctgccagagatgaacgttgtcaatggtgagtgagacgtctgttccggttccctgagcaacggggtggtgttgctcgtctaagatggtaacctgaactgtatcaaatgtgccccccacttcagttgtgaggtgaatggtagcctgctgatgagcaaggtcaatgtcgggaaccaccgttacgtctttgatgtagtcgtggggggttgaatataattttacggggcgatgaatgccggcatagttataaaaatcgaagttttcatctaccgaatattgcggattgcccgcgtcatcggtagtttcagtgaagttaccgaccggcagggttgtgtagtccaataggttgctgagtcgtacggataaccggttggttccgtcaacgagggcatcattgacctccgcttcaaacggggtaaacccacccttatggtgtgcgacttcggtgccgttgacgtaaacccaagcttcgtgggtgaccgaaccaaaccgtaggaccaaccgttgtgttttgagcaagtcggcgacttcaaagttggtttcgtaccagaagtaaccattatgttcacgtagttggggattatcggtttgatcgttaaaagaagctgggaccgccatgacttcggtcgtttgtaatggcgtggcagccgtgatgctaccgacgggctcctcaaccttaaatttccagacaccgtcaagattcaggacgacccgactatgagttgtaattggatatagcaaaataaattcctccattcaagtcttgatgtaaacgattaccactagtatattggaattatagcacttgcattattaaaattttgactatattaggataattttgactacttaggagactactaatggattcggtacttgcacaccaactgactgaaataaccaagattccgacccgctatgttcagcagcctgagactacggtggatcgtcaggccgcgcagtttttaacccagcatgatcggcaaacagcgtactatttgaacgaacgggtgcaaaaatacgtggttgttggggactggcatgaagcccatctagtgggaattttggtggcgggaccgtttttagccaatgatgatctagccctttatgatgatcgtgattggtcggatagccgccggcgtgcgctggatgacttggctattttaaacgaatcagaaattcagggattagcggcggtgatgatgcgcttggcgggcaccacggcagtaactggcaccttcgttcgcgcgacggtcagtccggcctatgtcgtgaccggaccacgggaatcgcaagaagatgaagaggcggtcgtgaatgagcggtaccggcagcaacgggccctagtagaagcgattgagcatggagatcgaaaacaggcggatcaattaacggatggacgaccagaaacgttttttacgccatttacgaatcgggtacctaatagtccgttgcgttcggctaaaaatattgggtttgcctacaacacaatgtgtcgtattggtgccgagcagggaggcttacgaccgatttatctgcataccgtctcggagaagtacgcgattaaaattgagcgggcgcggagcttatcccagatttggcagctgattcgattgatggcacaggaatattgtgatctggtacagcggtatcgggaccaatcgtacggccgcctggtcaatgaagcacttaattacgttcgaattcggtcgtcacaagcattaacgcttccccagattgcacgagctctgcagacggagccctccgtgttagcacgaaaagtgaaacaagagacgggacacacgcttttcgagtacgtgaaggcccaacggatcgcacgagctaaaccactattgcgacggggaacgttgacaattggggaaattgcggttcgggtcggctttaatgatcagggctattttagtcggtgttttaagcaactcgttcatatgacgcccacggcctatgcccaaaatgatcatgatatcacgcaatgaaaaaagatggtgaccacccttataaagggcggcaccatcttttcacttgacgggtattactttttaaatacgagcggctcggtgattaatttgggtttggaaggccgccaaatattgcaccgaacaccgtaaaacaacgatatgaaatcgaaattttaccggagtaactgaaccggttattgttattgtattgaatctgattaggataaattggtaaaatattgttaatattcgaattattttgtttaattaaggagaaaaataatgaagcaacggattgcaacacagctcacggaactgactaaggtgacgacgacctactaccaaagcttcagcgagccactggtcaaaatgatggtggcgcgattacggcagcaaccaactaacgtggggtactacttcaatggaaagattgataagtatttaggtgttggcgattggcagggcgatcagttgtgcggcatgctggtgatggggccatttctggcgaatacggattggacgacatttgattcgttggactgggaacaacgatcacgacagttatcacggcgggtgcccatcctcagtgaagcggagattcaaaatgcggccgcgattatgttggagttgcttcagcaaaccacagatctggtccgggtcattacggaaactgacgttcagccgtacgttgttgaaacccaacgggaaccgacgatggatgatgaaacgatcgtcaatgcccgatttaaagatcatcacgcgatgatggccgcaattgcgcgtggggatgatcaaaccgtggatgcgttgatggatgagacccaaccagcagctttctttatgccgtttaccggtcgggtgccgaatcggccactgcgagccgcaaaaaatattggattcgtgcatagtacgatgggccgcattggggcggaacggggcggtgtccgaccgatttatttgcacctagtttcagaaaagtacgcgatcaaaattgagcaggcccatagtctgggtgaaatttggcagctgattaaaacgatggatcacgaatactgccagctagttcaagcgtatggggatcacaactatggtcgcgaagtaaacgatgcgattaattatgtgcggctgcggtttgcacaaccgttgacactggcgaccgtggccgcggccattaatgtcgatccctaccgactatcacgccagtttaaacgtgaaaccggccagtcattatttgcgtttattaaggaacagcggatcaactatgcgcaggatttactgcgccgtggtcatttaactgtgagcgaagtggccatcgaggtcgggtttaatgatcaggggtactttggaaagtgcttcaaggcggtcacgggtaagacgcctaccgcctatagtcagggagtcggaaataagccggttggagactaagcagttagtgggttaaaatgtgcagtggtgggtattaaagaagagagtgggcaaaaaggcgttttgacttcgagcatactccgttgtccacgcaactaaaatcgctaaagcgataagttgcagtggcagcctagaaagccgaatgattcgtactttgaatcgtttggctttcgtagctaagcggagaagtcagccttttttccccgatttcggctattaaagttcggagacaggaagaggctgggagtttttccccagcctcttttcttttctaatatacacgtttatttaacttttaattgttcatcgcgtttaaatagccgccacatgatcaagacacagtataggagtgataatccccacgcaatttggttggagtagcagatggcgatatagcccatggatgtgattgagagtacgcccccgaaagaccgcccgatgagttcaccgaagccagagaagatggcgtaaatgctgtgtccaaggccttgaagcgtgtttctgaaaatcatcaaaagcccatgaatgatgaagaaaaagctgatgatcgtcaggtattgatcggctcgatcgtagacggttcccgttgtcgtccccagcacggccgcaatcagggttttcttgaagaccatgactacgatgaaggcaagaaaggagtaggttaattggattaaggagccttgaataatgcccttcttgattcgatcaattttccgggcgccgtagttttgggccatgtaggtggcgatcgccataccgacgctttccattggtagtgtaaagagttgtcggatcttttcacccgcggactgtcccgccacggcggcggtccctaacagattaatggcgtcttgcatgatgaccgccccgattgcagaaatggagtattcgaagcccattgggaaaccgataatgcacatccggttaaaatggtgcaaactgaacttggtatcggccagtgagattcggataaagtggccactgtagaccatccaccagatattcaaaaggccactcacaaattcgctaatcacggtcgcaaaggccaccccagcaatgcccgtgtggaattcttcgatgaagaccagagcgaggatgatatttaagaccaatgacccaatcaaaaaatagaaaggacgggtggaatctccgaaggcccgcagcgcatttgccgagtagttgtataaaatgttggcggggatgccagcaaacgagacaacggtgaaaatggttgcgagcttcatgatctcgtggggagtgttaaggacggccagaatgttaccggcgaagatcatcattaccggtgttaaaatggccgcgatgatgatacacagccagatggcgttccccagatactggcgactattacgatcctcattggcaccgacgctttgggccagcggaatgctgaagccaacgcagctgccttgaataaatcccagaacaagaaagctcaacgggtaataggcccccacggctgccagggcatcgattcccaataaacggccaacgatcatggtatcgataaagttgtagagctgttgaaaaattgatccgccaacgagtggcaatgaaaagcggataatttttgtcagcggtgatccagtggtcaaatccaaattattctcgttcatgatgttaactcccaagtctttgattaacgtacagacgaatagaagttctaaacgaaaatcatttagaacttctaccgtaacgctatttatttgtcatctgttggatggggatgtttccgttggtaatcggcaatgatgtcgtattctccctcaagtttacgaccaacacggaggtaaacaggaagtaagtcacgataattttcgaagtttgatgggtctggttggtaagtgttttgcttaccaataaattgtttaacaattgacagatcatcagcttcaccgatactaattaatccaacgaccatggcaccgagacagccactttcgaaggcttcggggatggtaacgggatgttcgaagacgtcagcaagcatttgacgccagagcgctgaacgtgcaaagccaccagttgcagtaatgacggttggttccccaacggcttcttgcaaggctaacaacacggtgtacaggttataaaccacaccttccagtgcggcccggaccatgtgtgcccgggtgtgtgaacgtgttaggccaaagaaggaagcccgcgcattaccgttccagattggagctcgttcgccaccaaggaatggatggaagaggagaccatctgaaccagcaggaattgtctttgcgatttcagttaagaagtcgtaaggatccatgcctaacattttggcagtttctttttcaggggcgaagaggttgtctcgaacccaccggaagacgatcccaccgttgttcacgggaccacccacgatccatttgccgttcattactgggtagcaatatgtccgacctttaggatcaagttgtggtttgtcgatgaaggtccgcacggcaccagaagttccgatggtaacggccacttcacctttatcaattgcgcccaaaccgatttcagctagggcaccatcagtggcacccattacaaatggtgtgtttggtgaaataccaatcttgttggcaatgtctttgtccatccccgtgagttgatgggtaggttcaacaagttctgggagttgtttgcgtgtcacgccaacccatgacaagatgtcgtcgtcccaatccatgttgaagatgttcatcaaaccagtggcagaagccattgaagtttcttcctttaattcgtggaagaagcgccacatgatatattcctttaaaccaacccagtaagcggccttctcgaaaatttcgggatggtcttttttgagccacataattttgtatacgggacccattgggtgaattggtagaccggtcttgttgtagatcttcattccgagaccgttgttagacgcctcagttgcttgtttttctgatcggttatcagcccatgtgataactttcgttaatggcttatgattttcatctaaggcgatcaaactgtgttgttgtgttgagaatgaaacggcacgaacgggaccgtttacttttttgacaacatcacttaatgcagtgaccgtggcgttgaagatttcatctggatcttcttcagcggtgtcaggtgtgtcttggtaaaggggataaagttgatttgagtatcctttaatatcaccgtgtaaggtataaataactgccttagtacttgttgtaccaacgtcaattccgataatgtagtccattgaaaattccctcctaatttggatgcttggttgtattcgaggcttaaagatggaggctgattcatctgttaacgcttacataatacaaaatacacacgtaaaagtcaacaacagatatatcagttttgaaaataaaatttttttatcggcaactggcactgattttgtggtatcgttttcttaaatcgaaacgagtataatgggctgaaaaacaaaattcataaattaagaagtgagcaaacaatggaagagttatcaacgaatatgcgcatggatgcgtacaatcaattaaaatatcaaatcttgcacggcgtatactatccgggacaaaagatttctgaaaagatcgtttctcaggacttaggaatcgggcggactccggtacgggaagccattatcagattggaacggtactcattagtagaagtcgttccgcaaagtggaacgtatgtgaccaagattgatctgaaatcggcggagacggcgcaatttttgcggcgcaagattgatccagatgtgttactccaattttcgattaacgccagtgatgacatgtttaaaaaagtagaaaagaacttggctcggcaaaagcaggccgccaaggaaggtaacaataacttgttctttgacttagatgaagagtttcataaattattttacattggtgccggtcgcgagatgatctgggactggttacaaatgattaatatgcacctgaaccggtaccgttggttacggttggaagtggctaagctgaactgggacacgctgcttgaccaacacaatgggatttatcaggctgtgaaagaacgtaacgtcgaaggggtgcgctttactgccgagtctcacttacggttgatgttaacggaattaccaagtcttttggaaaaatttccagattattttgaccaaaatacggaattagacgatcaaaaataggtcgtgaagggccgctaaacgttgttaaactgggattcttaaaataatcattgacagttttgaaatgtgcgttataatgaaagcgtattcaggcatactagtatatcagttgattttatgttactaattatttagctggagggagctataaaaatggtaaaaattacagacaattacttagaaaataagcaagcattcgcagacagcaaaattacggtgcccacttatgatgccgctaaagtggctgaaaagaccgtaaaggaaccacgttggattcactttggtggtggtaacttgttccgggctttccacgcagcaattgccaacaagttgattgaagacggcgaaatggattcaggaatcatcgttagtgatacgtacgatgacgctgtcgttaacgacatttataagaaatataacaacaaaatcgtacgggttgtgactaaggcggatggttcacaggatcgtgatctctttgcttcagttgctaaggcagtttttgctggcccagcaacggttgatgctagtggctttgaagaactgaagggctacttcactcaggccagccttcaagttgtgtcattttcaattactgaaaaaggctatcacttaaagaatggtgccggtgaattcttcccagcagttgccaacgatattaaaaatggtccagctaagccagaaaacaatatgtcattactagttagcttgttattagctcgtttccaaaatggtgccgttccattgacactgatgagtaccgataacttctcacaaaacggtgatcgtttgaaggacagtgtcttgacgattgctaacgcatggaaggacaacggctttgttgaccaagccttccttgactatttgaacgacagcaagaagattgctttcccactttcaatgattgaccggattacaccaaacccatcagaaatcattgaaaagtcattgttagatgatggctttgaagatgcgacgatcttgcattcaaagaagcacactaacattgcggccttcaccaatactgaagaagcacactacttggttgttgaagatgcctttcctaatggtcgtccagcctttgaaaaggccggcgtgatcatgacagatcgtgataccgtgaatgcagctgatgaaatgaaggttacaacttgcttgaacccattgcataccgccttggccgtttacggtagtatcttaggctacaagtcaatttcttcagaaatggaaaatgccgacttagttggtttgatcaagcaaattggttatatcgaaggcttaccagttgtgcaagatcctaaggtaatcaacccacaatcattcatcaacgaattggttcaaaaacggttaccaaacccatacattccagatacaccacaacggattgcaacagatacatcgcaaaaattgggtgttcgctacggggttaccatccaacactatgtggatgatgccaaccgcgatccaaagactttgaacttcattccattagtaattgcgacatggttacgttacttgatgggcattaacgacaagggcgaaacgttcgaaccaagtccagacccaatgtttgatgaattgcacgcccaagttgctgacctgaaattagggagtgcggacgttgatgttcacgatgctgtgaagggcatcttgagtaacaaggcaatcttcaacatggacctttacgaagttggtttaggcgacaaggttgaagcatacttcaaacaagaacttgccggtgccggcgccatcgaacaagtattgcatgacacgttggctgctaaaggccaaaacgtagactaagattaattgagaattggggaataaaaaagatgacagaatataaaattgcagttgtaaactcaagtagtttcggacaagtatttaaagaacactggactgaattagaggccattggaaccgttgatcggttcatggtggaccctaacattcccggcaaagaattggctgaaaagctcaacggttataacgtaatcgtttcaagtgtgacaccattcttcaagcaagacttctttgacaacaaagacgaattgctattgatctcacgtcacggaatcggctacaacaacattgaccttgcagctgcaaagcaacacggtactaaagtaacgatcgttccaccattggttgaacggaacgcggttgccgaaaatgcccttgctaacctgttgtcacttgttcgccaagcaacaccttcatcagaacggatcaaggctgaccgttacgaagaccgggcccaattcatgggacatgaattcactggtaagacatacggtgtgatcggctgtgggaacatcggtagccgggtggctgaattattccagtacttcggtgccaaagtattagtcactgatccacatcctcacgctcgtgaaggctggttcgaagacaatcctaaggtggaacgtgttgaactcgatgaattattagcacagtgtgattatatttcattgaacgcatcattaaacgatgaagactaccacatgatcaatgcggaagccttgaagaaggccaaagatggcgtctactttgtcaaccatgcacgtggtgctttgattgatgaaaaggcaatgctggccgccgttgaaagtggtaaggtttcaggttacgctgctgatacgatggaagtggaacctgttcgcgcagaccacccattcttgcaaaatgaccgcttcttgattacaccacatacctcagcatacacatacgaatgcttacacgggatgggtgaaaagtgtgtggctgacgttcgcaacctcgttaatggcgaaccactcggccgcgaattaacccaaacgatctaggagcacagtttggttgctaggcgtttagtcatgatgatcaaataagaatcgcgcgcccaaaccacgcgtagcaaaaaggcccccataattggttgaaccaactatgagggctttgctatgcaaaaaaggttgtgaaaagtaaaacaggatcggtctattcccgtgtttgtttaataacggcgttaatcttcgttaattttggacttggattgacggtttcatcccgcatgattgacatgtagaggcagtcgatgatactcatttgtgaaatcagggatgccacggcctgtgaccggtatttggaatcatctgaaacggaatagaaggtaacgtcaccgatcttagccaattcggatgatgaaaaactggtaatggcaatgatgggaacgttgttttcgcgtagaaccttggtcatcttcaaggtatctaagttacgaccactatgggaaatgacgatggcacagtcgttacttgtcatcttggcggcttgcatgagtgacatatggtaatcagagttgtagatcgctgtgatttgcgttctaaggaatttttggtaggcatcgaaggccaccacttcggaagcccctaaaccaaagaaactgagttgttgcgcattggtaatcagtgaaacggcatcgttcagtttatcttcagtgagcagatccagtgttttactcagggaagacttgttagaactgaaaaccttttgggccaccatgatgttgggatcggtcacatcgatgtcagccgcaatcttttcgggatgtttgagctggttactaatggcgagctgcagctcagggtaactagaataaccaagccgtttcgcaaaacgggaaatagttgacaccgaagtatcaattttttcagccagcgattggattgactggtgatcgcagtccgcaagattgttcaaaaagtaatcagcgattttgtggctactattaccgaaggtatcgtattttgagtagattctttctattaattgaagggtcattgtgagacctcctactttattttaattaatagtataacaaaaataattaattttcacaattttcatacaatgttattgctttttgataggtttttgcatataataaaaccatcaagtagaaattaagaaaacaaaattaatcgaaagagggattttttcatgcgtgttggaatgatcggccttggtaaaatgggccttaacttaactaagaatatgttgcggaacggaattgaagtagttggatttgacttggcaaaggacaacgttgttgcggctcaagaagccggcgcaactcctgctgatagtcttgaagatttggttagcaagctaggaactccacggattgcctgggtcatgttaccagctggtaagccaactgattcaacaatcgaaacattagctaagattttggacaaggacgatatcgtcgttgatggtgggaactcattttataaggattcccttcgtcacaatgaagttacgagcgcgacgggcgttaagttctttgattgtgggacttcaggtggccaaaatggtgccttgaacggtggtaacttcatgatcggtggcgacgacgcagaagccttcgacaagtatttgaaagatatctttgaaaaaattgctgaaccagatggattcctttacactggtgctgccggttctggtcactatttaaagatggtgcacaacgggattgaatacggaatgatggaagccatcggtgaaggattcgatgtgctggaaaattcagactacaactacgacaacgaagccgttgctaagctatggaaccacggctcagttgttcggagctggttgatggaattggcagaagacgcctttgctaaggatcctaagttggatgaattgctgggccggatgcattcatctggtgaaggccaatggacattacaagaatcacttgatatggcggtaccaacaccagttattgccttatcattgatgatgcgttacgaatcaatgcgtgatgcggacaacaacttcactggaaaagtggttgctgctttgcggaacggctttggtggtcacgccgtagatacaaaataattaacttaaaaaagttcgggaccgtaaggggccgaacttttttgccaaatgggggaattttaaaatgttctttaatcaagcagatttaaaaacacaggtgattgatgataactcgtatcggcaaattttagcgcatagcgggagtttgatgaacgtcaaggtgttcttcaagcaagccacaccagccgccccaattccggttcatcagcacgttcacgagcaaacaacttatgtcctcaagggcgcctttaagtttgaaattcgtgaagcaacgggtacgcaggttcaagaagttcacgaaggcgacagcatttactttccggccaatgtttttcatggctgcattccgttggcagatgacagtcagctactggacagctttacaccccaacgcgaagattttttgcagtagcaaactgatataaaaaaacgcacattcctaattttgaggaatgtgcgtttttgcgaattaacgatcatgttctaagaagccctgctctttgagaatcgcgaggagttcccgccggtgacgtggcgaactcactacctcacgggcgagggattgacgaaaagtttcgcggcgcggattgagatgacgctgctcgtaatagctttgtagctcggtgtcgtaagcatccagttgcgcttcaaagtcagccggcagttgatacgcattgataaagttgaccacgctttgtgggaggcgcggtttttgttctggtaggtcattgggatagcccacggcaaccgcaaagagtgggaacgtgaggtgtgggaggtggaggagttggataacctggcgggcatcattgaggatgctgccaagaaccacggttcctagtcccaagctttcagcggctgtaatcagcgattgtgccccgatagtggcatcgtacacgcacccgagcaaccggtctgtttcatgcagcaatgtggtatcaacctgttgttggctagcaatcagctggttgcggtactggtccgcgacaaagacgaagaggtgcccgtttcgattcacctgatgttggctttgcccacaaatctcagccaattggtccttgatggcctgatcggtgatactcagaatgctgaattcctgcaaaaacatggatgaggcgccctggtgagcgacttcgaggagggttgcaagcgtctggtcatcaagtggctgtggcttgaaatcacgcacagaacggtggttgaggagactctgaatagtttcgttaacggtcattgttcaaacctcccttggcaaactaggcttctttagacgcagattcattgacttgcttagtcaggaggtcatagatttgctcaatatcgcgtgaggtcccacgcagttcgtagtcggccaaaaatggggcgcggaattggtgggcgtaccgtttggcggtgagacagtactgctcgttaaagttgcggttgccactgccaatgacgccgatgcattgacgcgcattgttatgataggcaatgtattcaccaaggacgttggtcatcagttccttcacgccggaatcaatgccgtttccaccatcgaggtaggttggtacgaaagcaaagaaggggtcgcgctcgtcgtcgaaatcgctttgttcgctgatttctttggcgttgatgagtggcagtgagtcgtcgatagcatgttgctggctagcgtacgctgtcaaccgattgataaaggaacgggtgttaccttcaattgaaatgtaaagtgcgttgatattagtcatggatggagtctcctttggggaaagtaaaattcgtaaattaaaaagtagcttaattttaacacgtaagctactttcaggtacgacaattattaagattaatcggattcgttttcggcgttcattttttgttccagtgccgccttggtccgaccacggtgttcggtaactttaaaccagttaatgtaggaattctcgtagtcgaggacttcaaggtcaaaatcgccaacctcaacgacatcccccacgtggatcgtgtcagcttgatcgatgacgtagccggtgattgtcacggactcggtttggtcgaattccttaatatcagtttggaaatagcgctcgaagtcatatgacgtggtcttaccactaaccttgtaggacccatcatcttgtttgaagatgatttcgtcggacacatcatcaatttcatcacgaacggtaccaaagagttcttcgtaaatatctttgtccgtgacaatcccactcgtaccaccatattcatcaaccacaaccacgattggggtgcgtttgcgaatcatttgttggaggacttccgtaatcggtgtcgactctggggtggtcgagatgtgacgcagcaccttgctaagagaaacattcttgtcaattcgtgattgacgaactaaatcgtagttgaagacgtagcctagaatcttatccttatcgttatcggcaacgacggggagacggctatatttttcctgcaggtacatgttaatggcggtggagatggtgtccttgatgtcaatcacgaccagttgtgtccggtcaaccatgacatctttagccaccttatcgttgagctcaaatgcacgttccatgtacaggaggtcatttttttcgagctcaccacccttaacggcattccgggaaatgctgagaatctcaccttgtgagagaacttcatcggtctcgtcagccggtttaagtcccaacatccgcaccacgccattggctgaaatgttcagcaaccaaacgaaggggtaaaaacaaatgtggaaccagtgcaatggcgtcgttacaaacatcatgacccgcagtggcatatcgatagaaatattttttggtacaatttccgtgaagaccacttcgaggtaggttagtaccagcaccccgataatggccccaattccatgcaatgctcccgcactaatcgggagatgggtgagatcgaacacgtcgaacaacaatgattcgatggtagactccccaatccaacctaagataatcccacagacggaaaccccaacctgagttgttgaaaggtactcattgaggttggtgaccatcttgatagcgcgattgagcttcatcgatggtttatctcgagcttcttgctgctcttccaacgcggttaaccgggtctgaacgagagcaaactctgccgccacaaaaaaggcggcaaagaagaatgtgattagaataatcacaagattaattaatatctgaccgctgtccaaaaactattcctcatttcctgggtcaagtaaccaaattatagtagaattaatagaaacatcagttgaaataatggtacatggatttagtgttaattgcaagtaatatcaacgatttgacggactttgtttaccaattagacgacccgggtttgaagggtgtaaagccgtatgataaaacccttaaaaaagaacttaaaaatgtataacgggtgaactaatttggcttatcaatgctcacatgatagtctataatagaaagtgtttggaggaatgaacatgcgactagatttttctgtagcagtacacagcttattatacctagatcaaaacaacgaccgacgaatttctagtcgtgagctatctgagaagctgaaagtaaattcggtgatgattcgtaatattttgtcactcttgcataagaatggctatgtcaaaggcaacgtcggaaaaaatgggggataccagatgattctctcattggcgcaatgcaatgtgggtgaattgtatgatctgacaatcccgcccaccatcagttacgcccgctttattacgggcaaaaccagtttactggaagaagaaaacgaaactcatgaaacggaaattgaaagtaacatcgctgaaacgctgaccgacttatttacgttagctgatcaggattaccgggcattttaccaccagtttacgctggctgatctcaagcaagatattgagcatcatgggtattttcagcgaaaaattgacgagcagtagtaatcatttaaatgatgataaccaacgagatggcagcgatgaattcgctaccatcttttttagacactttttgtgcaattatcaacaaattaatccaccccttgacaatgtttttgaatagtgagtaaaatatcaccatattctcatcagattttaattttacatagttttgggaacatacaagggggatacatatatgcaaaatgttgaagcaaaagatggcaagatgaccattggtagttacgtttataacgtgtcggcggcggtttcaaatgcggtgctggtcatgctgggggttgggttgttattccaatcggtggctaatatcacgcactggacggcactgtatcaagttggggcactggctcaggtcttactaccggcagcgtttggagccggggtggcgtcacaactgcgagtgaatacgctggtccttttcagttccatgattgcggcaacggtcggtgccaacggggtttatttcactcagtcggcagttaaagcggctaccgcaacgggatggcaaatgcatgaagcaactgccagcaccatctttaccacgggccaacccattagtgcggtgctagcggccattttagccactctcgttggtaagtatttgacgggtaagacgccactcgatatgattttggtaccgttggcggcgacgttctttggctctttgtttggtctgggggctgggacagtcgtaacgccggccctgaacgctttgagcaagtgggtcgctggtgcgatgacggtgaacccactactaggctcaatgtgcttgtcactagcgtttgctatcttcctgatgacccccgcttcgtcagcagcactagcaattgcgattgcgttgaacccgatttcatctggcgccacgttgattggtacaaccgctcaattcgtgggcttcctcgcaatgtcatttcaagagaataatttgggtgccaacattgcgcaaggcttgattacgcccaaggttcaatttcctaacttgctcaaacgaccggcgctatgtattccaccgtttattgcggcgatggtcagcgcggctgtcggaacattggcctttaagttcagtgttccctatacccttggcggtttgggactcaactcgttgattgcaccaattaatttggcatctagcaacatgcatgcgttctgggtttacatgttctgcggaattttgatgcccgctgtcatttcagcagttgggtatcggatcatgcgggcgttccatttggtctccgccaacgatctgcacatggaaatcgtttaatttttaatcttaagttacgagagttggaatgaaacttcttaagttacgagagttggaatgaaacttcgaaagagagttttgttccaactctttttgggctatgataggagaagaattgaaataacggaggcaactcatggtaacgatcaacttcaaacgggtcagtcgaattgtcaaaaaacaggtcatgcttgacgatctggacttgaccatcgaaccggcgatgattagtgcaatttgtaccgaccagccagcgagcgtgacggcgctatttgggctaattactggtgaaaaggcagacgatgggcaggtcatgttggatcagttggacgcatacgcacaacgaaaacatctcggcgatttagtgggctgtttatttgcagatgacgaaggaagtacacggggcaccgtgacgacttttttggagcactgtttgaagaaggccactggagatcatctgtccctagaacaggggttggggattgccaagcagcttaagctcacccccgacagtcgcgtggtggacttggaaccaggggccaaacgacagcttcaaattttgagcttagttgttaacgagcccccgattttgttacttgagcagcccacatcaatgatgaatgcacaacaagcaaccgcgatttggcaactgctggcggattatggtcgcaagatggccgccaccattgtattttctagtccccaagtggcggaaatgcaggcccatgccaatcagatcatttatctgtctaacggtcatgtgagtcaaatccgccccattgtgacccacgatagtagcgattgtgtggtcaaggtaacgggacgcggattaccggtggaaatgatcgatgttttgggcggccattttattaaagagacgcccatgaatcaggagtttgtgtattcgggcaatatccaagcgttgttgccgttgctggaacaaagcggcattacagacgtgagaattttggatgcgacgattgatgatgaactacgggtttggtgaaaggaatcaagatggcgacactaacagttattgatgaacagcgaagtcgattagggacactggtggcggccaagttgcccagcatggaggtcgtgttaaccgaccgctttgatacaacactgcaaactgcgcgtgtcattgtgtgggtggcaccggtggaacgcgcggatgaccgggtttttgagttgattgaccaaattgatgcgagagccaccgtgccggaaaaaattgtgatggtgaccttggcgggcattaatggtgaggtgccggatgagcaactgacccgttggtatggggatgccgctcaagaactgatgctcgcacatcagtacgcgaccaagatgatcgatgaactggaaattgactataccctcattcggcgggtgccactagtagatgaagaaacgccggtccaagtgactaacgaaggccaaccggtaatgggaacccggattgggatgcaagcgctcagtgagattattgtgcaggcatgtgatccgacggtatttcggaatcaatcaatcggtgtgagcgatcaataatgttgaataaataacaattaatgatagaataaacgaaatattaaatgaggtgggagaaatgagtcaacgaccatattttctcgacccaaagcgggtagtcgttaaaattgggacgagtagtttaatttatccagatggtcaattaaatttgaagacaatggacgaactcgctttcgtcttgagtgcggcttgtaagaagggccgagaggtgatcctagtgtcgtcgggggccatcggcgtggggcttaatcaaatgcacctgaagaaacggccggcggatattgcggcccaacaggcgatcgcggcgattgggcaaaatgagctgatggcgatttttaatcagcgctttgccagctatggtcagcaaattggccaggtgttgctgactcacgacgtgatggacttcccggtcagtcgacaaaatgtgttgaatacgtttgatcagttaatggccatgcacgcgatcccgattgtgaacgaaaacgatacggtggccgttgatgagttggatcataagacgacctttggcgacaacgatcagttatccgccatcgtggcaacctcgttagatgcggacttattaatcgttctttcagatattgatggactttatgatgcggatccacataagaatccggatgcccaggcgttatcgtatgtgagtgcggtgacaccggaaattttggaagcggctggtggaagtagcacccgttttggcactggtggcatggtcaccaagttgaaagcggccgcccgcgtgctgggcgccggtcaccagatggtcttagcgaatggtgaagatccaaagattatttttgatattttagctggtgaaacggtggggacgttatttgcgccggcaacacgagtggaggactagatgatggatagtttagaaaaaatgggccagcaggctcaagcggccgaacgtgaattgtcacaattggcgacaccggtaaagaatcaagttttgggacaaatggcgcaggcacttcgtcaaaatcaggccgaaattatgttggccaaccagcatgatttaaatcaggcaacggatttacccatgaattttgtggatcgcttgacgctcacagcacaacgaattgagcagatggcgttgggactggaaaaggttgcgtcattgcccgatccgattggtaatattgaaaagggttggcaaacggaacagggtcttaaaatcgagcaacagcgggtgccattaggagttatcggcattatttatgaagctcgtccgaacgtgacggcggatgcctttgcgctgacctttaaatcaggcaacgcggttattttgcggggcgggaaggaagccttacagacaaatattagtatcgtggaattcttgcaggccgttttgaagcaaaatgggttgaatccccatgcaattcaaattgtacaggatacctcacacgagacggccagtgagatgatgcagttgacggactatatcgacgtcttaattccgaggggcagtgcccggctgatcaaagcggttgtcgatcaagcgaaggttccggttattgaaacgggtgccggcaactgtcatatctacgttgatgagtttgcacagcttgatatggctagccaaattattgtgaatgccaagacgcaacgaccatcagtttgtaacgcggccgaaaaaattgtgattcattcggcagttgctcaggagtatttgccaaagattgccgaagcgctgaaaccgttcaatgtggaattgcgtggggatgaacgcgcccaggcgattttaccggacattacaccggcaactgaagcggattggggcacggaatacaacgactacatcatggcaattaaggtcgttgattcgctcgatgaagcaattgaacatatcaaccattacaacacgaaacattccgaagcgattgtgacggacaactatgaacacagtgagcagttcttgaatcaaattgatgctgcctgtgtgtatgtgaacgcctcgacgcgctttacggacggttttgaatttgggtttggggccgaaattggaattagcacgcaaaagttacatgctcgcggcccaatggggcttaatcagctcacttcaacgaagtacgtgatccgtggaaatggtcaaattcgtcattaaatttaaaaactagacttgtgcttttagaattttatggtaatatattaagagtacttgtttggtactgctgatttagctcagctggcagagcacttcactagtaatgaaggggtcacaggttcgaatcctgtaatcagcatcttaatattcggtagaatacattgaggtcccgcatccgcggggccttttttgtttggtaatactaaaaaaacggcatccccacacgagaatgccgttcaaacagtgatttaattattgagcggtgtagccgccatcgaccacgaattcagaaccggtcgcgaatttcgattcatcggatgcgaggtagatgcagatgtaggcgatatcgtttggttctccgatatggcccattggcgtcttgctacgatcggacatggcttcttcggcaccggggatgttatcaaccaatggcgtcttgatgtagcctggatgaacggtattaacccgtacgccgtagtctttcaaggcgcaatcaacagcggccgattttgacatgatccggacggcccccttggtagcattataggcaccaaggttcggatcgccgatgaagccttcaatagaagacatgttgatgatggaagccccaaggttcttgttcttcattctttggatggctaagcgggtaccaaagaagaccccgtcgaggttgatggacatgattttacgccatgtttcagttgaagtttcttcaattgaaccggtcagtccgacgcccgcgttgttaacaagggtgctaacaggaccgaatgctttttccgtctcatcaaagagcgttgtccaaccatcttcatcggcagcatcatgctggatgaagcgaatcacatctggaccaccaatttttttagcggctgcttcaccaacatcagcgtggcgcccggtaatgacaactttggcaccttcttcaacaaacttgttggcgatggcaaatccaatccctaaagtaccaccagtaacaattgcaacttttccgtctaaacgatgactcatgtaatcaacctcctagaatttgagtatgtgtgaatcataacacaaataaaaacgctttcaaagcaaaagacggtcaaaaaagatgattatttaatgaaatttttttcattggaatgaaacaggcggttatttgacaatcgctgtaaagactggtttaataaacagtaattaaattgtgcgagggattatcaatgaaactagtaaaaaaccaatttaattttagcttctttagatagcgtccatgtcatagatgtggacgcccgtttagcttgcgttcatatctaaggagcgattccggtaggtatggaaatctactggagtattaaaatcgttatttaactccgttagatttaagcaggcgacacgcttaaatctggcggattttttgatggcaattttaatacgagaaatggggaatgcagcatgcgtaaaattcatacattagggcccaaagcaacggatagttacgaggcgtcacagcatattccgggaaccgaagaaaacgagatcgttttacatgatagttttgatgatattattgaggacttagcacagtatgcgggcgattatctcctcttaccagccgcatatcaaagcaaacagagcgactttggttggcgggaattgagctatgagtattgggatcggctaaaactggagacggtctatcatcatccgttgaagacgctgtgtctgattgccaactttgatttccagcaaaacaaggctgtcattcatccggccaccacgaacctattaaatgcttacttgaagaagcaacaattgagtttatcaatccactacgctgggagtaaggcaaaagcatacgacaagttcgtcgcgggcgggtaccggttcacgattgttagcgaagattccttggaacccgagcacccttatcaaatgattcaaaagtatcacccagatatggtgtggtgtctatatcacatcattaagtaggatgatcttattattttaactgggtgtattagttgaaaagactagctaatgtgggttaagatatagctactgaatgaggtgaataaaatgggtgcaatggatgactatcagcagtgggaagaatcactgctaacaaccgaattaccacgctgggaccagctgccaaagtttgatttgtatatggatcaggttgtggcgtttattaacaccacgctcggaaagttagaatttgagccggtaacggcctcgatgattaataactacgtcaagcacaaggttgttttggcgccggtgaagaaaaaatatcagtcgatgcagattgctgacattctagtgattagtttattgaagcaaaactattcgttggacgtgattcattctggaattaaccaagtcactaagcgtaactaccctaagcaggcgtacgatcattttattgaaatgcttgaggcggggattcgtgagcagcagcgtcccgaaatggtgggcgcagaccaattgaatgaaaaacttctggaagtcgcagttgaaagtatcattactgggctgaaggcgaagaaactattaaaattaatggaacgcgaaaaagcatagcaaagagacattcggacgaaaaaaagtcgaatgtctcttattttttttgaataaaaatgtaagcgattacaattagttattaatttcacaagactttttagaatcctttgtggggcttaatatctagattgtgaagaaaaaacggtgattttacacgggtgaaccgttgatatgatctactttgaaaaaagttgcacaaatcactttacaaaaatgaaaaagggtttatactcgtagatgttaaatagttcacaagatagttattggacatggagggaatagagaatggttgttaaagcagaaacaaaacaagaaaacaacgttgaagacatgatcaataagctcgtcagcgccgggcacgtggccttagatgcattagatggttttgaccaagaaaaaatcgatcacattgtccaccaaatggcaatggaagcactcgaccaccatatggaattggctaagttagccgttgaagaaactggccgtggtgttgtcgaagataaagctgttaaaaatatttacgcctcagaatatatctggcactcaattaaaaatgacaaaactgttggaatcatcaaagatgacaaggaacgtcaacttatcaccgttgccgaacctttaggggttatcgccgggattacacccgttaccaacccaacatcaacaacgattttcaaatcattgttagctgttaagacacggaacccaattatctttgctttccatccccaagctcaaaaatgtagtgttgctgccgcaaagatcgttttaaaagccgccgttgaagctggtgcgcctgaaaacatcatccaatggatcgagacaccaagtcttgaagcaacgactggcttgatcaacaacgatggtgttgccagtgttcttgctactggtggccctggtatggtgaaggctgcttactcaactggaaaaccagccttgggtgttggtcctggtaacggtccggtttacattgaaaagacggcaaacatcaagcgtgccgttaacgatatcttactttcaaagacgtttgataatgggatgatctgtgcatcagaaaacagtgccgttatcgacgatgaaatctttgatgccgttactgctgaatttaaagcacacaacgccttcttcgttgctaagaaagatcaaaaagcattacgtgatgccatgtttgatcctaagcgtggcggtgtgaagggtcctattccaggaatgtcagcatatgacattgctaaaatggccggcattaccgttccaaaggaaactaagatcttagtgactgaaatctctgaagttggtcctcaagaattactttcagctgaaaagctttgtccagtattgtcaatctaccatgctaagggtcaagacaatgcatttgaactctgtgatgccttgcttcactttggtggtttgggtcataccgcagcaatccaatcagaagacgatgacgtgatcatgaagttcggtatccagatgaaggctagccgggtgatcgttaacacaccatcagcacttggtgggattggtaacatgtacaacgaaatgattccttcattaacactggggactggatcatggggtaaaaattcaatttctcacaacgtctcatcatttgatctgatcaacgttaagacaatcgcaaagcggagaaataatatgcaatgggttaaattaccaaaagtttactttgaaaagacatctgttcgttaccttgaggacatggaagatatcaacaaggttatgctgattactggaccaagcatggtgaagtatggttatgctgacatcgttgtgaacgaattaaagcgtcgtcctaacggtgacaagattcaatacgaaatcttctcagatatcgaaccagatccatcgactaacacagtaacacgtggattgaaccaaatccgtgaattccaaccagacacaatcatcgccctcggtggtgggtcaccattggatgctgccaaggcaatgtggttattctacgagcacccagaatcaagcttcttcggtgctaagcagaagttcttggatattcggaaacggacttacaagctcgaatgtgctaacaaggctaagtttgttgcgatcccaacaacatcaggaactggttcagaagtgacaccattcgctgtgattactgatagcgacacccatgttaagtacccattggctgactacgcattgacaccagacgttgccattgtggattcacaatttatccaaacggtaccaaagaagacgattgctgaatctggcttggacgttttggcccatgcaactgaatcatttgtttcggccttggcatcagactacacccgtccattatcaatgcaagctgctaagttggtctttgacaacttggaggcttcatacaatggggatgcccatgcccgtgaagaaatgcacaatgcgtcaacccttgccggaatggcatttgggaatgcattcttaggaattaaccactccgttgcccacaaacttggtggcgaatttggattggctcatggtctatgtattgcgatcacgtacccacacatcatccgttacaatgccagcgaaccacagaagttccaagcatggcctaagtacgaatacttccgtgctaacaaggactacgctgacttggcacgctacgttggtgttaacgggagcacggacgaagaattgatcgaaggattgattcagaagttcatcaagttggctcatgcagttggaatcaagcttagcttgaaggctaacggtgtgaagaaggctgacttcgacaaagcaattgacaacggtatggccgaattggcttacgaagaccaatgtacaactgctaacccaaaggaaccattaattgctgatttgaagcaaatcatgattgatgactttgatgggaagggcgtcgaaaaatagagtgcggagccaagcgtttagactctgaaaactaacaaaagaaacccaattgatttccgtgatttggaaattgattgggtttctttgacgttgctaccatcttcaaattaaggagtggtagccacttttgggagcggatcagattattgtgcagcaggctactctgtatctagtggcactgtgatgtagacaagcacaaggccgacgatcaagcaactaatggaaagagcgagaccgaggaaaccagaaaacagattaaaaaaagaaaaaataacagttttacctaataacgcagcaatcagtggccgagctaaaagagtgagaccaatcaaacttaagacaatgcctaagattctgagaggttcatttttaatttttttcatgtgatcgattcctaacaaaaaatattatatagtctgctctaattgtaaggacaatttctgggtaaacaagagactaacaatatttttaacagattgaatgaaaaaatgaccaaaattatcggtaaaaacttcctaaattgtatagttattacaaagttatggacactcgccacgaattgatggcataaatctagatatgtgttgatttatacggataaatatcatacaatgtaagcgtacaactttagtgttattatatattttcttacttatataaggtggaggtttaatcccatgaatgctgatcagattaagaacgaaattgtaagcggaaacactgccctcggtatcgaactcggttcaacacgaatcaaagcagtgttagtttctacagatttccaaacagttgcttctggtgactacgtttgggaaaacgaattagacaaaggaatctggacatacccattaactaaggtatgggaaggaatccaaaccagctatgctaacttagcaactgaagtcaaagacaagtacggtgttgaaattacaaagattggttcaatcggaatcagtgccatgatgcatggttacatggccttcgataagaacgacgaaatcttggtaccattccggacatggcggaacaacatcactggcgacgctgcagctgaattgactgaattattcaacttcaacatcccagaacggtggagcattgcgcacttgtaccaagcaatccttaataaggaagaacacgttaaaaacatcgacttcatgaccacccttgatggttatgtacactacaaattatctggcgaaaaggttgtcggaattggcgatgcttcagggatcttcccaatcgacgaagctgctaagtcatacgatgccggcatgcttgaaaagttccgtgccttgcaagcagttaagcaatacacttgggacatcaaggaaatcttgccagaagttaaggttgctggtgaaaatgccgggactttgactgacgaaggtgcacgtttgcttgaccctagtggccaattacaaggcggcgcattgatggcaccttctgaaggggatgctggtactgggatggtttcaaccaacgccgttcgtaagcggactggtaacatttcagccggaacatctgcattctcaatggttgtcttggacagtccattgaagaaggtgcaccgtgatattgatatggtgacaacgccagatggcgccccagttgccatggttcacaccaacaactgttcatcagacatcaacgcatgggcaagcatcttcaacgaatttgctaaggccattggtcaccctgttaaaggaaacgacctttacggtgccttgtttgatacctcattgaagggggatcaagatgccggtggtttggttaactttgcttacctttcaggtgaaaacatcaccaagatggctgaaggtcgtccaatgtttgtccgcaaaccagatgctaacttcacattagctaacttcttcaagacgcaattgtattcagcatttgccccattgaagattggtatggatatcttgcttcgcgaagaacacatcaagacagatgttttgattgctcaaggtggcttgttcaagacaccagttgttgcacaacaagtcttagctgacgcgttgaacacaccaattactgttatgggtaacgccggtgaaggtggtccatgggggatggctgtgttggccttgtatgctaaggatactaagggcaaatcattgtctgactaccttgaccaagacgtcttcactgacccagatagcatgacactcgaaccagaaccagttagtgttcgtggttacgagaaatttatcgataattataaagccgctttacctgttgaagggaaagcagtagaatcaatgaagatgaactagtttatttggtttaagaaaggaagagtttgagagaatgcttgaagatttaaagcaaaaagtttatgaagctaacatgatgctgccaaagcttgacctcgttacctttacttgggggaacgtctcacaaattgaccgcgaaaagggtctatttgtcatcaagccttctggtgtcgattatgacaagttacgtccagaagatatggttgtcgttaacttgaagggtgaagttgtcgaaggtgacatgaatccttctagtgataccccaacgcacatgtacctttacaatcacttcccgaacattggtggggttgtgcatacccactcaccttgggccgtctcgtttgcccaagctaagaaggacgttcaggcctttgggactacccatgccgacaccttctatggtgatgtaccagctgccgatgccttaacaaaggatgaaatcgaaggcgaatacgaattaaacactggtgaagttattgtgcggactttcaaagaacgcggaattgatccagatgccgtcccagccgtattggttagccaacacggacccttcacatgggggaaggacgccgctgatgccgttcataacgctaaggtgctggaagtcgttgcagaaatgaactatcacactttgatgctgaacccttactcagataaccatgtcccacaatacctgttggacaagcactattaccgtaagcatggggctaacgcctactacggtcaaaacaatgcgaagtcgaagggccacgcccacaaggcttaagcacgtaaataaataggtttcaaaatccgttatgggttttgaaacctatttttttgcagttaactgtttgatgaggcgaccaaggttagcggctgttcgggtgagattgggccctgctacttgaatggcatgtgtcagactatcggcgcccgcaacgattggaaaaatggcatcaatttgatcgtacaaattaacgatgtcttcggcgacgcttccggtaagagcaattacggtgcaggcaggcacggttgatttggctgccttggcgacaccaaagggcgttttaccgtattgtgtttgagcatccagacggccttcaccggtaatcacgatatctgcgcttttgacgcgctgcttaaaatgagtggcctccagaacgatttcgacaccggcccgcatggttgtgggggtgaatgcgagcagcgccatgccaatcccaccggcagcaccactgccggcgagggtgctgacaggacgcgcgacgacttgttcgaccaattgaccaaagtgccggagattatgatctaattgacgcaccatttcacgattagcgcctttttgagggccaaagacggtactagcaccattgggacccgtcagcgggttagtgacgtctgaggcgacaataaagtgggtgtcggcgattctggggtcaatgtggcgggcgtcgatgcatgttagttggttcaactgtccgccgccaggggccagttcgtgatgatgacgatctaggaggtgcacccccagcgcttgcaagaggcccgcaccaccatcattcgtcgcactaccgcctaagccgataataatcgttttagccccgtgatctaaggcagcgatgatttgttcaccggtccctcgcgaagtggctgtgaggggattgagatgaccctgcatgagcccaagaccactcgcagcagcaacttcaattacggccgtttggcggtgattgatcagaccataagcagattggacagggctaccaagggggccggtggtggtcgttgtgaccaatgagccttgattggcggctaccaaggcgcgcaccgtcccttcgccaccgtcggccatggggagcaggtcaaaagtagcggtcggccaagcggcgcgaagcccctgatgaattgcgtgcgccgcctctacggcggtgagtgatcctttaaatgaatctggtgcaatgagaaatttcatacgtacgcctcacttattatgataattccattaaaaaccagtcgatttgttaggtcaatccaaaaaattgttcaaataattttttgtccgaataaatcggaatcaagtggcaacaaatgccgatttaacagtattttaagaaacataataaagtcttaaagtcgaaaacgattacaaaaattatgaaataaatcaaatttgtacttgatttatacgtacaaatattttattgtaatgtatgtaagcggtacctcataaatcagattctagacatggcttatgaatatgccgcaactacacagccattatttaccgttagttgatgagtgttaatgtaattgattcttccgatcaggttaccctttttagagagcgcttacgttatcaacatcatgtttaattctttggagcaaaggagaaaagtataatgcaaaatgaaaagaaaatcccaagttggttcatatacttctttggatcatttggtggaatcctttttggttatgatattggtgttatgaccggtgctttaccattcttgaaaattgattgggcaagcgcaatgtcaaacgccacattagtcggatgggtgacatctggtgttacgttcggtgccatctttggtggggctttggccggacaattagccgatcgtcttggacgtcgtcgtatgatcttatattcagctattatcttctgtgtattctcactgttatcaggggttgcacctacaaacggtgttatgtacttgatcatcattcggtgcttccttgggttggccgttggtgccgcttcagccttggtaccaccttacatggccgaacttgcacctgcccgtcttcgtggccggatgaatggtttgaaccaaaccatgatcgtgtctgggatgttgatttcatacatcatggactacgtcttcaaaggtttgccaacagcatggggctggcgtattatgttagccttcgccgctgttccagctatcatcttgttcttcggggttctgaaattgccagaatcaccacgttacttggttaaccatggtttgaatgatgacgctcgtcgtgtcttgagctatgttcgtgacaacgacaacgaaatcgacagtgaattaaacgacatcaagaagactgctgcagcagaaaacaacgccgcagaagcacaaaagagtgtcagctatgcatcattgttcactggtaagtatcgttaccttgttatcgccggtgttggggttgctgcgttccaacaattccaaggtgctaacgcgatcttctactacattcctttgattgttgaaagtgcgcttaagattaacgccagtgatgctttgatctggtcagttcttcaaggggttatcttggttgttggtgcccttctctacatgatcatcgctgaaaagttcaagcgtcgtagcttgatcatgaccggtggttcaatcatggcgatttcattcttgatccctgccattgttaacaaggttactggtactgaacatccaatgctcttgttagtattcctttgtatctatgttttcttctatgcctttacttgggctccattgacttgggttatcgttggtgaaatcttcccattggctgttcgtggtaaagccgctggtttagcttcatcattcaactggattggttcattcgttgttggtcttttgttcccaattatgactgctgctcttccacaagaagccgtgttcgcgatcttcggtattatctgtatcttcggtgttatctttgttaagactcgcgtcccagaaactaaagggatctcacttgaagaaatcgaagctcaaaacattaaggaataggacattctgtttcaaaacgagtggttcgtgtatctagtaaaaaataaaaaacattagttactatgtcttggttgcgcgtaataattaaatagttttatggcagaatctaaacggattctgcttttttttgcgtaaaaataaatttttaccaaattttcattttttaacttgaacgggaagaaaaaatgcatcgtaatgggattttgtgcgctcaaagctttctcatttagttaaaaaagaggggagataagcaactgaaatttgtatgataaataaaataatcgttgatttatacggataaattagataaagtatttaatgtaaacgttatccgtacgcttattttatttttagttaatttagtaaccgcattcataaacaatattcaaagattgtaaaatagtggttctgtagtatacagaattacggaagtgtcatcgttttagtgatcgggaacgctaaactggcattgcggtgaagaattaaccatggcaaaggagaagaaagtagtggaaaaagagaagaagattccaagttggttcatttatttctttggatcatttggtggtattttgtttggttacgatattggagtaatgacgggtgcattaccatttttgaaaattgattgggcgttaaccaatgcaacgttgacggggtggatcacttcggccgtcatgttcggagctatttttggagcttccattgccggtcaattatccgatcgttggggtcgtcggaagatgatcttgctgtcggccgtgatttttatgattttttctattttatctggattagcgcccaacaatggcacgctatatctgatcgtggtccgtgtattcttgggactcgccgtaggggccgcttcagcgctggtaccatcctatatgtctgaaatgtcgccagcccgcttacgggggtcattatcagggttaaaccaaaccatgattgtttccgggatgttgttgtcctacattatggatttcttgttgaaagatttaccagaagcttgggcatggcgggtgatgttgacacttgcagctgtgccggcaattattttatttttcggcgtcatgaagctgcctgaatcaccacggttccttgttaaaacgggacatgaggatcaagccgttcaagtgctgggatatattcgcgatagtgaacaagaagttcaagatgaactaacccaaattaagacgactgcccaacaggaaacggctgccgcacaggcggtgacctggggcaccctcttcaattcgaagtatcgttacctcgtaatcgccggtgtcggcgttgccgcatttcagcaattccaaggagcgaatgccatcttttactatattccgttgatcgttgaacaagccacggggagtgctgctagttccgccttattgtggcccgtgattcaaggggtgatcttggtcgctggttcattagtattcttagtgattgccgaaaaattcaagcgccggacattgattacgctcggtggctctgtgatggccctgtcattcttactgccagccgttattaataagctggtaccgaatgccagtccaatgatgatcgttgtgttcttatcactttatgtggcgttctactccttcacatgggcaccactgacttgggtcattgtgggagaaattttcccacttgcaattcgggggcgtgcatctggcttagcttcgtcgctaaactggatcggttcttggctggttgggttactctttccagtcatgacagcacatatgccacaggcggccgtttttgcggtctttggggttatctgtgtactgggtgtaatctttactcggttctgcgtgccagaaaccaaaggaaagtccttggaagaaattgaagaacagggaactcaccatggtcgtgcggcagaattaaaagatgctgacgtaacggattaaattaagttaaaaataatcaaaaaaagcaaactcaatttggagtttgctttttttcgtcgaactagctatagaagagctttaaactaatatcttgatcatagttgccgaaacctttgccaaaaatggtgcaaccaccctggtttttagcatcgggtttgatggcaaagcggattttgaaagtctgctgagaaacgtctaaatctgacagagaaacggaggtaaatggctgaccatctagataggtaccgtggttagtaatacgaagaattttttgaataccatactgattcacattgtcgggaacccagtcaggagtgtatttaccacgagtatcagaaaagtcaccgggactcgtccaggtgccgatctcaatgtcattaatgtagaacgtaatatctgaaggccagacattattagagaaaggaaattcggaaccaagctccatggataggtcaagcatttccaaatgttcattcttagctaagaagttgggtgcttggtactcgacaaaaccgttggaaaaccaaatcatgccagcttccattcgttggggatccatgaaataggttggattatcaaccttaccaatatagtcatttttaccggccagaccgcaagacggtttaactgagaattcagtgtagtgtccgacgggaatgtcagtttcgtggacttcaaaagagggataaattcgttccggaaaacggacagaaatgttatcaactttcaatgtcgatatcttattatggccatctttttcaaatacgataatgcccgcgtctgctaaaatctgcaaatgcttaagcgtgatggtgttgctaatatgtaagtgactggcaatatctttaacgtttaatttttcgtgggatagaatttggataatttttaaccgcattggattggcaagtgctttgtaaacgggtaatgaattatctgaaatatcaagttgcatgaacatcactccttagttaatgaaaacgttttttatttattcatatattaacataattgtgacttagaataaatgtaaagacgattttgttttattttgataaacaaaaacgttagtttattcaatagaataacacgcaagataaacaaaaaagtgttgcaagcggatacataccggtttaaaataaacgtgttgagaaagaaatcacaaattgaaaaagggtggtctaaaagatggcagaaaattatatcaacccgctgatcattcagcgagctgatccatacatttataaacacacagatgggtactattatttcaccgcatctgtgccggcctataacttaattgaaattcggcgtgcaaaaacactaaatggtttagctcatgcgacaccacgtactgtatggcgaaaacatgatcatggtgaaatgagcaaattaatttgggcaccggaattacactacattgaccataaatggtacatctattttgccgcaactgataccgagaaattagatgagctcgggatgtttactcatcggatgtactgtctagaatgtaccagtgtcgatccaatgattggtgaggaagtctgggctgaaaaaggacaagttgtgacagacaaggatacattttgtttggatgcaacggtttttgaacggcaagataagctgtactacgtttgggcgcaaaaggataagtcaattaaaggtaattcaaatttatacattgctgaaatggctaatccatggacgcttaaatcgacaccagttatgctttcaaagcctgaatttgattgggaaacaaaaggattctgggtcaacgaaggacccgctgtattacatcgtaatggccgctacttcttgacgtattcagcgagtgcaacggacgaaaattattgtatgggcatgctaacggctgctgacgacagcgatttattgaatccagctagctgggtgaagtcgaagcaacccgtatttcaaagtgatattgcaaccgatcaattgggaccggggcataattcatttaccgtttcagaagatggtgaaacggatatcttggtttatcactgccgaaattatttggatattaaaggtgatcctttgtatgatccaaatcgacacacaaaggtgcaatcatttacgtatgacgctaatggcgtgccgatgtttggtaagccagtaccatttaattatgaataatagtttgattgacaaagaaagggtgtaaattatggatcaaaatcaagtcacacaaaaaaagcatttttggagtttttttggaactgatgtaagttacttctttatttggcaaattgtacaaggatttttagttctgtggttaaagcaagaagctcatcttagtggtggacaagctggattcgtattttcatttcttgcgtttgcctcattattttatcaacccgtattcggaattatttcagataaattggtcttcaaaaagaatctatttctatcaattacgattgctgccatttttattggaccatttttccaatggatttttattccgattctgagctttagtccactgttaggggcgattattgggggctttgcgctggcatacgttttaaacggtggggttgctgttgttgagtcctacgtcgaacgtgcgagcttagctaatggatttgaatacggccattcacgaatgggtggctcgattgggggcgcctgcgcttcattcgttgcgggactagttttcgttaagaacccatttatggtcttttggatttgttcagctgccggaatcatccttacgtgtttagtgttattcggtgacaaaattaatttttctaatgcttctgctgccgaaggtgctagctcagcaccactaaatcgaaaaacaattttatctatttttaaaattaagaacttttggattttaagcattttcttcatggggacttctgcaatttatgatgtgtttgatcagcagtttccggtcttttatcaaacattctttagtagtgctgctgccggtacattggcatacagtcgactattaaccacacaaattgccctagaggcactgctcatgataccaatgccatggattatcaacaaaattggtgccaaaaatgggttgatctgctacgggattttaactttcttacgaatcacattgagtgccattgcgccgaacttctggttcttaacttgcgtgcggttaattgcatcgtttgaaatgccattattcttggtttcaacaatgaagtatattgcgggggcctttgatcttcgactttatgcaaccatctatgcgttggcgtttaacttcgctaaacaaatatcgttgtttatcttttcaacggtggctggtgatctatatgatagcattgggttccagcacacatactttgtcttggcagccttagttgccattgttacaatccttgcgattgcagctctgactaaagaggatccggtccaagcgggagaagttaaagcaactgaatgatactgtaacaaaaaacttcgctgccctttctggcaacgaagttttttcgttagtatggatattgttcaccaaactcataaacgagttcaggttctttgctgacacggtgatttttgttgatcgcatccatgaggtgcatttcctcagtcgttaattcaaaatcgtaaatttgtgcgttttgcgcaattcgattaggatgaatggacttgggaatgaatgagatgccattttgatagtgccagcgtaaaatgatttgggctggggaacgatgtttttgttcggcaattttgactagtgtgggttcgttgaagaccttaccacgacctagtggactccacgcttgcgtggcaatgttgttttcttcgtggaagtgaatcagtggcttttgactcatgtagggactgacttcgatttggttcaaaacaggcatttcgcgagcctgcgtagcaaggtattgcagatggaccataccgtagttgctgaccccaattgatttggttaagccttgtgccttcaagtcttcaaatgcgcgccaagtgtcaaagaaatgggtgttgattggccagtgaattaaaaggaggtcgacgtagtccatttggagctttttcagagattctttcagtgaccggatagtagcgtcgtagccctgattggcttcggaaattttagtggtgataaataattcttcccgtggcacctgtaaatcgtgtaaaatcttaccgaggtactgttcgttttcgtacatttgggcggtatcaaaaaggcggtacccctgctcccaagcagcggtaactgcttggttaaattcgtcttgatcagtaatcttgtaaacaccaaacccctgttgtggcatctgattgccatcggcgagggtaatcaaattattactaatatctgtcataatatcctccgctaagtttatttatcaaccactattataaacataatttgggaaaaggcgaaaagattctgacctggtggcccccaaaactgggtgcaagtgatatagtaataacaaataaatcgaaaaaatgaggagtatgcttcgtggaaagtaaatatgaaattgttaagcaaggactgaagtctgatattattgctggcaagtaccaggttagcgataagctaccaaccgaatctgagcttatggcacagtacagtgttagccgctatacgattcggcgggcgattagtgaattacaaaatgagcattacgtctaccgaattcaagggggcgggatgtacgttgatgattggcaaaagggccgatcaacgaaggtcaacaacaaaatggtgggtgtgattacgacccacattgctgactatattttcccaagtatcattagtgggattgaccgggttatttcagataacggctattcaatgattttgagcaacacccacaataatcatcaaaaggaacggcggagtttaattcggatgctcgataacaacgtggaagcgatgattattgaaccaactcaaagtgcgctacctaatccgaacagagacatctacgaaaaaattaaagcgtcgaagattcccacgctgtttatcgatgcccattacgaggattttgattttccatacgttgagacccatgatatggaagctgaacagcatatgacggagtacctctttacacaggggcacgaaaaaattctaggaatttttcaaattgatgatttgcaaggtgttcaccgcatggatggctttattcatgcctacctcaagcatccaaagatttcctacctcagtgaaatggtgatgtatcagtccagcgacgaaatggctaagatctttgataaggtttcagcgatcttttcgcgggaggaccggccgaccgccattgcgtgctacaacgatcaattagccattcagattattgatgtcgttcgctcactggatctacgtgtgcctgaagacgttgcagtggtgggctttgatgactacgaattaagcaagtacattgaacccagcttgacgactaccgttcatcctaaaggaaagatgggaatcgatgcggggaagactttgatgaagctgattaatcacgaggaagtcgattccatttcgtatgatttggatatgcggattcgaaaatctgccggcattaagaaaaattggtccggtatgtaattaaagttattttataaatttagcaaaaagtcgctgaaatcagcggcttttttattaatttaaaaactttttttgtggtcgttttaccggccagatggttagtatctaagggatttatgcgagttaaaaatggttaaaaggatatttttatgctatcaaaaaaagtttttgttgatttatacggacaaatatcatacaatatgtatgtaagcgatttaagtgttgcaaccacttggatggaagcgccgttcaaagtgcaacacaataaattaaaaaggagatcatctcatgtcattacaagtacctgattatgaattctggtttgcaactggtagtcaattcctttatggtgaagaacaactgaagtcagttgaaaacgacgcccgtgaaattgtcgataaattgaatgcaagtggcaaattgccatacaaagttgtctttaagttggttgctacaaccgctgaaaacatcactcaatttatgaaggatgccaactacaacgataacgttgccggtgttatcacatggatgcacacattctcaccagctaaaaactggatccgcggtactaagttgttacagaagcctttgcttcacttagcaactcagttcttgaacaagatcccatatgacacaattgactttgattacatgaaccttaaccaaagtgcccatggtgaccgtgaatacggctacatcaacgcacgtttaggcgtaaagaacaagattgtttacggctggtggggcgatgaagaaacccaagaagaaatcggtaagtgggaagacgttgcagttgcctacaacgaaagccaaaagattcgcatcgttcgtttcggcgacaacatgcgtaacgttgccgttactgaaggtgacaaagtttcagcacaaatcaaatttggctggacagttgactactatggtgtcggcgacttagttgaagaaatcaaacacgtttctgaagacgacgttaacgctaagtacgaagacttacaaaaagactatgaattcgttgttggtgacaacacacctgaaaaattcgaatcatcagttaaggaacaactccgtcaatacttcgctttgaagtcattcatggacaagaacaactaccaaggcttcgttacaaacttcgaagatctttggggcttgaagcaattgcctggtttagctgctcaattattgatggctgaaggctatggcttcggtgctgaaggtgactggaagactgctgccttaggtcgtttgatgaagatcatgtcacacaatgacaagacgatcttcatggaagactacacccttgaattacgtaagggcaaagaagccatccttggttcacacatgcttgaagttgacccttcaatcgctagtgacaagccacgtgttgaagttcacccacttgatattggtggtaaagatgatcctgcacgtcttgtattcgccggctcagatggtgaaggtatcgatgtaacattgactgatatgggtgacgacttccgtctgatttcatacgaagtaaatgctgcgaagactccagaagcaacaccatacttgccagttgcccaacaactttggacacctaagatgggcttgaagcacggtgctactgaatggatccgccttggtggtggacaccacactgttctgtcactttcacttacgactgaacaaattcaagaatttgctgacatgatcgacttgaacttcgtcgacatcaagtaattcaatgatataatgaagccggccagtaatggtcggctttttttatgggtgcgatagggagctggagcactacgacgacatgtcatgggagttgataattgtgtatgataattgtgtatcaagcagatgaacatcgttacgacacaatgctttaccggaatttaggaacatcgggactcaaagtttccgccattgcccttggcttttggcataactttggtgacacaaccccgctgagcaatcagaaaaaattagtttttgatgcgtttgatcgaggaattacgtacttcgatttagcgaacaactatggcccggaacctggagctgctgagaaaaactttggtaagatttttcacgatcatctcacgagctatcgggatgaaatggtgatttcatcaaaggccggctatactatgtggcctggaccttatggcgactggggatcacggaagtatctgattgcgagtcttgatcaaagcttgaagcgaatggggctcgactatgtcgacattttctaccatcatcggccagatccgaatactccgatggaagaaacggcacgggcattagatcaaattgtccgtgatggcaaggcactatacgttggtatttccaattattctgccgaccaaactaagcagatggctgctttattaaaggacctcgggacaccatttattgtgcatcaaccccggtacaacatgtttgaccggtggattgaagatggactcacggatgtcctcgaagacgagggcgtgggggcggttgtctttagcccgctagcacagggtcgcttaaccgatcgttacctacacggtattccagaggactcgcgggctaatcgttcggatagtcccttcctgtcgaaagaccgggttgaaccgaccattcggatcgctcagcaactcaatgaggttgctcaacaacgggggcagtcactggcacaaatggcgctcgcttggaatctgcgtcaaaaggcagtttcaagtgtgattgtcggtgcatcaagaactgcccagctcgacgataatattcaagccttacagcatctcgactttactgccgcagaattagcgaatattgatcgtattttgaacggtgctgaatttaaatagcgttaaaaaaagactgagaaattttttctcagtcttttttgtcgcttgaattaggaaccaagcttaattcaatttaacgacgtgccaacccggctttaggctgaattgatcgtactgtcgaacaaattggtgatcgtttcccgaaataccgaacagaatacgaagttcctcgctggaataaacccgatagaccttcgtaatcttaagctggttggtcgcttggttttgtttgaccatgaccgtggtggtggccggattggtctttttcaatgttttaacgagtgggttagtctggtacagataaacccgttcgtttttagtgccgagttgccgataccacagctggtgaccgtgttggctactggaggtgaggggataggtaatcgtggttttcacttccgttgtcccaaagtggttgtggtagttaagcacgatcaatccgatactaccaagcgtcagaacgagcccgaccgcgacccagcagttctttttgaagctgggttgcatgaaaatcatggtggcggcaaacagaaccgcaccaataaagagcaaaataacaatcattaatcccaccttctttcgtcttttttcaagaggaaggtgagcgcaaacccgacaaaggcaaagatggtcgcaatcgcaaaggcgtaacgaaagccaaggacgttagcgttgagtgctaaatggcgataggcgatgggagttgccttcgcaacggcactgctaggaacatggttcatggtgacgtttgacatgacagacaccaatacggcggtccccatggatgcgaagacttggcgcgcagtgttgttaacaaccgtcccgtccccaatgagggttaatgggagggcgttcattcccgtggtagtaacgggcatcatggtcattgagatcccaaacatccggaccatgtagagacacacaatgtacaaaatcggtgtgttggatgtgatcggaatgaatgcggccgtcgtgatggtcagaagaaacatgcctgtaatggccatgttacgggcaccgagtcgatcaaaaatccggcccgtgatggggttcatcaccccgatgacgatggcaccggggaaaagggttaatcctgaagcaagtggcgattcgccaccaacggtttgcaggtacaggggtaagaccagggtaaacccattcatcgacatgaacgaaacggcaaccaaaatacacgaaagggtgaatgccggacttttaaagacgttgaattgtaaaaggggattcttgattttgagggaccgctgaataaagagtgcgatcacgactacccccacaacgaggctgacgtagacgatcgggtcggaccagttgtaagaaccgaccatcgagaacccgaagagcatggtgccgaagcccacaacggaaaggaggacggagaaccaatcgatgggagcgtccttcgtgggcaataccttgcgaagggttatacttcccaagatgatgacgatgattgaaatcggcatgatggataaaaagagcatccgccatgagtagtggattaaaatccagcccgaaaaggtcggtccgattgcgggggctagcccgataacaaggccagcactccccattgcggccccgcgttgggacggtggaaagatggaggtcatgatggtttggtaaaccggtgaggcaaccccgaccccgacggccataaccaaccgaccggctaggatcgtataaaaggtttgtgcaaagtaacagacgacggtaccgaccaagaaaatcaacattgcgctaagatacagtttacgagaatcgaagcgtcgcaagaaaaagcccgtgatgggaattgtgatccccatcattaacataaagccggttgttaaccattgaacggtattggcagaaatgttgaaggatttcatcagggttggaaacgccgtggtgagcatagtagaagtcagaaaagtactaaatgtaccgactaataacgtaaaaacgagggccagtcggttgtagggcttcccgttttgatctaatggttttgtttcagatgccatggatggcaactcgatcacctcggataaatatatttgcgttcgcactaaaaagacacaaatgctattgtagcacgcgaagtgagataaaaaaagtttactgccttttagcagtaaactaatcgtggtggtcgcctatagattttcgtccattttgaacgttagttgagacaattctaacccgtgcatgatcaggtcttcaatcaagtgcttggtccgatcggccattgcttgagtcattgcatgattttgttgtgtcagataggcagttgctgcagtggcatccatgtcacggaccgcttcaattgcttggtcaacgaactgatagtggaattggcgtgcttcttttaagtagtccaaatccgccgaaataaactgagcgtggtggctttccaccagcatggagagggtccgatacatccaataggcactgtctaagctaatgtcgagacgcattggtgtttgagcgtagctaggatcagttgcggtggcattgccgaagaagggcacgtacggcgcaaatgagggcacgccaaagcataaccacatgatcgcactggcagcctcaggggcgtcgttacgaacttgcaggatgtgagagttttgggtccgactcagtgagattggacggtaacggtgcttatcagcgtcactaccatggccgaggggatcaaagtcggtttgattgtagtggctgcctaaaacctgttcaattgcttgcagggtaattttatgatcggggatgacgatgaacggcagatcaaagtcttcgggatcaccggcatcgagcccgttcaaaattttgtgggcgtaccattgccgcggtgtgttgtagtgttgatcgaattcggtagcagtaccgaaaatatggcggaagttccagccatgatcatcgggatttaagtgatgatcgctgacaaattcttgaatgccatcggaccacatgaaattatcggtgtcgctaaagtccacttcttggatggcaacccggttgccggtcgccgcgtaggcattgtctggaattcgttgggcaacccagtgatgaccggtgacaatttccatataccagatgtcgtgacgatcgctaaagatcacgccgttgccttcgggcgaaccatattgcgcaatgatgtcacctagacggctgacaccttcccgcgcggaatcgataaagggcagaaccatggcgaccatggcatcttctgcgagtccgtctgccaccaggggatcaaaagccagcactcgttcgttggcgtagacgctttccgtcgcactcatgccgacattttgttcgttaaagccattttcatcgaagacgccttcgttgataacgtcaacgttaggggtggcttggtaacggtagccatgggcgggcgtttgtgcttcaaacccgtttttataggatttaacggttttgctcgtgtcaaatccgggataaatgacgaatttttgtggtgtcagcgggcggaaagtgtcatcgttgcgggccgccattgtggaaccatcaatggtcgcctgtttgccgacgaggacggtggtacaagcagataagttttgcattaaaaatagatcctttctgaattgtgatacttcattttaacgctttgaaatgagaataggaattaattactgttgcgctaatgtggtgagggttgctttgatttcaacaactgaggcttgacctggtgccgaggcggcaccaaccgtcccaaacgtggcaatactcccaaacgtgtcgcccgccaaccgggagatgcggcccaaccgacccattgacatcgcaataatgggcggttcaatttgatgatctgctgcgagggtggcgtccatgagcgccatgacgtcttcgcgggcgtgaggggtgaccgcgattttaacaatcgaaggggcctttttggccatttgggcgaacaaaaagatgaggttatctttctcgggcgtttcggcgaagtcgtgatggctcaaaatagtggtgacgtggtggtcgctggccagttgatgtaatgcgtcgtaggtcgcgtcgtcttgtgaaaattcgatatcgatagcgtcgacgagcttgtgggtgatcagagcagtgtagctttcctgatagtcaggtccctgatagtctcgttgaccgccttccgtactggttcgattggtggcgataatcgggacctgaccagtgattgtccgcagcgttttggcggtagcgatcagttgctcagtattagttaggtcagtcaggtaatcgagccgccattcgagcatatcggctgctgaggcaacgatttggtgagcctgagtgagaacgtcatcgtaagtacgagcgacgatgggggcgattactttctggccggcttgaggaccaagtgttagcgtgccaatggtgattgttttggaattagtaggcatagggtgggactcctttggtaagtttctttgacagtatcattaatgggagactgattcaataagaaaagcgatcggaatttccgatcgcttttgactatctcgttagtgagactatttagcgttttgttgggcttccaatttggtttccaattccttaacgatctgttcatgtttgtcttcagtcagacgaaccttgaatagatagattaatgcggcaatgaggatcaagaccattggcccgtagaacatgtatgatttaaagttcaataattgcagtgtgctaatgctacttggtttagcgttaccaatcatcccagagtgaacggcagcgatcccgacaaccccgttagaaacggcaccggcgaccttatcgatcaacggccggactgaaagtgttacggattcgttccggtttccgttcttcaactggccatattccacgctatctgtgatggtcatcaaagcggccaagaagatcattgggtatgggaagaagaagattgaaacggcgattaggacgatcaggatgttttgaccggcaaacaagaagagtgcataaccgattaacatcatgataatgccgccgacgtaaatggcacgacgcttaataacggcgacaacggcaggaaacagtgaaacagaaataataccaaggatggcggtgataaccccgaccagtgagaatttaccaggttgtccgagaacatactggaagtagtaggcgagcaggttattcgtcaatacgtaactcagggcgaataagaagtatgacaaagccaaccacattaattgatcgttttggccaatcaccttgaagacgtcgcggaaacgaactttttcggtgttgttccgaatcaggttcttttgttctttggttcccatggcggtcgccaaggcccctaagaaggaaatcaaaccaacgacaatcgcaaatcctaaccaaccggtcttagttttggtatcaccagacgtgccggagaaggtctgtgagaagaagatgattaatgggaaaataaagattggcaccccttgggcacccaatgtggaaccaaaacgaccgattgttccaaacttagcccggaccttcgaatcaacactgagtgcggggagcattgaccagaaggaaatatccttgaatgaataaaaaatatccaaaataacaaatgcaattccaaagaggacaaggtaaagaaccgggttgctggtggtcaaaccaccaaagtcagtgaagataacggccagcatgattgaactgacaagggcaccaactagcaaccatggtttgaatttaccccaccgggtttcggtattatcaacggctccaccgatcaatggatcaaagacaatttcgaccagtcggatgaccatcattaaggtggttaccgaggcgatcatcttggtattgaaggcgtggttgctggtatcgaatagttgactggtaacaaaaagcatcaaataggtacttaacgtggcatagaaggtatcatgtccgaaggcccctaacgcatatgacgtatactgcttagcgtgactcataatttttcctcctcaaataatgagactgtatcaattaatagcggcgttcaataatcttttgcaagatcttatcgcgttgtgtttcctttgcaatgtcaaaacgagattcctctaaatcgttaaagttgtcgatcagcaccaatgattccagatacagacgtaactgacgcttaatgtacttgacgtcggcttcatcgggttgctggttgctgccttgcaataccaatttggcgaattccgttggatcaattttgattttatcgttgttgttagccaaaataaatcactccctaataatgattagttcaacgatgtaaacgcttgccttaatgtaaaacacaatggttaaaaaggcaaggattttttagtaaaaaacgcttgttaaaaactgaattagtttttaaaacgcctatatgaaagcgctttagacgttagtaataatttactaaaaaaattcaagaatgcaaaaagaatagtcttatcataccggattacagtacatttgttaatgctttttagactaaatgaaaataagtgtcatatttttgcatacttcaatttcatttgatgaaaaagatgaaaataggttggttgaactgcgttactataatgtagctataaaaaaccacccattcaatttcgcaagggtcaataatttttttgagattatggttgacagatagtttaattattgttaaagtgtgtttaatcaatttcacaggagattttaatatgcgaagtatcaatttattacaattgaatagcttttattactattggtttatgaagtgatgtttgagtctaactcagacgcaaacatcacgtttgcatctgagtgaccaatagtttttaagcatattaaaaaatatttgccacatagatgttaaggattttgaacaataacattgtgtggcgtttttatttggtgatgaccatctctctataggtggactgaagcctcacagtgttaggacactgtgaggctttttattttacctggaggagggcgaattatcatgagagagaacattgagattagtggacagacaaggttatacggattatttgctcatccggcgcaccacagtttatcgccgctgatgcacaatacgagcttcaataatcgggaaattgatgctcggtacctggcgtttgatttacaaccagctgatttgacacagggcgttgcagcaattcgggcgttagacttgggcggcgttaacttatcaatgcccttcaagcaaaccatcattccgatgctagacgaaattacaccgcgggcccaattattagaatctgtgaatgtgattaagaattctaatggtcatctcattggtgacagtgtcgacggcgaaggattcttcgctaacctgattgcagaaggggtaacggttgctcagcaagcgatggtggttttgggggccggcggtgctggtttatcaattattcaggccggcattgatcatcagttggctgaaattaccgtcttcaagcgtcgcaactcacgttttgagcgggtagcacagcaactcgcaacaatggccgcagggcgttcaacgaaggtgcgccttgtcgactatgacgatgttgcccaaatgacaacggtcgtggcccgaagtaccttgattgtcaacgcaacaaacctggggatgggcgactaccaagcccaaatgcctgcgccacctggtgttttagctcagctcaacgcacaccacgttgtgtgcgacgtcatttattcgccacttgaaacacagttcttatcagtcgccaaacaaaaaggctgtcaaacatttaacggtcttggaatgctgatttatcaaggcgctctcagttttaaattttggacaggacaggatatgccagttcaactcgttagaaaaaccattcaaactcaactcaaccaacaatagaaagcaggaattcaatatgattatcattctaaacaacagtaaagccgcccaaaccaaacaattgctcaatacccacttcgggggcaaaaccgatatcttcacccatggtaaccgaattgccctgaacaaggtgacaccggatcaattgaccgacgatgaaaaagccggaattgccgacattatcatggatcacccaggtgccgtgcaaagtagtcgcgccctccacccagaagacacaattattaaattgcctcacacccaaatcggtggccatggaaattttgtgatgatggccggcccatgttccgttgaatcagaggcccatgtgagtgcaatggctaaggtagctaaggacggtggggcaacagttctgcgtgggggggccttcaaaccaagaacctcgccatactcattccaaggtttgggtgttgccgggttgaagtacctgcgtgaagcagctgacaagcaaaatatggatatgatcaccgaagttatggacgaagaacatttggaagttgtttgccagtacgccgacatgattcaaattggtgctcgaaacatgcaaaacttctccctattgaaggcggtcggtaaaacacggaagccagttttgctgaagcgcggaatgtccgcaacgattgatgatctactcaatgcggcagaatacattgccgctggcggtaatacccaaatcgcgttgtcagaacggggcgtacggacatttgatgacaaatacacgcgtaacacgttcgatgtcagcgcagtacctgttttgaagaagctgacccactacccaatcattgccgatccaagccatgccgaaggtcactgggatttggtgactccgatggctctggctgcgacagctagtggctcggacggcattgtggtggaaattcatgataacccagaaaaagccctttcggatgggccacaggccttgaagccgaagacttacaagaagatgacgagtgaagttttcgcacttcacgatatgctcaattcattcaaccaacaagaaggtgcagttgtaaatggctaaggtcgaagttcagttaccacaaactcaatacacggtgttgattgaacccgggttgctcaatcagattggcgatttaattgctaagcagtggccgggacggaaagtcgcgttgattaccgattccaacgttggcccgttgtaccagacacaagtgagcgatcaattgacggccgccggctttacggtttgcgactatgttgtcccagctggtgaggcgtctaagtcttggccagtcattgcggatttagctgctaagatggcagccgaccacttcacccgtagtgatggcgtgattgcccttggtggcggggttgttggggatttagccggctttacggcatccatttacatgcggggaatctcgtttattcaaattcccacgtcattgttggcacaggtcgatagttccgtcggcggaaagacggccattgatttgggagatgccaaaaatattattgggacattttaccaacccgatgcggtctatatcgatcccaacacgctagacacgatgaccgaccgctatgtggcggagggctatggtgagattgtgaaaacggcggcactggattctgccgatttttggcacctgattgaacagattaattcggtggccgatattcgcgcccacgcaacggagctgagtcgacgcagcgtgtcttacaaggcacgcattgtgatggccgatgaaaaggaggctggtcaacgccagttacttaattttggtcatacgatggggcatgcgattgaactattggcccatggtggcctagcccacggggaagccgtcagtgtgggaatggttcacattatgcgggtttttgaacaattacaattaactaagccaggaatcactgctgcaatcgaagagcgactcaaggcggtcggtttgccgacagaatccgcgttactcggaaccccagaattctatgaaaaaataaaaaatgataaaaagaataaaaatggtacactaaacttggtttatgttgaagactacggaaccccgcatatttacggaattccgactgatgaagtcaaggcatttttcaaggaatagttaatgaaggaacagtaggaaaggtaggcatgatcacgtatgcgctatgtaacagcaggagagtcacacggaccagaattaaccgccattattgaaggcattccagccggattgaaggtttcggccgatcagatcaatgacgatttaaaacggcggcagcaaggatatggacggggaaaccggatgaagattgaaacggaccaggtcaagattttatctggggtccggcatcaagaatcgttggggtcaccgatcacactgaacgtgacgaaccgtgatcacgcacactggggtgaagtgatgtcaccaaccgcaccagccacaccagaaaatagtgtccgccaagtaacccggccccggccagggcatgccgacctagttggtggaatgaagtatcgccacaaggatttacggaacgtgttggaacggtcgagtgctcgcgaaacaacgatgagggtggcggttggtagtttatgtaaacaattgctggctgaaattggggtcgaggtgctcgggttcgtgaaagagatcggtggcgttcaagccgataatgccaagatgagccaatacgagaatcttacacaacttaaaaaggccacggatgagagtcccacgcgcacgtttgacgccgaggcggatgagaagatgcgggagctaatcgataagaccaagcgtgatggggacacccttggcggcatcgtggaagtgattgcaacggggatgccggctggcttaggtagctatgttggtgccgacaccaaattggatgctaaattagcggccgcaatcgtgggcattaacgccttcaaaggggtggaattcggtgatggatttgaatttgcccaccatccggggagcgaaggcatggatgaaattttctggaatgaggatcaaggttttttccgtcagaccaaccatttaggtggatttgaaggcgggatgacaaacggccaaccgatcgttgtgaaagcagtcatgaagccgattccaacgctttacaaaccgttgatgagtgtcgatgtgaaaacgaaggaagcctataaggcaaacgtggaacgttctgataccaccgccgtaacggctgctgccgtggttgcggaagcgatggtcgcgattcaactggcaaccgccttactagacaagtttgacacggattcaattgaccggttgaaagaacaagtggccacctataatgaagaattaaaacggtactaagcaggccgtgatttaaaagtgatggcagattacgagcaaggggatatcaagatgacaacagtcgaactaccgaaaagcgaaaatggccttcatggcacactcaccgttccgggtgataagagtatttcacaccgcagcattatgttaggcgcaattagtcacgggacaacggtggtgaaccactttttactgtcggatgattgcctccatacgatcggggcgtttagggaattaggggttgcgatcgcggttgatggtgatcaagttaccattgaaggtaagggaggctttgaccactttactaagcccaccaaaccgcttgatatgggcaactctggcacctcaacgcggcttttactaggcttcttgagccaccagccatttgatattgacctgtttggggatgcgtcacttagcaagcggccccttgatcgggtgatcaagcccctggctaaaatgggagtgcatgtgaccgccacggatgataattttttgccggtgactctgcatactaatccgcaacttcggggccttgattaccaattaccggtagcgagtgcccaagtaaaaagcgctctggtttgggcgggcttgcaggcggaacaaccgagtcatttgactgaaaagttgatcacccgggaccatactgaaaaaatgattgcccagtttgggggccatttggaacaagacggtctggaaattacagtgacgccacaggatcactttgaagcacaacagattacggtaccaggtgatatttcatctgccgcctttttcttggtggcggccgcgtgcgtacctggcagtcagattaccctcaagcaagtgggacttaatcagacgcgggatgggatcttaaaggcactggatcagatgaacgcccattacacgattacgaaccgctcgacagatagtgaaccggctggtgatattacgattgggtaccaagcattgacggcgctgaagctgggtgcaaaagacattccagcggtcgtcgatgaagtgccactcattgcattggcagccacacaggcccaggggacgacggtcattaccggcgccgaagaattacgggtaaaggaaacggaccggattgcgaccgttaccgaggaactgacgaaaatgggtgcgaagattacgccacaacctgatggcttcattattgaaggtggcacgaaattgcataccgcgacgacgccgttagattcccatggtgatcatcgaatcgggatgatgctggcggttgcgaacctgattgcgggtggaaacagcgttttaaacaacgcggattcaatcagtgtttcataccctgaattttttaacgatctcgaccaattgcgataaagaagaggtagcggcatgcaaattgtagtaaacgggttaggtgaaatgggtgcgtcattagcactcgccattaaaaatgcgaataccaatgtggagattatcggtgttgaccgtaatcaggcggcgctggatcaagcagcggcaatggggctgactactcagacgacgactgacttaatgacggtcgcggctcaagccgatgtgatcattttagcgacccccattcgagccattatcgcaaccctgcgtgatttagcgcaggttcccctcaaagaaggggtgctggtaactgataccggaagcaccaaggtccaggtgatggcggctgctcaaggtttaattaagcggcagattgcctttgttgggggccacgcgatggcgggcacccagaaggcgggcatccatgcactggatgcccacctctatgatggggccccctactttttggttggtgacgatgtagcagctcaacagcggttgcggacgttattagctggggtgggggttcaattaatcccgatgccggccgagcagcatgatcagatgatggcctacctgagcgacctaccacatgtcgtttctgccgcactggtgaacagtacgcgtcaaactgcgacccagtatcctgagctgccccgttatgcggcgggcggatttaaggatacgacccggattggcggcgctgatccgcaaatgtggacggatattttaacgacgaatcgggctgcgacgttggccgcactgcatagttatcaggacagtttagcgcaactcgtgacggcactggaacaagatgatccccaacagatctacgacttttttgcggcttccaggcaactgcggcaaaagtttgaggaggaaatgggatgaccgataaagtagtactaattgggtttatgggcgccggcaaaacaactgtgggtgccagaatggccgcccagttggatacatatcagcatgatttagaccagattatcgaacagcacctgggcgaatcgattcaggatttttttgctcgggaaggcgaagccgcttttcggacgttagaggcgcaggtcttggaccggcaactggcagaaaccggcatcttgtcgactgggggcggggtggtgatgaccccgacaagtcggcaactgttgcagcgcacagcgacgccggtggtttacttacgaacacagccggaagaattgttacgccgactgcaaggtgattcgcagcgcccgctactcaagcagatggatcgggagggtttcatggcactgtggcggtaccgagaaccgctgtaccaggccgcagcggatgttgtggtcgatacagacggcctgacgattgatcagattgtgacactaatttcaaaacgattggagcaaaactaaactgatggatgaactgcgcaaacaaattgatgaatatgataatcagattatgaccgcccttgataagcgctatgacgtggttaaacaggtggcgaaatataaagaggctcatggattacccgtgctgcagtttgatcggatgacgcagttggtcgatcgattgacggagacgtatggcagtgaaaacctatcgagcgattttatcgcgcaattatacgatctgatcatgcaccacgccatcgaactcgaaaatgagacaattgatgactaaaatacgaataatgtgagcattattaatctttttaatgtaaatctcatttttagtgttgacattcacattttaggggagtaaattaataccaatcaaacaaatcaaaacaagcaatgacaaggaaaagtagaagatatgagtgttgatacagagaacttcgtttgctgagagaagccgcactgattgatttcgaaagtagcctttgagctatccgctgaaaataagtaggttggattgggagtgcccattaatgcaccgacacattagactttatcaggatgagcggcgtccagcgcgacagctcgtttggtctcagtgatttttggctgtgatgattctgctcttaaggcgctagtgtgtgatagaggcagctacggcaacggagctgtaaactaagggtggtaacacgcagaagcgtccttaagatcttttaataggtcttttgggcgcttttttgtgtccgcaggtgggccacgccgtttgatgcaattatgataatgaaagggtgagggtgtatggaaatgacaatgacgattgagcatatgatatgtcaacattgtggtgcagaagttccgtttggtaaatattgtagtgagtgtggcaccaaggtgttaagtcaccagggatcagaacaatatcaaaccacattttgcgttaactgcggtgccatgacacccgatgccaagtattgctcacggtgtggttatgagaaagattaccagcatttttaagaatcttaacctacaaaataaaaaaactttattttcaaaaaagtagttgacattacgcaaaattatagtaagttaatacatatagattttaatcaaattctaatttgattctaatcattgaaaggaggtgaataaatgcaaacgaaacagtcaagtaagacacaacttagtggtgcagagttgttaatcaattctttatcaaaacagcaggtcagcctcatctttggttatcctggtggaacgattctccctcaatatgatgcaatgtatcgcaagcacttcaaaaatattttggtgagacacgaacaagcagccgcacacgccgctgaagggtttgccaaatcaactggcaaaaccggcgtggtccttgtgacaagtggtccgggtgcgacaaacgcaattaccggcatcacggatgcgatgcgtgattcagttccaatggttgtcttcactggtcaggtgggcaccaagctgatcggaacggatgcgttccaagaagccgatgtgctcagcctcaccaaatcaattaccaaacgtaactaccagattcgttcagtcgatgaaattgaatcaactgtcgcagatgcgtttgaaactgccaactctggtcgtcgcggccccgtggtcgtcgatctaccgaaaaatgtgatgtcagaaaaaattgaaattgatgagaccaagccagtgaccaaccaaccagcaactcctcagatgagtgctgaaagtgctgataacctacatgcgatcattcaagcattgaagcacgcaagtaagccattgatgattgcgggaggcggcgttgtcgcagcacaagcaagtccagaattcatagaatttgcgcatcaacatcagattccggtagtcagttcactacttggattaggggtactccctaacgcggatccgttgttcatgggaatggccggcatgcacggctcctacgcagctaacatggcattacataagtgtgatttattgattaatatcggatgtcggtttgaagatcggctagcaacaaacacgaaacgatttgcaccaaacgccgaagtggctcatatcgatatcgatcccaaagagattggtaagattattgagaccaagtatcaggtggtggctgatgcaaaggatgcgcttgatcagatgttgacttatgacaccacggcagacacgcatgccgaatgggtggctgaaaatcaacaacgtaaagcacaacatccttatcactatcggaagcaagacggtgcaatcaaaccgcaacagttaatcgaaaaagttggtgcattgactgaaggtaaggcgtacgtggtgaccgacgttgggcaacatcaaatgtgggcagcgcagttctatccgtattcgttcccacgacaactcgtgacaagcgggggacttggaacaatgggatttggcttgccagccgcgattgggacccaattcgcgcatccggatcaaccgatcattttgtttactggtgatggcagtttacaaatgacgagcgaagaaatggatgtcttgagtgcctatcacttgaatgtaaaagtgatcttgttaaacaacgggactctgggaatggtgcgccaatggcaagacctgttctatgatgaacgacggtcgcaaactgtcttccatgaacagccggatttccagaagctagcacaagcctacgcacttgaaaactaccttcttgatcctcatggaaattgggagcagcaattacaacaagccttatcttcagaacactcagctttgatcgaagttccaattccgaagttagaggccgttgaaccaatgattacccctgggcaatcaaacgaccatatgatcggtgtggattagagtgtttctgcggtagttgcacaggcaaagttttaacgaacaaactcaattagaattagacaaacaattataaatggatatataaattggaggaaaatacatatgtcagctgatatgctatatgaaaaagacgttactacaaactacttggacggcaagaaaattgcctttatcggatacggtgctcagggccatgcccaagcaaacaacttacgtgattcaggcttcgatgtcatcatcggtgcccgtccaggtaagtcatgggatgctgctaagaaggatggcttcgatgtctttaccgttgccgaagctgctaagcaagctgactggattcaagtattaacaactgacgaaaacatgggtgacatttaccgtgaatcaatcgccgatggccttgaagaaggaaacatcttaggattctcacacggcttcaatatttactacggcgaaatcaagccaccaaagaacgttgacgttgtcatcatggcccctaaaggtccaggtaacctttgtcgtcggacttacaaagaaggcttcggggttcccgcattatacggttactggcaagacttttcaggtcatgctgaagacctttcaaaagaatttgccaaaggtaacggggcagctcgtgccggcttactgaaaacaacattcaaagaagaaactgatgaagatctcttcggtgaacaaaacgtcctcatgggtggtgtaactgccctgatcgaaactgggtttgaagttttgactgaagacggctactcaccacaattagcttactttgaagtacaacacgaaatgaaattgatctgtgacttgatctatgagggtggtttcaacaagatgtatgctgactgctcaaacacttcagaatacggttcatacgtcatcggacctcgtgtcatcggaccagaatcaaaggctgctatgaagcaagctttgaaggaaatccaagacgggacctttgcgaagaacttcatggacgacttccgtgctggcttcccagaccttaagaagatgcgcgaacgttcagctaattcacaactttcacaagttggtgcagaattgcgttcgaagatgccattcgttaacgatgctgacaagtacagcacaccagaagactaggcagacgattccaatcagtctttgacgggcggactcaaactgccggtcatcctctaaagtaatgtaaacccaataaaaaggggccgcagtcacaatcgtggcgggctctttttttacatattaacgaatgtattaaggctgaaacataaaaattaagctaacgatttcgatcaatttcgatgtcagaaagcaatgcgatattttttaaccgtgagtgaatgcgcgacgacgcggacgcaaccatgtcgtttgacgccttaatctgcagatactaggaagttaactattttgaaagcaactaaaaaaagaaagggtggtggcgaaatggcagtcacagattcagaaccagtattaacacagtcagatgtcgaaaaagcaagcgaggtgttggcacccattattcgccacacaccgttacaacatgatgtttacctgtcacaacgttataactgtcaggtctatttaaagcgtgaagacttacaagaagtccggtcttttaagattcggggggcctattacgctatcagccagacaacgccggcagaacgaaaacggggcgttgtttgcgccagtgccggtaaccatgcgcagggcgtggcgtggacctgccatcacatgggcgttcatgcgaccatctttatgccaactacgaccccgaagcaaaaggtaacccaggtccagttcttcggtggcgatgacgtcacgatcaagctgacgggcgatacgtttgacgcttctgcgagcgccgccactgaattttgtgagcgcgaaaatcaaaccttcatcgcgccgtttgacaatgtcaacacgatggctggtcaagggaccattgcaacggaaatttttgccgatgcccaagatagtgacatcgacgtggactacatcacggtcgcaatcggcgggggtggcttgattagtggtatttcaacctacaccaagggggttagccctgcaacgaaagtggtgggcgtggaaccctctggagcagcctcgatggcggcagcctttaagcaaggacagccagtaaccctcgataagatcgagacgtttgtcgatggcgctgcggtgaagacggccggcgatttaacctatcaaacggctaagcgcaacgtcgatcagttggtacaagtaccagaaggcgccgtgtgccaaacgattctagacctctataccaaggaggcgatcgtagccgaacctgccggggccctgagtgtcggtgcattggaaaatattcgcgatgagattaagggcaagacagtggtgtgcgtcattagtggcgggaacaacgatatcaaccgaatgcaagaaatcgaagaacgggcgttgatttacggtggtgtgcaacactacttcatcgttgattttccccaacggccaggggccctgcgagaattcacgaatgaagtcctcggaccggatgatgatatcacgaagtttgaatataccaagaaggttaaccgcgggcagggacccgttttaatcggggttttgcttggtgatcgcaatacgtatccggcgttgatcgaacgaatgacgaagtttgatccccactttatcaacctggttgataatcaaatgttatatacgatgctggtctagtcatttagagtgaaaggagcgaggaacttgacacaacccattttgtcatttagagatgtgtccttacaacgtgggcaacgacaaattttaaaacacatcgattggacgattcagccacgcgaaaactgggccattcttggcttgaatggtgccggtaaaacgacgatgctaaaaattattcatggtgatttatggccatccgaagggcaaatggaagttctcggtgggatctttggtcatacttccattccagaattgacgaaacggatcggctgggtgagtaccgccctccaagactggctccatcctggcgacctagttgaaaaaattgttctctcaggcaaatttgccagtattggcatttatgagcagtttacgaaggcggaattggaacgggccaaagaaattctcagcgaaatgggtggcgccaagctgattggtaaatcataccgggtcttatcacaaggcgagcggcaactggtgatgattgctagggccatgatggcggaaccagaattgttaattttggatgaaccctgcaacggactcgacttgtttgcgcgcgaagcgttgttacaacgggtggctaaaattgccacaatgccgaaaagtccggccctcctgtttgtttcccactacacggaagaactgatgccatgctttcaaaatgtcctcctgttaaaggatggtacggttttccaacagggcaaacgggatgacattctaactgatgatacgctgagtcacttttacgcggcaccgattcaaaccgcacgaattggcacggatcgattagccgtttatccgcgctagtgttactaccgaatgatctgaataaattgaatgaaaccaaaaagcacttatcgctggggcaaggtcctggtggtaggtgctttttgcggtctcggcatggctgctatcggtaatgagaccgaccatttaaccgtaagttattaaattttccttagaaaccggattaactaatattagtgttaactaatttttagtataatgtgattatagatagtaccagtcattatttgcgatttggaggatttcaatgaacaatcttggaacaagcagctggttactcagagtgcttaagggcgcgctgattgggacggggtttattttacccggtattagcggtggggccctggcgacagtctttggactgtatgaacggattatcgaatttttagctcatccgttgcgacattttaaacgaaacgttttcttttttctaccagtcggcattggggcgattggcggaatttttttactctcctatgcggtgagctacctgctgggcaattttgaaacggtcgttctctggttttttattggggcgattgtaggcacccttcccgcattatggcatgatgccggtcaacagggacggcagccacgggatattgtgatcatgctgagtgcgctggcggccatgcttttgtttttacgattcggcgcgccattattgacaacgcttgagccgacctttggagcctgggtgctcggtggcgcactgattggtctgggcctggtgattcccggtctgagtccctctaattttctcatctatttgggattgtataaggggatgaccgatggaattaaaaccggggatgtgaccgttttgctgcccctgctagtgggggttggattagtgatcgcgttaatggcaaagctcatggcgtatttatttaaggtcgtttatccccagctattccactttattctaggtgtggtgttagcgtcgacggtgatgattgtgccgagcgagacgcttcagttggcccccttagaattgggtgcagcgggtgcgttattggtgttaggaatttggctaggttggtggatgagtcgcttggaccaacgtgttcgaacaagtaaggaggatcctgattgactgtaagtttggggtattggattggcttttttgcgtttattgtggtgatgctggcactcgacctcggtgtgtttcacaagaacaatgaaacaccgacgattaaatcgtcgctactgtggagtgcgttttggattgggttagcgtttttgtttgccggcggtgtttggctgttcgccggtggtgagtacgccttagactttgtgaccgcgtacctgctggaaaaatcgctgagtattgataatctgtttatctttattctggtctttggcttctttcaaattaaaccgcaataccaacaccggattttgttctggggcgtgttcggggccctcgtaatgcgggtgatttttatcttcgccggtgttgccctgctcgatcggttcaagtggctcatgattttatttggcctgtttcttgtagtaaccggtgttaagatgctgtttgaaaagaaagaccacgctgatgatctaaatgataacctcatcgtcaagggcttacggcggctacttccgtttaaagaagacgccaccgtcccgaagatggtgctgcgggttgacggcaaattaatggcaacccagtttctgatggccctcttatttattgaagtgtccgatctggtctttgcggtcgactccattccggctgttctttccgtatcacagaatacgtttattgtggtcacctcgaacatttttgcgatcatgggcttacggtccctgtactttgcgttgagtgggattttgccacttttccgttatattaagtacgccttggccgtcatcttggcctttattggaatcaagatgatcctaaacgaagtggcccactatgctggttggacgtggcagatttcgaacgtggtttcattagtggtgatcattgggctgatcacgatttcaatcgtggcgtcggtgattgtggatcgcgtcttgaagcggcgtcagctttaaatgataaaaaggtggctggcttttttcagccacttttttgggttggcggggtataattgaaccagagttttagaagaggagaatataaacgatgtcaaaaattaatgctgatcaattagttgcaattcagcaatttgcttgtgagtttgctcgtcaggatcatagcggtcatggagtggaccatttgaaccgggtggcagctatgatccgtaccattagtgcacaggaaccggtggatgagtcggtggcgctggcggctggctggttgcatgatgtgattgacgataaattgacggacgacccggcgagtcgccagcaagcggtgattgaccagttgacacaggtgggggttgatcatgagacgcagaccgcaattatggcgattatgacgaacatgtcgtttgctaaaagtctgggagcccatgcccagccactctcactagaaggacaagtggtgcaagatgccgatcggttagatgcgattggggcgctgggaattggccgggccttttattacagtggccggtttggtgaagagatgtatgatccagccaaaaagccccggcttaacatgacgaaggaacaatatcgtcacgagccggggaccacgattaatcatttttatgaaaagttatttaaaattgccgatcaacttaatacgccaactgcccggcgaattggccaacaccgtcagcaactgatggccgactttgtggcgagctttaagcaggagtggcgcggcgagtagctacgaccgtagatggcgcgggcgaagcggagattttcgttttccgagtaaccgaacaagaagattggtgacgccggaaaccagaagggcgaaccccatggtgaacgcaatagttaccatgacggccttaaacccactcaacgataggccgattagtgcaatcagaccaccgacaacgacgagaattagtactaatccaattaaaccagaggcggcatttgtcaggtcggagcggcttaggtcgaacccgcccgcgcaaatgttactacatagaattaaccagattaacacgctccagccgctaaatggggcgccggaaagtaatgaaacatccagaaacgagtgtgtttcgacaaacgatgaccaagacgtcagcaattcgggaagtagccaatcggtcagcgctaggatggccagtgtgttaccgatcagcggggcaatgccaatgaatagattaccaaactgctggtagaaccgatgttgatcccaagtgtggttgacgtatccgagggataaatcggtagggtcgttttggctgggaattcggagcggccggaaaccggtaatcttgtggccgaagatcacggccatgataagatggctgaattcatgaataataatgccgagacagccgccaaagatttgcgcgtggaatccaaataggttgacgatctgctgcttagtattgtgattcaccaccacgagggcgctaccgagtagtccgggaatgatgacgagatataaaacgagttgtccgtaagttgtgagtaaggtttgtcccattcaattctccttgtcagtgttattgttgtaagtcctcaaattttgcatgaacaagggtggccatgtcaaccgcgttgaccttgaccgaacgaccaatcttacctgaggaaacgtagataaagggaatctcgcgggctgattggtcgatataaattggatacttaaatttttcgtaaattccgatgggggtgttggcaccgtgctcgtaccccgtggttttcagcagatctttgagcggcaccatgttgacctttttattgccggaaaccttagccatcttcttttcgtcgagatgggtgtcgacgggaaccacccccacgacgggaccggtggtattgccggccaacacgagggttttgtaaatgaggtgttcttcaatgccgttatgatcgacattcaattgggcaacgtcgccttcttgatgtgtcgggaaggcggcctgctcgtaggggatgctatttttgtcgagaatctgttcaactaatgtttttttgatttttttctttttacccatgttaaaaacctcgaatcttaatatgtggatcgaaccaattttttaaaagtatacaaccaattatgtaaatctggtatactcgaaaccaaaagagtacagcaatggtcaaaatttaggagctaatgaaatggcagacttagtatatcgcgaggtcatgcatgatctcaaggaacggatttttaaaaatcagttcgaaaataagaagttaccagacgaacgtagcctgagtgaatcgtatggtgtgagtcgcagctcaattaaacgggcactgaacgtgctggctcaacaaggaattatttttaaaaaacgtggttcggggacctttatcaatcccctttatttgaagaatcagtcattgtttcattacgaggggaccaatcttggtgtaactgatagttttaatttagacggtcaacacccaagtgtcaaattattggactaccaggtcgtcccggcgactccggaactgcagcaggatttatttttgaatgaaaatgattttgtgtaccagattaaacggctgcggctattggacaaccgaccgatcattattgaaacgggatatattcccattaaagtggcgccggccctgacgccggaaattgtgactggctcgatttttaattacttagaagataacgcgggaaagtcggttaccaagtcatttatgtcaatcttggcggaaccgtctaacgaagaggaccagtcacttcttggattgaacgatcgggagccggtcgggatcatggaagggatcttcttcctcgatgatggcaccccatttgaattttcgaatatgcgcgtgcattacaagtatcttaaatataatacgtttgtcagtttagatggcgaatagcgagattgtgggtatcagattaaattgatctgggactcacaatttttattaataaattttttgaaatcatttaaatttagaatcggaaagtagtatactgttgtcagtagcggagtttgtatgctccaaaaattggaccgtatcaattttcaaaaaggttgactttttctcaaaagtcagtattatagggtttgtaaattgatccgacacaacaagggtatatttacgttgcgttacacagtcaagatgataagtagttattaatttattgaaggagtgttaatttcatggcagtagattacgattccaaagcatatttggaaaaagttgatgcatggtggcgcgcaagcacctacctttctggcggcatgattttcttaaagaacaacccattgttctcagttacaaatacaccacttaaggcagacgatattaaggttaagccaattggtcactggggtactatctcaggccaaactttcctttacgcccatgctaaccgtttgattaacaagtacggattaaacatgttctacattggtggccctggtcacggtggacaagttatggttaccaactcatacttggacggttcatacactgaggactacccagaaattacccaagacgttgaaggtatgtcacgcttattcaagcgcttctcattcccaggtggaattggatcacatatgactgctcaaactccaggttcacttcacgaaggtggcgaacttggttactcactttcacacgcaactggtgcaatcttggacaacccagatcaaatcgccttcactgttatcggtgatggtgaagttgaaactggtcctgcaatgactgcttggcattcaatcaagttcgtaaaccctaagaacgatggtgctgtgctaccaatcttagaccttaacggattcaagatctcaaacccaacaatcttctcacggatgagtgatgtcgaaatcactaagttcttcgaaggtttaggttactcaccacgtttccttgaaaacaacgacattcacgattacatgacttaccatgaaaaagctgctaagttatttgaccgcgcaatcgaagatatcaaggatatccaacatgatgcccgtgaaaacggccgttatgaagatggcgaagttccagcatggccagttatcgtggctcgtttaccaaagggctggggcggtcctacacacaaccctgccggcgaaccaatcgaaaactcattccgtgctcaccaagttccacttggtctttcacaaaagaaccttaaagaattgccagaattcgaagcttggatgaactcatacaagccagaagaattatttaacgctgacggttcacttaaagatgaaattgctgaaattgcacctaagggtgacaagcgtatggcaatgaacccagttgctaacggtggccgtgctcgtggcgaaaagccagaattgctcgacttgccagactggaaagaattcactaacgatgtaactgctgaaaaccgtggaacgacatttgctgatgcaaaccgtaacatggatatgaacgttctttctggctacttagctaagttgtcacaaaagaacccaacttcattccgtttcttcggccctgacgaaacaatgtcaaaccgtctatgggaaatgttcaaggttacaaaccgtcaatggatggaagaagttcacgaaccaaacgatcaacacgaagccccagaaggccgtatcttggatgctcaattatcagaacaccaagctgaaggctggcttgaagcttataccttaactggtcgtactggtatctttgcttcatacgaatcattcttacgagtagtggactcaatgattactcaacacttcaagtggattcgtcaagctgctgttgaagactggcgtaatgattacccatcattgaacttgatctcaacatcaactgtattccaacaagaccacaatggttacactcaccaagatccaggtctgttgactcacttggctgaaaagaagtctgactttgttcgtcaatacttgccagctgacgcaaactcattgcttgctgtctttgaccgtgcatttactgaacgtcaaaagatcaaccatatcgttgcttcaaaacaaccacgtcaacaatggttctcagttgacgaagctgctgaattagcaactactggtttgaagactattgactgggcttcaactgttgctgaaggtgaaaaagctgatatcgtctttgcttctgctggtgttgaaccaacaatcgaaacattggctgctatcgacttgatcaacgatgccttcccagctgttaagttccgttacgtcaacgttgttgaattaggccgtctccaaaagaagaacggacctttgaacgacgaccgtgccctttctgacgaagaattcactaagttcttcggcgaatcagggacaccagttctgttcggcttccacggttacgaagatttgatcgaatcaatcttctacgaacgtcaacatcttggcctccatgttcatggttaccgtgaagatggtgacatcacgactcaatacgacatgcgtgtttactcagaacttgatcgtttccaccaagctaaagatgctgtttcagcattggttgctgaaggaactatcaaggaaccagacgcccaagccttcgacaagaagatggacgacgttcttgcaaaacacttcaaggttactcgtgatgaaggtcgcgatatcgaagaattcactaactggaagtggactgcattaaagaagtaatttccgattacttgtttaagcaccttgaataacttaaaagcagacgctaggcgtctgcttttttgtcatctaaatcttgagatgtgggggaaacgatattttgacagaacagttgatttacttgtacggcaagcttggcctgcaccacacagcgttggacatgttgactgatcgtggttacacgattctgcggggagccgatgatcaaactgatgctgattttttacggcgtgctcgtgaagctcaaatcgtggtgatggatgatcattattttaaggaggcttggtttgaccaactcccacagctccgactaattatccggcggggtgtcggttatgataagattccgattgaggcggccacacaacgtcacgtgtgggttgcaaatacgccgggggccaatgccagttcggtggctgaaattgccgtgggattgatgttagagacggttcgtaagatgccagctgcgcgtgattatctgaaccaactgacgggtaaaatgtacccaagttatctcgttagtcatagtttgggatcgcgaacggtcggcttagtcgggtatggcaatattgcgaaggccacggagcaaatggtggccggatttggggcaaaaattttggtgactgcgcgtcaccctcatacgccaaaatatggtcaatttgtcgatttggcgacactcttggctgaatcggatgtggtgtcactccatttaccagccactgctgagacgacaggcttgtttgatcggcagttgtttgcgcaaatgaaaactgatgccattctgatcaatacatcgcgcgggtcgttggtgaatgaaactgatctggttgccgcaattgatggtggtatcattgggggtgccggattggatacgacgagcatggaacccgttccagcgcaaagcccattattagcgcatgaacggattgtgctactgccccatattggcgggtttaccatcgaagcagaagttaagaccgcacacatggtagcccaaaactgtattgatttgtttgaagaacgtacgccaagatttgcacttaattaaaatcatattaatatatgatgagacttttcgttgttcattctcattatcaggagtatcatagaaccatgagaaacaaagtattgatgatgaggaagggattcaaatgaaaaaagtaattgcaacacccaatgcacccgccgcgttaggaccctattcacaagctgttttcgccaatggcgtgttgtacgggtcgggccaagtgggcctcaatccggaaacgggtgaatttgccggcactacgatcgaagcacaagcgcgtcagatttttagtaacattaacgcggttttgaccgaagccggattcacaccggccgatgtggttaaaaccatcatctttttggataacgtggccgattttgcaacggtcaacggattatacgaacaatttttccaaaatagtcaggttttgccggcgcggtcctgtgttgaagtggctcagctaccagcgggggcactcatcgaaattgagtatatggcaactaaataatgattcgagatcaaagtaggtagagacgattaaattcgcctttacctatttttttatatctaatagtagtcgaaaacgtttcgtaaaacgttaaactaataaaaacacgaacattaagaaggtaaaatttaaaaatgtttggaaaatcaattgacgggaccgggtcaggttggtacactaagggtgcaaaatgatggattaaggaaaggaagaatcatgaaaaaaattgcggttgtgatgggttcaatttctgactggccaaccatgaaacttactaccgatttattagaccagctgaaactaccttatgaacgtcatattatctcagcgcaccggatgccggtgcagttacaagaatttggtcaaacagcggccgatcaaggcttcggggtgattattgcgggtgccggtggcgccgcccatttacccggaatgttagcggccaacacggtgttacctgtgattggcgtgcccattgaaagtcatgcgcttcatggcatggattcattgctgtccattgtccaaatgcctagcggtgttcctgttgcaacgacggcgatcggtaattcaggggcgaagaacgcagcgttgttagcagccgaaatgcttgccattactgaaccaacggtgacaaaaagcttgaaggcctttcgggcccatcaaacgcaggaggcgatcaatagtgaacaacagttctgagacgccactattaccgccagcatgtattgggattgtcgggggcggtcagctaggccagatgatggctttatcggccaaagaaatgggctataaggttggcgttctcgatccgacaccggattgtcctaccgcacaggtttctgatttccaaattacggctgaatacgatgaccacgatgcgttacttgaactggccaagcgcagcgatgttttaacctatgaatttgaaaacgtggatgttgccacgctcaaagatgcccaaaagttggcggctctgccacagggaaccgagttactcgaaattacgggtaatcggattaacgaaaaaacgttcctgcgacaacacgggattcccgttaccgattttgcagtggttgatggtgctgatcaactaaccgctgcggtggctcaaatcgggtatcctagtattttgaaaacggccgatgggggctacgatggtcacggtcagcaagatttaaactcggcggccgatttactggctgggcgaaaacttgcaagtcaagcgcaatgtattttggaaaagcgtcaggcctttgcaaaggaactttccgtgatggtcacgcgtagtgcagcagggacgattcaagtttttccagtttcggagaatatccatcatcaccatattctgcataagagcatcatccctgcgcgggtgaatcaagctgttcacgatcatgctcaagagttggctcgacgcattgctacaggacttaatctgcgcggcgttctcgggattgaatactttatgcttcccgatggtcaactaatggttaacgaactggcaccacgacctcataattccggccactacacaatcgaagcatgtaacgtctcacaatttgaagcgcatattcgcagtatttgtggattagaaattccaaccatcgaactcaagcagcccgcggtcatggtcaatttactgggccaacagttacaacccgcgcggcaaaaattaccacagcgaccacagtggcattttcatgactatggcaaagctgaaagtcgacaggatcggaagatgggccatatcaccatcttgggcgatcttgatcaatcattgacatcaattaaatcagaaggcatctgggaggctgaatcataatggaaaagggtacgttaattaaagaaggaaaagcaaaacggttatatcacactgacgaggacggctacgtgtgggttgaatacatggatcaggcaaccgcactgaacggaaaacgcaaggatcacatcgtcggcaagggtgttttgaacaaccagatcgatacgatgttattcaagatgttgatggataacggcattcacaccgattttgtgaaacagctatctgataacgaacagttaaacctaaccgttgacattattcccctcgaagttgtggtccgaaatgcggcctcgggtagtttccaacgaaaatttgcggtaccgtacttacaaaaatttgaccaccccgttgtggaatacttctacaagtcagacgagctggatgatcctgcgattaataccagtcaagctttggcattgggtgtgattaaacccggtgaaagtgaacgactacaggaactggcacttcaaattaacgacttactcaaggcacggtttgccaaggctggtttagaattagttgactttaaggttgaatttggcaagaaggccgatggcgaaattattttggccgatgaaatttcacccgattcatgccggttagttgatctggaaacccgtgattccttcgataaggatgttttccgtaagaagactggcgacctcgtaaccacctatcaagaagtgttgaaccggttgaatgactcacaggaggaagcctaatgtatcgcgttaaagtctatgtgacctataaagaatcgatccttgatccccaaggcgaagccgttaagactgccttacaccggctcgactaccaaaccgtcgaaaaggtaaccgttgggaagtactttgaattaaacattgctgatcgtggtcaaaatattgacgaagaagtcgatcaaatgtgcgatcaattattggccaacgtgaacatggaaagctaccgttacgagatcgaatcaacgactacggagggctagttaatgaagtatgcaattattcgcttccccggatcaaactgtgactgggatctgttctacgtattacgtgatgtgatggcagtgacccctgaatttgtcgattatcgggaaaccacgctgccagatgaaacggcggccgtgctggttcccggcggcttttcatacggggattacttacgaagtggggcgattgcccggttttcaccgattatggcggccgtgaaggcgttcgcggatgcgggccacccggtaattggaatttgcaatggattccaaattctcacagaagccggtctgctgcccggtgcattacgaaaaaatagtagccttgactttatatgcaagccgcaaccattgacggtgacaaatgcggccacgttatttacccacgagtttgatgcgggtgaaaccgtgatgtttcccattgcgcatggtgaagggaactactactgcgacgacgaaacgttggcgcaactcaagcaaaatcaccaaattgcgtttacctatcaaaataatcccaacgggagcacggcagatattgctggtgtgacaaacgagcgggggaacgtcctcggcatgatgccccatccagagcgggcgagtgaagcaattttaggcggcgatgatggtcaacgactattcgccagcttaattgccagcgtgactgcagccgctcagtagggtcagctgacagtatcaccgtgaccctttatttcgcaccctaacttacaaaggagaattccaaaacatgatgaccgaattatcacccgcagaaattaaggctcaaggtctttatctccagtggggattgagcgaagacgaatttcaacaggttgaaaagattttaggacgcctgcctaactttaccgaaacaggtttatttgccgcaatgtggagtgaacactgtgcctacaaaaattccaaaccactcttgaaacagttcaagacgactagcgaccggatcttacaaggacccggtgaaggggcaggcgtgctcgatattggtgacggtcaagccgttgtcttcaaggcggaaagccataaccatccaaccgcagttgagccgtatcaaggcgccgcaactggcgttggtggcattgtccgtgatattttttcgatgggcgctcgaccggttgccatgctcgacagcttacacttcggtgagttagacgatgccgcaaccaagtacttggtcgatcagacaattgccggaattggtgattatggtaactgtatggggattccaaccgtcggcggtgaaacgacctttgacgcaatttttaaaaataatacgatcatgaatgcaatgtgtgtcggaattttaaacgttgatgaccaacaaaagggtgccgctgccggcgatggcaactcgatttattacgtgggcgctaaaacggggcgggacggcattcagggcgcgatctttgcttcggctgaatttagtgacgaacaggaatcacaacgctctgcggttcaagttggcgatccatttgccgaaaaacaactcatggaagcctgcttggaattgattcacgatcatgccgatattttggtcggcattcaagacatgggggcggctgggttagtatcatcctccgctgaaatgggggccaaggcgggctacggtatgcaacttgatttggaccttgttccccaacgtgaaagtggcatgattccttacgaattgatgttgtcggaatcacaggagcggatgttactgtgcattaagaagggccacgaacaagaagttgaagcgctcttcgcaaagtatgaatccgaagccgttaaaatcggccacgtgaccgcggagacgcagtaccaactcttccataaggggcagcaagtagccgatgtaccagtgcacgcactggttgatgaagcaccggtttacacgcaaccaagtcgccaaccggaacgcctcaagcaagtgactgagcagttcgaaccagaaattgaaaatatgaacgacacgttcattaagttgctcgaacaaccaaccattgccagcaagcacgccatctacgaacgttacgattcacaagtgcaaacaaacacggtggttgcaccgggggctgattcagccgttattcgactccgcggaactaataagggcttggcgatgacgactgatgccaacccacggtatatgtatttggatccttacaagggcggccaaattgcgttgagtgaagccgcacgaaacattgttgcgagtggggcccaaccgcttggaatcaccgactgcttgaacttcgggagtcctgaagacccagaagtttattacgaattacaacaggcaacaaaggggatggcggaagcctgcgatacctttggaacaccggtcatttctggtaatgtgtcactttataacgaatttaataagcaaccaatctatccaacaccgatggtcggtatggtgggcttaatcgaatcgatggatcgactaacgaccatcgacttcaaacacactggtgatctgatttatgtcatcgggaccaccaaggatgattttaatggtagtgaaattcaaaaaatgcaaaatgaaacggttagtgggcagctatttgacttcgatctgcaggtagaaaagcaacatcaggatttggtcagcgacttgattgaccaacacttggtggcgagtgctcacgacttagccgaaggcggcttagcagttggtttggcagaaagtagttttgccggcgatctgggcgtggccgttaccgtcgatctaccacaaagttggctgtttgcggaaacccaatcacgattcatcgtttcggtcacaccagacaaccaggctgcgttcgaagcgctggcaggtgatcaagcacaactaattggaaccgttgatgatgaccggtttgctattcacacgaacggccagtccatcgacatgagtctagcggatgctaagcattcgtggaaagaggcattggcatggcaactgaactaaaaagtctgaatgaagaatgcggtgtgttcggcgtctggaacgacgatcaggccgcacaacggacctacttcggtctccacagtctccaacaccgcggccaagaaggcgccggaatcgtggtcaaaactgacgaggatcggctgattggtcataaaggcctcggccttctcgcagacgtctttgatcggccagagtcgatcgacgaattacaagggcgcagcgcgattggtcacgttcgttacggtacggcggggagccggggaattgaaaacattcagcccctgttatttcactatttaaaagaagacgtcgcactggcgcacaacgggaacctcactaacgcggtcagcatgcgggaaaagctggaagcagatggcgctatttttcaatctaactcggataccgaggtcttgatgcatttgattcagcgtcaaccacaagcgcagtttgtcgaccgcttgaaggccagcttacgccaaattaagggcggctttgcctacctgattttgacgaaggatgcgctgtatgccgcccttgacccgaatgggtttcggccactagtcgtggggcaacttgaaagtggctcttacattgtggctagtgaaacctgtgcgttggacgtggtgggcgccaagtttgtgcgtgacgtacaaccgggcgaactgattcagattgatgacagtggctaccacgtcatgcaatacaccacggagacgcagctcgcaatctgttcgatggaatacatctactttgcgcggccagattctgatatttatggagttaacgttcatatggcgcgccaagaaatggggcggcaggtggcactagaaaacccgatcgatgctgacattgtggtgggggttcctaattcatcactttcggccgcttcaggagtggcacagcaactcggcgtgccggatgaaatgggcctcattaaaaatcaatacagctcacggaccttcattcaaccaacgcaggaactacgggagcaaggggtcaagatgaagctttcggctgttcgagccgttgttgcggggaagaaagtggcactcgtcgatgattcaatcgtgcggggcactaccagccaatatatcgtgcggatgctcaaggcggctggtgctaaggaagttcacctcttaattgcctcgccaccgttgaagtacccatgtttttatggcatcgatattgaacatacccgtgaactaatggcggccaactacacggtggaagaaatgcgcgaccagattggtgcggattcacttcactttctgagcttgcctgggttgatcaaggcgattggcttgaagcaggatgcaccgaatgaagggctgtgtgtggcgtactttagtggtgactatccgactgcactgtatgactatgaagcgggttttgaagcacctaagacggccgatgatcatgttttagccgcgtcggccaatcaacccacgacgatttaacggaggagatttaacgatgaaaaacgcgtacgaagaagcaggagttaacatcgccgccggggaggccgtcgttgacgcacttcaaaaaaaggttcatgaaactgatccgcacgttcttgggggcattggcggatttgccggctgttaccaactcagtgaggaccaactggatgctccagtgttagttgccggaagtgacggtgtggggaccaaggtcttactgaccgccaagtcaggtcaggtgaacacgatcgggcaagacctcgttgccatgtgcgtgaacgatctgttagcacaaggggccttaccgctattcttcttggattacctcgccttgtcgaagctggaagaagatcaggtgagcgaaatcttgagtggcgtcttggctgcctgtcaggaacaagggatcacactactcggtggagaaacggctgaaatgcccggtgtttaccagccgcagcactttgatttagccggatttgcagtggggttagccagtaaacaggcattattgacaccggctaacgtgcaggccggcgactacctgattggattaccatccaatggcttacacagtaacggcttttcacttgtccggaaaattttgtttaccgaccacgattatcagtttgaccaagtgctccccagtattgggcacgcactgatcgatgagttactccggccaaccaaactctacgtgaacgttttacgaccgttgctcggtcaacacttgatcgccggtgcggcccatattaccgggggcggattactagaaaatgttccccggatgtttaacgattccttggccgccgagattaatacggggacgtggccgcaacaagcgatttttaacgaactcgtgaagttaggcaacttgtcggtgacggaccggtaccagaccttcaacatggggattggaatggttttggccgttcatccagcgcaactcgacgctgtcaccgatcagctgattgcacagcatgaaccgttttatcatattggccgaatgaagccgcgtgataatggggatgcggttcaacttgtgggggtagacaatgattaagattgcagtatttgcgtcgggaacgggcactaactttgtggccctttacgaccatatcaagcaggcccagttgccaattgaaattacccgggtgatctgtgatcaacctaaagcagcggtgttagatcgggctcgcgaacgacagattccaatttggacgcaccggctcaaggaatttgaggggaaggaagcttacgaacaggcaattttgacgcaggttcaagccgataacgcccagttactggttttggcggggtacatgcgaattgtgacccaggtactactaaacgcctatgcgggtaagattattaatattcacccagcattattaccttcgtttccgggacgtcacggcattgaagacgcctttgattacggggtcaaggtgacaggggtgacggtgcattacgtggactcgggtgtcgatagtggtcccgtaattgcccagcaaccggtggcgatcttaccggaggattcggtggagtcactggcgatgaagattcacgatgttgaacatgaactgtattttgagagtctgtgtcaggtattacgtgatcaaggattactgacggtacaggataacggataaaggagagaatttatcaaatgaaaacggcattattgagtgtatctgataaaacaggaattgttgaatttgcagcaggattaattaaacagggttaccggattttgtccactggcgggacgaaaaaagcgctcgaaagcgcccaaatcgccgtcaccgcggtcgaagatgtgaccggctttccagaaatgctagatggacgggttaaaaccttgcatcctgccattcatgggggcttgctagctcggcgcgatttaccagaacatatggcagccttaaagaagcaaaaaattgatcccattgacttagttgctgttaacctttatccgttcaagaaaaccatcttgacggccggtgtcactgagccggaagctatcgaacaaattgatatcggtggtcccagcatgttacgctcggccgctaagaattttgctggtgtgttacccgtcgtcgatcctgctgactatgacaaagtattggcagcgattgaaaatgatacggctgatttggctttccgccgtcagctggcattgaaggtcttccaacacacgtcagcctacgataccctgatcgcgcaatacctgggtcggaccgctgccgaggaattccctgacagcttaacgatgacctacacgaaaaaacaggaactccgttatggcgaaaacagtcatcaaaaagccgccttttaccaagatgcgattcccgtaccattttcaattgcatctgctaagcaacttcacggtaaggaattatcgtacaacaacattaaggatgctgacgcgggcctgaagatggccgcagaattcgagcaacccgctgtggtggccgtgaagcacatgaacccgtgtggaattggtctgggggaaacgattgaagcagcgtgggataaggcatatgaagccgactccatgtcaattttcgggggcattatcgtgcttaaccggaatgtggacttggcgacagcagaaaagatgcacaagctattccttgaaattatcattgccccaagttttgatcaggacgcctacgaagtattagccaaaaagaagaatttgcgcttattgacggtcgacttcaacgcgcgtttagatgccaaagagctcgaaacggtttcggttatgggcggggtccttcgtcaggaacaagatacgctgatcgaatcggcggaagactttcaagttgtttcagaccggcaaccaacggcacaagaagtgaaggcaatggtctttgcacaaatcgtggctaagcacgtgaagagtaatgcgattgtggtggcgactgacacgcaaacgttaggaattggcgcgggccaaatgaaccgggtcggctcagccgaaattgcggtggcacaagcagaaaaggccgctaactatgatcaagcagtcctcgcttcggacgcgtacttcccaatgggtgacagtgtcgaatttgccgctaagcacggcatcaaggccatcgtagaacccggtggcagtattcgagatcaagaatcgatcgacaatgcgaacaagtatggggtcacattagtcttctccggccgcagacactttagacattagaacggagcacgcctttcgaccttatggcgcgaagggtgaatttacacctaatagtatagatcacaccattcaaaattaatcatccaactcatgggtgattaattttgttgaatgatcgattaaaagagcttgaccaaatgaggggagtcaacaacatggcgacggtattagtaattggtagcggggcgcgcgaacacgcaatgtgtcggcaactgcgccacagttcacaggtgacagaggtgttttgtgcaccggggaatccggggatgacatacgacggtattacctgtgtggcaattgaagaattagatttcgcggggttagtcgcgtttgcccaacaccaccatgtggacttaacggtggtgggaccggaacttcccctccaacaaggggcggttgatgccttcgaggccgcgggcttacgggtatttggtcctaaccggcaagcggccgcactcgaaggctcaaagaagtttgccaagcaaattatggctcacgctggggtaccaacgggacgctatcaaagctatactgatgagcagacggcgttggcggcattgaatgaccaaaccttcccgctagtgatcaaagccaatggactcgccgctggtaagggcgtggtgattgctcaggatcgagatgaggcggcggccaccgttcatcaaatgctgggggaacatgaattttcaacaactgaaattatctttgaagagttcttggttggtcaggaattttcgtttatggcgtttgtgagtggtgatcagatcgttccaatgccactggcgcaagatcacaaggcggcctacgatggtgataaggggcccaataccggtggcatgggcgcatacagtccgttgccccagtttgaagctggattgagtgaccaatgcttgacgagtattttgcggccggttgtgacggcgatggcggataatggcaccccgtttactggaatcttgtatgcgggcctgattatgactgttcagggacccaaggtgatcgagtttaatgttcgttttggggatccggaaacggcagtggtattaccccaactcaagagtgacttctaccaattactggtcgatttactggatcatcaaccagtgaccgcacagtggcaaacggcggcaacgtatctcggagtggttgtgagttccgcaacgtatccgcaagcttccggtcacggggtagatttaacccagtttacgcagttgccggccggattagattgcaattttgccggagcggccgaggatgatggtcagcttgtgagccatggtgggcgcattttgtgcctcaccacccaagcggccgatattgtcgctgctcaggataaaatatacgcttggctggatgcgcagacgctccctggtttgcggtaccggcacgatattggcaataagggcgtcaagtaaagactcacgataaatactccgaaatcggctaatcaggctgaatttcggagtatttttttgcgcatgacgagggagtgaacggccgtgaaatgcaactttcaccgaatgatgattaacgcgaccattgatatggtaaactaatcctattatcgaaagtttacgattagtttgtggaagaaggaatagtatgtgcacaagtatgacttataagaccagtgatggtcagtattggctagcgagaacgatggattttggatttgaattgggcggcaaccccattgtcgttccgcggcaatacgaatttcacggtgtactgggcgagacgtttacgaccaagttcgggtttgtggggaccggggcacagcttaaggactatattgtggtcgacggcgtcaatgaacagggtctgagcgcggcgaccctctattttagtaaccaagccagttatgaccaacaaccggcggctgatcggctgagcttagcctcttttgaagtggttaattggattttgggtaacttccagagtaatgcggaagtccgcgcacacttggatgagatgcaggttgtcgattttgaattacccctgttgaaaggtaacgtgccattgcactggatcattgcggatcgtcagggacattgcaatgtgttggagttcaaggctgacggaatgcactggtacgacgatcaaatcggggtcatgactaatagtccagactttgcttggcacgaacagaatttaggtaactacgtgcaactgcaaaatggatttcaacccgcgcgtcagtttagcgggtatacggctcgtgaaattggtcctggttcgggcgcccttggcttgccgggagactatacgtcaacgtcccggtttgtgcgggcatcatttacacggcagtatgcgccacaggttgcggatgcccaagccctcaacacaatcaaccatctgctagaaccctttgatattccacgtggggtgaagcagcaggcaaatggctacttcgattacacgcagtaccgggggtacatgcagttaagcaatgcgacttattattatcagccgtatgacgataacacgattagtgcggtgcagctaacagatgacttgttaaatgacaccaccgtcaccacgtttgcggtggcccatcaacaacaagtacatgttctgaattagcacacaaagaggctgggaaaaactcccagcctcttcctgtctccgaactttaatagccgaaatcggggaaaaaaggctgacttctccgcttagctacgaaagccaaacgattcaaaacacgaatcattcggctttctaggctgccactgcaacttatcgctttagcgattttagttgcgtggacaacggagtatgctcgaagtcaaagcgcctttttgcccactctcttaaaagtggtctatttgattttaacgatcaacacatcgcacttggcgttgcggttgacgtagctggtaacggagccgaccatgaaccgttcaacggctgataagccggtggtaccaacaacgatcagttcgttagcgtgatcagcggggaattcgcgggcaatgactgatttaggattaccaaaacgaacgtggatgctgacgtcttctagtccggcatcgagggcttgttgcttcaagtcgtccagacgttgttcgatctcttcaaccagactatagatcacatctccactaacggcaccgccgtagctgtcggagaattgattgacttccacgacgtttaaaatatccagatgggtattattttgcttagcaatttcaattgctttagcgatcacttgtggagttgccttggatccgtccaccggagccaggacgttcttgtattgttgtaacataaggcaggtcttctttctatatggaatggtttgttattatcttaattatactattgattacgcttcctgtaagcaaaagtcttaaaaaagtctcttagcgcacggtgtttcatatttcgtctaggaaaagctgtgattttttgatcaaaaaattaggccagtcattgataaatcaacgttaaaccgtccgataaggtgaatctttttcactaactttttcatcgtcataatgggagaaatcggtgatttaaaagagattgtaatcggtttcaaaaggtggtaagctatgggcgaaagctgattgaatgacataattactcaaacagtctattaaatcgagatttaggtagggggacgttgattatgcgctacgtttcaatgacatcacacaatattggtcggaatttagccacggaacagtatttgatgaatcacaaggattttggtgagccattgctgctgttctactatgaagagccatgtatcattgtcggtcggaaccaaaacacactggaagaaatcaatcagaagtatgtcgatgatcatcatattcgggtgacgcggcggttatccggtggtggcgcggtttatcaagatctcggtaatttatgcttcagcttcgtggttgatagcaatagcgaagagtttggtgatttcaaatcctttacccagccaatcgtcgatgcgctgcacgaaatgggggcaacgacggccgaggtcagcggtcgcaatgatattttagttgatggcaagaagttctcgggcaacgccatgtacacgaagaatggcaagacgttttcacacggcacactgatgctggatgttgacttagacgtcgtgacgcacgccttaaacgttcctgaagataagatcaagtcaaaggggattaagtccgtccgctcacgggtgacgaatctcaaaccctacttagccgataactatcgggatttaaccgtaccagaatttcgcgacattctgttaaagaagcttttccatgtcgatgacctcgccgaaattaaggatcaagagtacgtggtgactccggatgagcagactaagatcgatgcgatttatgagcaattttataataactgggactgggtatacggcaaatcaccgacgtttagtgttcaaaagcggcaacactttgacatggggacggtcgatgctcggctaaccgtggcagacggccaaattacggatattaaattttacggagatttcttcggcccgcaagatgtaagtgcgctggccgagcagctcaagggcagtcactatgatcgggaaaccctcaaaaaggtgctcgatcaagctgatacgagccagtatattgtcgggattacgaccgatcaattggtcgatctactggcctagcgggcgttcgtgacgctatactaatccagatcgatggaggatcaccatatattggtggttcttttttgattttaatagtaaaatgaaattactatcaattgggagcgatttaatttgaaagaagcaagacaaacaatttcatacgcaacagtagcaatgatcatttattgtgtcgtaagcctattaatgtacgcgcagacggggactgccctctggagcgtggaagtcattgtccacaccggaattgccatagcgctctttttgatcgcggcggttctcagtgcgatgaactcccgtagtgcggtttatgtgatgatgttagtgcttctgatttatacgattgcactagtcgtggcgtttgttcaggtgacgtggcactcagatgccagttcctttgttaaaatgctaattaatgtactgagtgtgattggtgtcgtgataaatgtcctctgtgcggctgcggcggtgcggctacggacccatcagtctaattttaaatttcttagaaggaagtaactcatggaaatcaatgtacaacagtttattgatcaagtaatggatggccagtatacgcaacaaagcgagacggttgacgatggtcaggtgacggtaacaaccggtatcgcggcgatggcgcaggcgatcagtcagcagcaactggcacaatttgagtggcaggtgacggtgccagaagctgaacagccggtaagcgtgcgcttggaaacgagcgtaatcaacttaccattggtgaatgccaagaccatttcgaagattatggacgttaatgccaccgcggaagtaaacgtctatatggtgtgtgagacgccggatattaatcggtcggggttacgcatcgataagttggtgtcggccaccacgttggtagacgatgctgacagcgtgacgggggccgctcagcagtggatcgacgaaaaattagcagcggttcgcgataatattgcagccgcgaaggaagaaaaagactagtttgatttgcaccgattcttaaaacatggtatgctagtttcatgcgatgagtcgagaacgtcaggcagctttcgagctgttccgcgcaagcggctagtgacatttcgagtgggacacgtttacctaccggatgatgtagggtgtccgatcatgatgcgttgtggagcgctcatgatctgagataatatcaatacacattgaaaatggaccgtcatacaacgttagttgtgtgatggtccatttttgcgtggtacgataagttaattcgggagttacttaactaaaaagagatgctcgttgacgagatcaaatggtgcgaagttgcggttaagccgttgtgttgcctctggatcgatgaactgtgcgttttcccagaattcgtgggagtttgttgcgccattttgttcaccgagggtgatgagcgtgatgtcgggatagtccgcgcgaatcagttggagaagttcccaatcggtggtttgtttatcaggggcccatgacatgatgacgaattggacctgatcgccgtatttacgcagcgctgctaaggcgtctaggggctcgatcgtggtcaccggatgtttgcccgtctcgttttcagccgtccacgattgactgtcagtggtgtaaattgtctgggtctggctgaggttgcgtagtcctttggaaatgtagccgttaccggccattacttccaaaacgggcgcgtgattgatgtagtgcgcgaggtcactgatgaccggtgcactgatgtaagcccacatgccgtacgtcgtttctaagtattcgcgatagtttcgcaggagacgatcgacctcaggcaacgccgccgtgtactggttccagagctgatcgccctgcggatcgccagccggatacttgtggttaacgaattgaaagatggtatcttgaatatcatctggtaaaagtaacttgggtaggggctgcggtaggagcccgttttttagcagccgatcgctttcgataacgttattaatgagatatttcacagatggaaagtcgtcaaataaagtggcatacgttgtcaattgttgaatgtagccacttggttgggccttttgccgggttttaatcatttttttgagctttttacgctgttttggattcattgccaacctcgtttaggaaagatgtaggtcaagctcttcttgcttgccatagaatttatcggtgtccttacgatgggtacgaccgtagaggtagccatcaatgagctgataaatttcgtaccggtcatcactagataatgtctggtgattaaaggttaattctttgccagataagaatagcttaccgagatcgtactcgtctttttcggttttgccagtcaggtagtccaagctgacatcgaagtattccgccaattttttggcttccacgtatgacggtgttcgaatgccccgctcccagttaccaatttgggacggggtatttggtttttcatttttagtcaggtggtcgttaagcgccgttgccaattcttttagcgtgatattttcaccacggcgtagggcccgtaaacgttctggaaacatctcatcacatcctttagattattttaacattcttatgtaaccattgatcaataaaatcgtacacggtcgaccgatcggtttcgtttaagatctcgtggcgcatctggtcaaacaggtgtaacgtaactaccgtgaagtgatcgtgtgttagttgatcgaagaggcgtttgggaccacggccaaacttgccgacgggatcatgggtaccgctggcaaggagaagcggtaagtcgcgtcgaatcccgtggtaccagtcagccgttgttgccatcttggtgagggtgaacagggcgtagaaaccattatacgtgaaaataaagccagaccacggatcacggttgtaaaaatcaatgattttcgaatcgtgcgtcagccaagaatatttgacgtgacggttgaagcgtttggaaaagctcccaaacgctaaccggtcaaagaaggtcccagtttgatgaccggcagttttactcaatgagaccactagcggccaaacggggatgagctcgggatgtggggccgttgtgccggttaaaatgcagccggcaagctggttactcagtcgtggtaagagtgcctgagccatcatcgaccccatactatgcccgagaaggacgtaggggaggtgaggatactgcgctttgacttgatgaaagagctgaacctcatcatccagaaggtgcaaaacggggtgttcgccaaagtaacccaactcagtcggggaactatggccgtgtcctaagtgatcgtcccccacgaccagccagccctgttggaccaggtgttgcgcgtactcgtcgtaacggttgatatgttcggccatcccgtgaataatgtggatgatgccgattgggggttgtgttggacaccattttttggcataaatagtagtatgatcatcactagataaaaaatgaaattcgttagacaaggtggaatctcctttgaagaaaaaatactggtattggatcttagcaattttcgtcatcatgcttgcagggggcctattaggagccggactgtacttttatcaagtggccgttgtgccgggccaaaaaagttttttgagtaagaaaaccccgttgcgtaagtcagatccattatatcatcaaaaattatggtatgagaacgcaaataaacagcgttggacaataaaatcggccggcggaaactatcggctggtggcaaactatattcccgcaacccataagtcagccaagacggtgctcattgcgcatggatttaacggtagtaaggatgatatgggggcgtacgcctatcttttccaccaactcggctataacgtcttactacgggatgcacgggggcacgggcagagccaaggcaactatattggttacggctggccggatcgtttagatgataaaaaatggattcagcaaatcatccgtaaaaatggtgaccagtcgaaaattgtgatgttcggtgtcagcatggggggcgccacgacgatgatggtcagcggcctgcacctaccaagtcaggtgaaggcgttcgtggaagactgtgggtacacaaacgccaaaacggaaatcaattatcaggcgcaacaactctatcatttacccacgatcgtgagatggccgttgattaatattgtgagcggaattacccgtattcgagcggggtacttctttgggcaggcgaacgcgattgcgcaactgcaccataatcaccgcccaatgttgttcatccacgggggcaaggatacctttgtgccaaccaaaatgattgaccagaactaccaagcaactcggggacccaagcaaaagtggatcgttaaaaatgccggccacgctaagtcgtatcagacaagccccaagcaatatgagcaacatgtcgctgcctttttgaagcagtacgttaaataaggtaagaaacgaggaaaattagtaaatttcctcgtttttttatacattaattgaattttgaatgtcgctcgaaggaaagttgccagtcgataattaaactgaaaataatgagtaaattagaacggttctgatcctaatttagaaccgttctcacttacttattgtaacattattttaatatttctaattaacgaaccaaacaaaagtgtcaaaatactatttgagttaaggggtgctttaacggaaaaatacgtggtaaggcgttgaaatagcacgcttttttcatcattggccgtattattgacctgatcgaaaaataagctttttaaataatcagatgattaactgattagtgaatatcaaactaaaaatagattaacgtgccttgacatttatgagaaaatccagaataattcacactaatttataatgttaggggatggaattatgcattggggatttattaatggtagtccaaatgcgcacggacatacggccagattggcgcagtacttgttagcggatcagtcacaggtgagctggaacttagtggagcaccatgtggcccagttaggacagcaacggcaggccgaagatgatgatttcttggcaattgctaaagaagtggcggccgtcgatgccctcctcattggtacgccgatttattggtcggatatgacgggcttgctaaaaacatttcttgaccggtgcacgctggtggcgcgtcagtttgattttagtcaaatcccggtttacgtgctgattaacgggacgcaatcgcccaccacgacggcggccggaattgcaccagcggttgcgcaactatgcgattttttgaagatggattttcaagatgccatctacgttgatacgagtgtcatcgtgcagccggccgactatgcagccgcgttacataacgaacaacaaaaattacatatgatcgtcaaagcggggtagtggctgatggatgcactatttggcaaccaactcgtagttggttacggaaataaaaagattattgatcatcaatcgattcacattgctgccggccaaattaccggattgattggtccaaacgggagtggtaaatcgacattgctcaaggccattagcgggattaaaccggtgaatgaggggcaagtatttgtaaacgagcgtgaaatcggccgattgagtaccaaacaacgggcgaaatgcattgcctacctagcccagtcgcccagtgttccgggagatttgacggtggaaaatttagttaagcttgggcgctatgcgtacggtcgtggcttgtttggtcgggatcaggatgccgccgttcaggttcagcaggccctggtagcggccaaggtcgccgagttggctaatcggccaattgatgccctatccggcggtcagcggcaacgcgcctttatcgcgatgacactcgcccacaatagtccaatcattatgctagatgaaccgaccacttatcttgatttgacccatcaactcgatgtcctgaacttgctccggcagttgaataccacggcacataaaacggtggtgctcgtgctgcatgatttgaatcaggcggcccagtactgtgaccagttggtctgcttgcaacagggtcagattgtggccacgggaacgccccatgaagtgttgacggaacagctcttagccgacgtctttcaggtcagtgccaaggtgagtttccggacgcagacgcagtatccgcagatgaccgattacgaaacgctggtgaaccgatgagacgaataaaactgtggcagctcaacgttttgttagcccttgttttgattggcgtggccgttttggggctctgcacgggcgtgaagtgggaatcgttaaccctcttatggcgcgcaccggcaagcttagacggacgcattatgtggaccattcggattccccgtattttgagcgttgtgatggtgggggcgttattgtcagtcagtggcttgctgatgcagagcctgtcacgtaaccccattgcggatccctcgattttgggggtgaatgctggtgccatgctggcactgattattgggtcgctgctcggaatgagtctatcgattgtgacgacgatatggctgagcttggtgggggccgcggtggcttttacggcggtactcctgatcgcaatgacacggcaggggctagacgtcttacgctttattctagggggcacggttttttctagttttattagttgcctggcctatgcggggagcctactcaccaatacaacgatgcaatttcgcaatttactagtcggtggcttcagcgcggtgacgtacgcccacgtgcgggtgctatgcggcggtctgaccattgtgctagcgacgattttgctcatgcgcaagcaactgagtttattggtgttggatgatacaacggcgcgctccctgggcgcaaaaccaggcctcacacgggtggtggccgcattgctggttgtgattagtgcggggattagcgtggccgttgcgggaaatatcggctttgttgggttaggaattccccaaatgattaattatgtgcatccggatcggttggagcgcaatgtcgtcccgacggtgttacttggcgccatctttatgatggtggttgatattgtcgccaagactttggctgctccgagcgaattaccgctgtccgcgttgagcgcgatttgcggcggaatctttctgttgcttgtgattatgaaaggtgcacgggtgactgaaagatgagtaaaaaaagagtgaccatcagttggcttggcgcgctcgggtgtctgggaggcctatgtctgttgctcctatcaatgggagacattcatctgtcgctatggacgacaacccagacgttgttgggcctgtcatccgatcgagtcgccaacctagtggtctgggatatgcgggtaccttacgtttgggcagctttaattaccggtagctgtctggccgtcagtggcctcattttacagagtttgacgaataatgatttggttgattcaagcctgttaggggtgaacgccggtgcgagtctcggcgcggtcatcttgattggcttgagcgggctcgtcaaaacgattagcgttgatcgttggttacctgcagccgccgttgtgggcgcctgcattagcctgttactggtgatgctaatcggcaaaagtggcaccaaaatgcaaattttgcttggtggggtggcactgaccgccctactgaacgggatcattttgatgattcaactgcgaatgaacagttttgattttgataaaattttagtttggttaagtggtagtttttggaatacggagatggcttttttacgcccgtatgcgggcctcaccgtcctattactgggtgcaacgtggttgttgcatcgtgagttagccgtactggtattaggcgatcaaatggcgcgtagtgcgggggtgaatttgacgaccgttaagagcctcctcatgcttcttgccgttgcgatggcggccgttgccgtctcggtcgggggtgcgattagtttagttgggctgatggcgccgaacatggcgcgccgcttttgtggaagtcgcattcaggtcttgttaccagtgacctgtttactcgggtgcgtgatcatggtgcttgccacggtggtcgccaataatctctttttaccatcggtattgccggtgggattagtagttgcggttattacgatgccgtactttttgtaccaactatttaagggttaattaattatgagaggaatggatgagaatgaaaaagtggaaattggtagccgttatgttgacagcggcagtgatgtttgccggctgtggcaaggctagttcgtcgtctagtagcagtcagcagacgagaacgattaagacggcgaagggtaacgtgaaggttcccgttcatccaaaacgagtggtttcgaccgtgtataccggtgagattttatcattgggggttcatgtcagtggttcaacaagcatggacttggcgaacccctttctgagtcagaagacggtgaagaagatcaaaaatttgggtaacggcctcaatagcgaagccgtgttgaaactcaagccggatttgatcattaccagcaatgaatcagatgtgaaaaaattaaagaagattgcgccagtagtgtatattccctatgggtcgactggtaatgtgtatcagacgttaacgaaatttggccagattttaaaccggcaaaagcaggcgaaggcggtagccagtgacctgaagcaaacggcgaagacagagacaaccaaattgacgcaggcgggcattaaccccgccaagacgacggtggggatgtacgaaatgcaaaatagtaagctctacgtggatggctcaagttgggggcggggcggtgaagcactcgtgacggcgatgaaatttaagctgccaacctcgattcaaaaaattcaagatggcgcgggatacaagcaaatttccaccgagtcattgagtcactattccgccgattggatgttctttacgagttatagttcggccaagagtggtagtgaccaggccgtcagcgacttaaagagcaatccggtatggcaaaacctaccggctgtgaaggcgggccacgtggtggaattaccgtttaacaagatgtattactatgatccagcggcagttaagggacaaatgaagatgatcaccgctgcgatgattaagcaaaattaaaaataagagtggaaaaaaaggcggtttgacttcgagcatactccgttgtccacgcaactaaaatcgctaaagcgataagttgcagtggcagcctagaaaaccgaatgattcatactttgaatcgtttggttatcgtagctaagcggagaagtcagcgacttgtacttgccgaacctcggcttagtacaatcgacatcgacgcgtagctagtgcctttttttcccgatttcggctattaaagttcggagacacaaaagtggctgggggggttccccagccacttttgcggcacggtgatcatttaaacgcgattttgcatataaacgagttcatccgtggaaatttgttcgttgagtcggttggcgagctcgggcacgatttgctgactggcctgtcgctcctgaatgaaggtgtgttcagcctgaaagacctgaatgaagagtgttgcaaggtagtcttcatcaagttccgtactttgccggaactgttgcgttcgttgcaggtaggaattacgcaccatgttgacctcggctaagttatcagcggtttggatggtattgaggtagtccaccactgcttttgtgaggaggtccattaaggtcatgatttccttccgctgctgatgcacacgatcatgaaatggggacgtgtgctggggtttgtcgggttgcgcgtcgtgcggtgctgctggtgttgcgggaacatccggttcgacgggacggtcagcggatgacgatggcaattgtgcaagacgcccatgacgatccggtcgttgttgcgcgtacttcaggagtttgttcatcgcctctggactcatcttgtcaccgtaaagtttcttgaatttatctatgtcggtggtgagaaggtcgatgttttggtggtatttacgcatgaacttcttgtgtttgcgctgattttgtcgtttccgtaatcggtgagttagttggcgcgataccagccgggtgaagcccttaaagcccccgggaccgtttttgatggaaatgcgactcagcatctgttggtaaatgcggcgggtggcttcggatatttcgccatcgtcggtgagttgatcgagggtttcaagttccactttttgcgccttttccatcaactgcatgtagctcttgcgatcgacgtgttgatcaaaaccgagttgactggtgatgacctgactgacctgttcaatttctttggaggccggattgccctgtcgcagagcttccagcgcggagtagaccatctggttcagggcatccttgtactgatcatccgtgaagctctgctttttcggtgccagaatcagtggatacacaattgttgccactaagaggctaatgaggatcacgacggccgcaatgaaaataatctgatcacgaaaggcaaaggcgtgaccggcaatgacggttggaatcgagaacgccatcgccagggtgatcgttccgtgaatcccaccggtggccacttgcagggccgtttgatggggtgactgggtatcttccttgatcttaacgagccggaatcggacccaacagtaacgaatggcgaacatcaagacgtagagcaggcacccaattccgaagagcagggtgttttcttggaggctcaatgacatgatgacgtggggcagcgtcgtcccgaggagcacgaagacaaacccgttgaggatgtctgctaagatggtccaagtggtattcgacacgatttgcagctttgtcgaagtcagttgaagacgggaccgcagcatgccatgcgctaacccagccgccacgacggccagaatgccggaaacaccgaggcgttcggcaatccaataaacgaacaggggggtcatgacgttgatggggatgatgacggcactaatgtcggtatgggtgcgggtcaggtacatccgcaagctcacgatcagcattccgagaatccagccaacgattaggccgccgagaaagacttttaaaaaggaaagaacgctggtggaaagagaaaaattccccgacacaaagctggctaaggccaagtcgaacaagacgatcccagacgcgtcattaaagagcgattcgtgttccaatgcgttatgcacatgactgggaaccacgacgttttgggtgatcgactcgacggcaaccgcgtcggtcggggtgatgattgccgccagcatgaaggctaacgacagtgggagggcactccagacgctgtgagcgaccacgcccgttaaaatgatggtcaccaatacgagtgagacggccatggacagcatgttcgacacgtttttggagagcttttcgagagactgattttgtccgtcattaaacattaacggggcaatgatgatcagcatgaaaatttcgggatcgagtttaaagttaaacatgggatccaaagaaaggatgagaccggccgcaatttgaaatagggccagtgggaccttgggcagtagcaatccgacaatgttggcgccaacgacggccgctaacaacaggacggcggatgtaataatggtcacgtggttcatctccgatcaaaacttaatgggttaattttaccagagtccatcgaaaagttaaggcatacgacaacaaaaagctgacgattatagggaatcgtcagcttgggtaaaattaagttaatgaagtccggcccaaacgatcggggcttgaaggagcacgagtaagccgatcgtccagccaatgtcactcgccgtcacacggacgactgaataggtactacgcggttggccttcaacaaagccgtgggagatcatggcctgagccaagttttctgaccaggtaatggcgaccaagatggccttgaagtagagccgtggtgaccaccatgagagggtgacgcctcgcatggccgctgcgtttttgattgtcaagatggtcgttttaattttaggaagcatgttaaatgctgcgagggtgccgtacgcaaacttggaaggcaaatggcagttttgctccaaactgtgagcgagcaccagtgggctggtcgttaaggtgaacgccgcgccggcaaagacgtaggcgtacatccgggtgaagagggcgaccgcggtggcaagttgatgcgcaccgaaaaaataaatggtggtgaagagtccgaccgccggaatgagtggtacgactaataaccacatgagcgcgcgccaacgaattcggtggctgatcagatagatgctggccgccaccacgattagcaggttagcggccgtattataggtaaacgaaatctcgagtgaggcgagtaaaacggttaataatttgagactagggttcactataacacctccgcgtactgtaagtgatgttggtcaaagatcacatggtaatcgacccacgttgccagatcggtcagctgatgactgatgatgatggcggtctgatgctgtgcttggcaactctcgtggaggagctgaaagacctgattaattgactggcggtccaaccccttgagtggttcgtcaagcaataaaatggccggactaatgatcagcatcgttaagatttggagttttttttgttgcccctcgctgagcgaataaaccacccgctcgtccatgccgtcgaggccgagttgcgtcagagcttggtcaattttttgatcagaaaagtagtcggttaaccggtgctgcttgctgagggcgagttcttcggcgaccgtgatgtcgataaattgatgggccgactcctgaaagacgagcgcaatttgttgccaatacttctttttccgaatggcttgaatatccgttccatcaagcgtgatggtcccctgatatgcaaacatccgaacgagagcggtgaacagggtcgacttgccgatcccgttatgccccgtaatcagcgtcaatttatgcgcatagagcgggaaatcggcggcggttagaagggatcgggtcccccgtgcgagtgtcagtgattggagatgaatgacctcgtgatcggtagcgccgggcagggcgactggaacgtgggcctgttgctgatagctcgccagcagggtgtgccgttgctcggtggcgagttgccgaacctgccgctggggattgaactggtaaatttgatcgacaagggtgtcataccccgacagatcgtggtcggtaataatgatggttttatgatactgatctcgtaatacagcgagctggtctaatagctgcttgcgtgattgtggatcaacactcgcaaagggttcgtcgagcaaaaagatgtgactgtccatggcgatcataattgccagtgcgcatttctgcttttcaccaccggacaacgtgctaaactgacggtcggccagcggttcaatgtggcaaaaccgcagcgcttgttgcacccgacgatcaatttcgtcaggggcaacttgcaagttttcgagactgaaaatcagttcgtggcgcacggtgtctaaggtaaactgctgatcgggatcctgaaacatgaagccgatttgctggtcggtggcgacgtcaacgtggccgtgaagcaactggccgccgaacgtgggatacaggcccgccattagtttcagcagggtcgacttaccacatcccgatgggccgactaatagggatagctggccggtggggatggttaacgtgaggtcggtcaatgtgggtggttgttgatcgtattgaaatgtcaggtggtcaattttgatgggtgccatatggatcattgctcctaacgggcgactaagacgtgagcgcgattgagtaggttagtaattaatttgacgaacacgcccccgaagataaagatggaaatgagacgggcgatgaacaagataatgagaagttggaggtgaaatgcgctatacccatttttaaacatgtcccacgcgaaggtcaaaacggttgaggtaatcgtggagagtcccagcgttacccagttgtaatacttatagccggtcagggtaaacccaagttcggcggccaccccttgaacgacgccagaaatcaaggttgcggcaccccattgacccccgaaaaacatttcaccaacggccgctaaaaattcgcctaaaaaggcggtgccggggagtcgaagcatgaaaccggccagtgggcccgccatgatccacagccccatcatgaggtcatttgccattggggcgagcccaatgggggtcagtacgacggtgagggcgttgtaaatgaaatctgttcccataaaaatggccccgaatataatgccaatcagtgctagtaaaatgatgtcgcgaacgtgtaactttttgtcttgatgcatggtgaatcctccctagaatttgagctacatgatccaacttcttccggttaacccaactatttcaatcgttccaaaatcaggaacaattaaaatagttacgttaatcctcggaagttattcggatcatttcgcatcataaaattaatcaaaaccacatcccaggtaaaaaaaccaaccaaaccaactaaaaaacgtccctccgctaacggagagacgttaaattaagtatcattaatgacttaataatagcgattttaatatctcccttcgctggtactaaccagagcaggttcaatgggtatatctcagccaaaatggcaccccagatgtaatatgatttaaggccaatataaccgatctgtttgaaaaatgcaattataaattttcagttaatgatcatttgaaatgtttgcgtccaccgattaagctcggtataatcatctctggtgaagaattttaacggattgattcaagggagaaccagtgtcacatgaaaagaataaagaagagtggattattgattggactcattgccatcgtattggtggtgggatactttgcatttaatgcggccgatgccgccagcacgacgcaaaaggccactgcgacgagcagtacttcaagtagtaccgtagcgaaggtcgtcaagacggtcgactggacacaatcctcggaaaaaaaggcgtatcctgatctaacgaagtatccaaaagcctggctggatgtcaacattgccaagcaacgggtatacattcgcgacggcgccaaccataatcaggtgttgtacacgatgtattgttcaaccggcaagaataacgccacaccgcgtggcacgtaccatattcaagcagagcggggccctcatttctacaatgcgagtgaaaaagagggggctaattactacgtgtcatggaagaatcatggtgaatacctattccacacggtgcccgtcgacgctaacggcaactatattaagtcggtcgccgataatatcgggcataaagcgtcctctcatggctgtgtgcaactcacgattcccgatgccaagtgggtttatgagaacgttccttacggcatgaaggttgttgtgcattagctggcagccgtactaccgcgattatcaataaaatagcagcgtcatttgactggtcattactaatcaagtggcgtttttttggtgcggaaagaaagctaacattaccgtggttagttgattggaatgcctaaaaaggagccataaatttagctaatttgcataatgaattcaagcacaggtcccgatatactggcttcaagttgagtagtcgcacacgaggatgatgggagcgatatgaatggaaaaacaacgaattagaaccaatcccgatggaactaaacgggcacttagcaatcgccatgttcagttgattgcgattggtggcacaattggcaccggattgtttttaggcgccggaagcacgattaccaaaacagggccgtcgattttggttgtgtacgcggtgttagggctatttttctttttgatgatgcgcgcaattggtgaaatgttttattcagatccgtcacagcacacattcgtctcgtttattagtcgttatttgggtccagcggcaggcaagtttagcggctggacatactgggtcggactggtgtttgttggaatggctgaattaacagcagtcgccacctatgttcagtattgggtgccgggggtgcccgcgtggattatcgaaatcgtctttttagcggtcctaacgaccattaatttagttgccgcccgactatttggtgaagctgagttttggtttgcgatggttaagattattgccattatcatgatgatcgtcattggaatatatatggtggtgacgcattttaaaacgccaactggtaccgcaacgtttagtaacattaccagtggctatgcgcttttcccaaagggcattagtagctttgttgcggcgtttccaatggtgttctttgcctttcagggaattgaatttgtcagcatcacgatcggtgaaacaaaggaaccacgaacggtattgaaaaaggccattaacgaaaccctatttagaattttgattttctatattggtgctttggttgtcattatgagtatcattccgtggcggtcgttgacggcgtcccaaagtccgtttgtgcaagtctttcagttggccgggttgccggccgctgccgcagtcattaatttcgtcgtgttgacggccgccgcttcggcactgaatagcgtcattttttctgccggtcgtcatttttaccaactcgccacggaagcatcagagaaatcatgggtccaccgtcattttggcatcatttccagaaacggggttccagcggcggctattctgatttctgccggtttcgtgttgatcacgccaatcatgagtttgtcgcacggcctgctagcagtctttacgattgtgacttctatttctagtgatatgtacttgattgtctatacaatggcgatgctggctcatcggcgttaccgcgcttcggctgactttttgcctaccgggttcaagatgcccggttatcgcgtcaccagtgtggcgaccattctcttcttcgcggtcattttcgtgagtctcttcttcattagcggggatgcgattccggccgtcggtgcgattatttggacgttggtttttggtggctggtgctatcttgaggagcaacgtagcgtggtcgttaataaatgaaaataatcctagctaactactaagatcacggcagccagacgatatatctcgttgggttgccgtgatcttattgtgaattaaaaaagtgacccgccatcgtagctggtcacttactggtttagtgttgtttaaataattgggtgaggtagttcataaaggtatcgaggtagcgttgtttgtcaacgttcaccgccaccttgacgttggtcgttggttcgttgagccgatccttatcaccaacggtccggccgtagttgctttcatcataggtaaccttcatgttcaaatcgatggtttggacaaatgaaggatccagtgcaacgcccacagcgaggggatcgtgcaaggcacatccgtttttatcgatgtcgaggttgtagtaggcgtcgatgtagaagtcggtgatgtcggcatagtttttaccagcatcggtgccgaggttccgccaaacttgggtttccgccttggtcaggagggtccgtaatgtaacgtctaagccgaccattgtaatcttcaagtgactgcgcatcacgcggtccgcagcttctggatcttgattgatgttggcttcggcgtcggaggtgacgttcccttcaacggtgagggcaccacccatgaaggtgacgttgccgatcaagtctgcaattgcagggtccttagcgagggctgcatctaagttggtcattgggccagtcggcacgaaaattaagtcgtccgcatatttgtgagcagcttcgatcagaaaatcaatgccggattgggtttcgatgggacgtttcgcctttggtaatgcgacttcaccaatcccattgttcccatgaatatctttgctaacttgcatcacatcaaagtgatcggtggtgcttgaatgactggcacccaagaaaacaggaacatcagttgcgcctaacaactctaaaagcttgaggctgttttcgccagattgttcaaccaaacagttaccatatgagcttacgatcccgatcaaatctacgtcgggagcagccagtgcgtatgcaatggcgagggcgtcatcgacaccggtatctaaatcaagaatcatcttttttgttgccatgtaactacctccaaatttgttgatgtaagccttttctgcatatttaatgataaccaactttccgtaaaaaaacaaacaaaacaacaaaactgacgcatgatttacgaaaattgttataataagacctaataaactggagaagataagtaaaacggtttaacgaaaggtgagttgacatgcaagatttttacgatgtgacgattgttggtggcggaccagccggaatgtttgcggctttttatgccggattacgggagttaaaagcccaattaattgaaagtctcccccaattaggtggacaggtcagtgcactgtatcccgaaaaggaaattttggatattgcgggctttgccagtgtgacggggcaacagctgattgaccagctatcagagcagatgaagcaggcgccaatcgaaaactaccttggcgaaacggtcgaggatgtcgtcaaagtggatgggggctttaaagtggtgacgaaccaacggacgtcctattctaagaccgtgatcattgcgctgggcaatggtgcgttttcaccgcgtaagctggccgtggaaaatgctgatcaatttgaaaaccaccagttattctacgcagtcacccatcgtgacgatttccgtgatcaacgggtgctgattgccggtggtggggactccgcaattgatatggccttaatgttggaacccgtggccgctgaagttcatttgatgcaccggcgggaaaaattccgtggactggaacacgaagtgacgaaactcaagcagtcgagcgtccaactggaattaccctacctgttaaaagagattgatgaaaatgcggaccattcgttacacctgacaatgaagaaaatgcggtcagatgacgaaaaggagctagatgtcgatgatgtgatcgtcaactacggctttacgtctgacaataaggcactgacgagttggtcgttggaattggaacaaaaccggcatgatattgtggttgattcaacgatgcaaacgagtgtggcgggtgtatatgcgattggggatggcgtcaactttgatggtaaggtgaagttgatcgcgagtgcatttggagaggccccaacggcaatcagttcggtggctaagcagctctacccagatagacacgcgccagtgcatagcacatcgttggcgtcgagaaaaaatagggtgtgaagcaagggcgcttagaagttgagcattaacggaataagacctgttgattcctgaatttggaattgacaggtcttatttggttaagcgcagacttctgtccttgcggaacccaactaatctgaaatgtaaaaagtaacactaggcatattgttttttgatttacctaagacgggttaagcacacattggtctgtacctgtttgtctttgtgacgcttatcgtgttttacgcgatggctcaagacaatagacacgattagaccccataaaaaaagaaacccaatcgctatgtggagtagcaattggattaagtctctgaatgtagagtgaaagaatctgattgtggttgccctggctaaggttattgcttaacggcccaaacggtactgtaaccgacgcgtaaaattttgttaccatcctgtttgagcgtccaagtttcaggaccgcctttgtacattccggcaggttcacccgttccagaaatgacgtaattaccgtctaccattttatacgagacatcgttaaggacgacagcgggcatattagattcactgtatgtggccgaagttgcggtaaattcgtaggttgaggcaaagccggctgcgtcactcttttcggtttcctgataggtgccgattaacgcagcagggattcctggatgagttgcggtgtcggttgagctggcactggcgctggaagcacttgaagcgctagaggccgaactactacttgattggcttgattgactactttggctacttgaagattctgccgatgatgaggtcttagtggcctttttgtggtgcgattgttttttggcactggtcgaactattgtcgctcgatttagccgatttttggccatcgctgctgccacatccagctagtgtgagcgacaacagcgcagccgcggtgatactgattccaacccattttttcatattcctagttcccccaatagttttctgtaagctaaattataacagaataagatttggaaaaatattagttgccagtagtttatgtgtaaattcagcatttcaacgcgggatgattttttgacgttgaaaagccgaattaaatcccagaagtgataacaaataacgaaaaactgtcttataataaaaaagacttaatgcaatgatcacttattgtctagggagggtaatgcgtgcaagttgaattggaaaatattgggcttacttatgataatcagcaaccgctgttcgatgatttaaattgtacagtcctcgatggtgaattagtcgcgctgctcggcccgagtggcagtggcaagaccacgcttttgaacctgattgcgggcctcctaacccccacagctggaacaattcgatttggtgaaacggagatgacgcattgtgacgtggcgcggcgtcgaattgggatggtctttcaagactatgccctttatccgcatctcagtgtgttggataacatcgcgtttcccctaaaaatggcccacgttaagaaggcccagcgttatgcgcaagctcgggaaatggccgcctttgtgcatgtgacagagcagctcgatcagttaccgggtgagctatctggtgggcagcagcaacgtgtcgccattgcgcgcgccctcattaaacaaccggatgtgttacttctcgatgagcccttatcaaacttggacgcggcgttacgaattgaattacgggatgaaattcgccggattcagcaggccacgcacacgacgaccgtgtttgtaacccacgatcaaagtgatgcgctccagattgccgatcgcattattttaatgcggcacgggcagattcaacaggtcgggacggggatgaccctgtaccgccacccgcagaatcagtttgtggcccagtttatcggcacgccgcggatgacggttttacccgttgaggcagttttacctcaattagcgccccatgtggtctccgatttactggcgcgggcgacgaccattgggattcggagcgaagccgtgcagctagcggcgacgaatgatcagatgacgctcacgggcaccatcacgcgacaggtcacggtgggccgcgaagttgagacaacggtccaaaccgctgctggtcaagtggtgagcaccgcgattacggcgcaggtaccggttggacagtccgtgcaattggccgttacgctcacgagttgctatctgtttgatcgtaccggaacctgtatttgggaggggacggcggatgattaatacgaagcccactttcaaaacgacattacgggcgctgggctatttggcaccgctcctgatcattatcggcgtgtttaccgtttggccgctgattcatgcggtactcctgagcacctacaccaagtacaattactacacgaatcaggtgcaggccgtgggactcgataattttagctatctgtggcatgaccctgattttcatcaagcagtccgaaacacactggtgttagtgtttgtagtggtgccagtgacggtgctcttgtcgctaggcattgcgttgctcattaaccgcatcacgcgcttggcccatttttttcaaaccctctactttttaccatttgtgacgtctaccgtggcgatcgcgatggtctggaactggattttgtaccgcaacgggggactgctcaacacggcgctaggctggcttggaattcggccggttgattggttgaacgatccgcgctactcactggtggccctcatgttgatgtgcatctggcaggggctggggttcaatattattttatttttagctggtttgaacaatctcgatcagcggtactgtgcggccgcccgcatggatggagccactggctggcaggtattaaccaacttaacgtggcccctgttactcccgatgactgtattagtgacggtcaataccatgatcagcaattttaaggtgtttgatcaagtgtacgttttgtttcatggcagtacgggtcccgccgacgcggacatgacaatgattttttacctctaccaaaaattttacgtggaaaatcagtttgctatcgcggcggccagtggtgtcgttttgtttatcctattggccctcattactggtctgggtgcttggtatgttcatcatcattaccgccgaaggggtggtgatggacgatgaagcatcgcttgcagacattcctagtggttttgattttggggattggcgcactgctcatgatggtgccatttatttggatgatcatcacgagtttgaaaaccccagccgaggcactccaaattcctcctgactggtggccgcggtcttggcggtggcacaattacctgacgatgtggcatctggccccgtttggtcggtactgtcttaattccctactggtaaccactgcgattacggtgggacaactcgtgacgggaattttggccgcctttgcgttgacccatcttcagttttatgggcgccggagcctgttcatcggcttggtcgggctcatgatgataccgggcgaactcttgctaattcccaattttgtgacgctgacgcagtttcactggattgatacctatgcggccctgattgtcccgtggctggcgagcatttttgttctctacgcgctgcggcagtccttccaagcaacgccacggtcacgctactatgccgcacggattgatggtgcgagtgactggcagtacctctggcagattctcgtccccgccaatcggaccacgatcgtggcggtcgccgtattgcaggcgattgggtcgtggaattcctttatgtggccgctgatcgtgaccaattccgatgcgttgcggacgctcccagtcgggctgatcgcatttacgtcggataatggcacgaactacccgttgttgatggcagcttcgacctttgtgatcggaccgctgttagtgatgtacctcgtacttcaaaaatatattgttgctggtatgatgcatgccagattgaaaggataatcataatgattcgtttacgtcgtgtattgactctaagtttatgtttgttggtggctgtcttcactttgagtgggtgcgggcagcaacaccagtcctcatctgcccgcgttaaaattacgttttggcacggcatggtgggcgcccacaagacggcactgaataagatcatccgtgactttaatcagtcgcagtcgaaatataaggtggtcggcgtctcccaaggcaattttagcaatgtgcaacaaaagattacggcagctgccaaatcgcatacgttgcccaccattgcgcaaacgacgtataccaacgtgcccgattacgtgaaggggggctttataacgtcgtttgatccctatattagtagtgccgatctgagtgatatttatccggctttccgtcagtcgatcaagtatcaaggcaagtcatacgccatgccattttcaaagtcggctcagattttatactataatcaagatcttttgaaaaagctcaacttaagcgtgccgacaacgtgggaagagatgcaaaaagatagtgccattgccaagcaacagggatatgccggcacggtgtttgatcaaagctttatctcccaacttgatggtttgagccgccaagcggggaccacattgatgactagtacccccaaaaagcagttcaacgtcgccaaggtgacgactgcgacccatgtgatttgggacatgctccaaaacggttcggctacgacggccgggtcggatggctatggggatgtgccgttcttgaagggcaagacactgttttataccggttcatcagcggcactggcctttatgcaatcgagtacgcccaaggggatgcactggaatacgacccccttaccgagctatcagggcaagcaggccactagcattgccggcaacgatattgtgatgtttaaatcagcctctaagcagcagcgccaaggggccgccgcctttgttaaatacttgatgagtacgaaacagactattcggtgggccaaggcgtccggttacgtgccactaaccaaatcggcgcagaaaaataagagttatcaagcctatctaactaagcatccatacgatcaagccgcactcaaatcgcttgattttggattccaagatcggtcattcttgggatataaccagtattacagtgccgtggggaaggccattagcaagatggcgaccgatcatcaaaccccagaaaagactttgccgacgttaaagcagcagttggtgaagattgtgaaatcaaatcaataggtatttaattagaaatatgctgaatttgagtatattcataaaacacagctagatgaaagctaacagcttgcatttagctgtgtttttgcttattatagctagtaaaaagggggctacaaaatggctgttaaaggtaaatcagacgatcgtgttgtggttcagacacgaacggaacgtgaaacaaaggaggccgcggttgcgacttttaaagcaatgggcatggatctcagcacgggaatcaatatttatttgaaacaagtcgcacgtgacggacggttgccattcacgccaagtgccactgatccgctagaagcgacgttagctgatgccgctgctgacatcaaggctgggcggacggagcactatgatacctttgaagcgtatcaggcagcaatggatcagctatgagagcaattcagctgacgcatacttacaaaaaacagtataaaaaattgaaacgatccggtgccgatatgaggttgctggatcatacaatcaaagtattaatgaccgaaaatgcatctgaactagagcgactttgggatcatcagttaaaaggaaagcttgcggcgtatcgcgaaattcacgttggtcagagttcaagtaattgggtcgtgcagtatcaagttgtggcagacggaacgctactaattcttcttcaaactggttctcacaatactgttttgagactttgattaatcgaaaatagaattctacacgctcttttcacgccttgaaagatggcgtgcgataggacggaataaatgcgcgcaaaactggggatgaacaacatggtgaacgataaaaaagcgactgctgggtcgcgtgaactcaaaatttatgccgatttaatcgatcaaaaacgcgtcaataaacgcgacttagcacagttttacgatgtatcagcaaaaacgattcaacgcgatttagccgccattcgtagttttttacggcaaaacgggatgaaccgccagctggtcactgaaggcacggctgacgaaacggtctatcgaattcgccaaactggggcggggatgagccgtgagtctgtactagcgctttgcaaggtgattttagcaagtcgggggctagatcaggacgaaatgaatgcaaccttgagtggactgttaagtttactagaggaaactgaccaaaaaattgtgacagatattattgccaatgaatggaagtactaccgcccattgacgaatagtaacaagctactggatcggctgtggcagataggtgaagccattcagcggcaaaatacgttgcattttgtttaccggcacgcgagcggtaaaacgtcggaagaaaatttattgccgcatgccatcatgttttgggaattttatttctatgtagtaggctttaccgatggtgaagaaaatgaaaattatggtcggccatatttttatcgggttgatcggtttgaagaactgactgaatctagtgtagcggtagatgcgacccatttaaatcgctttgaagatggaaaaaaccgtcagaaaatgtatttgatgcggcggggattcgaacgaacgattgaaattgagttcacaggaacactggaaattgtgcaagatcattttgaggtgttaaaaagtgtcccaatgcgttcatcaacgggagaactgattggtcatcgggtgacttttcgtgcgtacgatggcgcggctatgatgtggcttctaggtcagggaacgcacgcaaaagtgatttcgccgaccagtctcaaaaataaaattcaagcggagttggcggctatgttacggcagtatcaggattcagatgaaagctaaacgattgctaaggtttcatcgtgccggcgaaaacgggtctcgaacagatgatgtgatttgattcaaagaagtgatgattttcagaaattctttgaattaggattaatttcgaattaaagcgccatgatatgaaaagctgaggaaatgtgagttcacatttcttcagtttttttttgctaaatacagaaaaaagttgttgcaagatgaaagaatacccaaatactgtccacccctcatgatataacaaagtcaatcaattaatccggatttaagcgagacactaaaaataataatttagggcaaagcaccatgcagcaacataaaattgttgctcaatgataactagaaaatgattgttacattaagatattgctatgattatgtaaacgttataagctactaattggaggtggattgaatggctgacgaaggtggtcgtgccacgtataaattgtcagggtacttaaaggcacatgaaattaagcagtctgaagtggcggctgttttgggcatttcactttcgaacacgaataagaaaattcgccataaggttgagtttaaggcgtcggaaattgaagcaattcatactcagtttcaaattccgtacgacgtattttttggataattaatttagggggcacttgggatgtacgaaaataaagaacacaaaaagatgtttaaagttgggaaacactgggcagttgcgacgatcgcgacggtggcctttttgggagcagcaacggtcattgatcaacaagccgttcacgctgatacggttgatacgtcactcgtaggacaaaccgaaaattcacaggatattgatcctgacacactgacggatgcgcaaaaggctgctattcaagcacgggatgacgcccaagcaacagctgatgaagcgcaggcgagtgcggataccgcccagtcggccgtttcagccgctcaaacgacggtcaattctgctagtgcggtacaacaatcagctcagacggcttacgatcaagcagcaacggcaacgtctggtgtgacacaggcccagaagaatgcggatgtcgccagtgcgcagtcggctgtgaatgcggccagtcaggccttagataccgcccagagtcaacaggaccaaaaggcagctgatattacggctgctcaaggggatgtcgacagtgcccaagcagccgtagatgcggcccaaacaactgatgcggcccaaaaagaagccgatgttgccaacgcccagtctgctgtggatacggctcaagagaatatcgcgaatgcccaatcaactttggataatgctactactacattagcacaaacaccggccacaaccacgacgactcaaacggtaactgatgatacagtttcttccattggggatgggcaaacgttggcttatgcaatcacggaaggtaagacaacaaatgatggaacttttggtcactttaaagaaggacaggcgcaaggaaatccaacgataaacgataatgtgttaccaacacaaatttcggaatttagtgatacggatgtaacgggagataagaatgattttgatagtgttcttaagcttcaatacgacgaaagtgatctagatgaaatttggagcggtgatatggttggcaatcaattaactgatagtcaacaaaaagaaatgaatacctatctgattatggtattaaatcattatcgtgaaagcttgggacttcagcccatcacttcaacaaattcagtgtacaatgcgactcaaaaacggggtcagacgttgctgaacgagaaagttacgtcacatgatgatactattacttatcccatttttgagagtgcgggattatcagatccggctgaatgtctatctggtgtttatggcgaaacaggggatacaatgtttgagatgctagaaaacggtgtatctgcgttggatgatctattaaacggtgatgctgacagcaattggggtcatcgccaaattcttcttagtgagagttggaatgtcattgatggtgcgttctcagttgtaaataccgctggtggctgggcacttgtgtttgaaggagttcaagaaattgataattcgggttccgcccttgtcagcaccgagctaacgggaacttcaacgcatgaagagacgaccaccgttgctaatccagcctataccaaggcgcaacaagctgtaagtgcggccaaaactgcggtaaccgccgctcagacgcaattaagcaccgctcaaacggcactgaaaaacgcccaaaatgaatcaacggataccgctactttgaaggccaacttggcaaccgccaagcaagctctagcaactgcgcaaagtgaagctgacggtgatgtaacgggcgctcaagcagctttaagtacggctcaaacagcattgaccgccgctcaaaacgaagtcgtcgatacgaatagtcaagcagacacagccaagcaggcgttagatgctgctaacgcgcaattggcaacggcgcaacaggcattagcgaccgcacaaagtcaggcaaccactgcacaaacgacattgacgacagcgactgctagtttggcaatggcgcaacaggcagttgatgatgccctggcaaccacgagtgggagtactgaaactggtaatcaaacaacgaattcagggaccacaactgaaacgaccggtcagacgacgagcacaactggcaacggtgggagcacgacggcaattggaacgactaacaatggtggcacaacaaccgaaactgggacaacaacaccaacggatggtcaaacaacgacgtcatcaacgacaacttcatcagtagctggtcatagcggggacgccactactggaagtgctgagagtcagggagccactcaaaaccagtcgacagtaactgctgggcaagcaactaagttagctacagcgacaactgctgcaacaccgacaactgcgattacgacgtcaagaacgtcacaacagaagcaggcggctagccagttaccacaaacggacggccaacgtgaaacagatgttgcagttatgggaattcttttggggatgcttggattaggtggcttggtgatgaaccggaaacggcaattctaacgagcaactagtaataatcaaaaaagtcataaccaccagttgaataagtggctatgacttttttgtaggaggagtaaatcggtgaagcgtaaatggattctaatcgttgttggagtagtgattattctatcaattttttgtggattatttgtactaggcaagcactcaacaagtcaagcaacaggtaaacaagacagtgaaaaatcatcaaagagtatgacgaagctggttaccaaaaaacaaattaaaaaaaataatcagattgctgctgcaacgacactaagttatgctgcgaatcatgtgaaaactagtgaatggcgtgcaattaaaccatatctaaaaaagcattattcgctaaaaatgtcttctgatggtgatgagataaaatactttgcgacggacggtcatgacaacgacaccacaaaatcaccatattatcaaattaatagtaaacaagatcgatatacgttttattcatcaaaaggtaaaaaagtaggctcagcgagtttgaatcaaatgattagttatgtaaatgaaaattttaataaagcaaagtggaacaaaatgatcaaaatggtatctgtttctgaaattgaaacgaattcaagtagttcgcaaagttcatcaagttcatttactcaagaagaagctctcgcattattgaaaaaaacaggttggaataagccggtgagtcaagtatctggtgatagcagtgcatggacctttgattctgagggtcttgactggacagtatatcctgatggatcgatgcactttccaggagatcctgatggttatagaggttttcctactgacaatagtattcaagatgatgcctcatcatctttgcaacaactcacagaaaatgaggccagagcgttaataggtggtgctaatggtgatatggaggcgcatcgagattcggatggatggacattcactgctcccacagattcagactctaatttagaagtttatgttaaagatgatggaacagtatcaaataatcaataggaatacggtgacggtatatgacacgaatttatatacatgtttgccatgagtagtcttgctacgacaattgtattaattgttaaattaatggtaatcaacaatgacaatcgtaaggttattaaccaatgaagtaaaacattaaatactttagaaagtaaatataaatgaaatttaattgattttaggagggatattatggatgctcttgagccaaatacggcactaaaagattggattcatcaatcgatttcagaactatcgtactatcaaaaaactgaaagttttatggaagctaatttagcccaattaaaaaaacaagttaaaccactcaatttggagcaggcttctgctagtcaacacgttattgattgtgaacgccagttggataagactgaaaaattaaatccagatttagttgaccaatcagttgacggaattgaagttgccaaaaaagtagtttcaggtgtcggtatgggtgtgatcggtagtattgctggtattttttacggactgtttcaattactcaaggcaaatatcattgtcgggattattgggattgtagtgttgttctttattgtgacacacctagttggattaatgggaaacattattttgctactctttattgtggcaattgccattgcactatatcaaattttcaagatgaaaaaagaaaatgctgctgaactagctagagttcgcgctgaattggcaaaattacaagaatatcgtaaaaatttagcggacgcaaaagattttgaagaagaaattcagcaaaaacgacaaggcttggcaactatgattgatcatcaggaaacgcatattcaggaatttatggcagagtttaaaaaggcattgcaaaataaaaaactgaatttagggctattgccagaaacctttcaaacaaacgagcaacgattgttgcatgcgtacgtgataattcaagacggcgccgctaaaaattggcaggaaacagccgccattgttcgaaacgaggaacatttagataagatcagtgatgcactgacacagcagatgacacagcttcaacagcaaattaaagacattgcgaatgaaaatatgttgcagttggttcaaattaatgaagcaattgacaaaaacactggtgcgatcattgatcagacgaagacgctaaaacagagtattgaagaaaatacgaacgctgttcaacaacagactcaaaaattaaatcaaaccgtaactgaacaaacacagcagatcaaacgtaatacgcaagaactacaaagacagggtaaaaatattacaaatgcagtgaactttcagacggggattgattttctaatcggaagcgggcaactatacgtcgctaacgcaactatggaacggttctaccggaagtgtccgatgagttcattggaacaggagttactgcaaggataggggcgttgtggagcaatgcggaacaagcgaaacataaaagataatacaaaattatcacaaccacaaaaaggtaagcataagtggattttaggcgtcctgttattggtggtactaattggtagtggaataatggcttttgaatttgggaaaacgagttcgcaagcaaagcaaccagataaacaggtagcctctcagaaaaaatcgagttctagcaaaaaaaatgatcgagtaaaaaagaattctacgaagaaaagcaccgccgctgcaagtgagtccgtgtcttctagtagtaccagtactagttctagtacaacatttcaactgactaatcaaaatttgagttttgtgggttggaataatgctgcactgtactatttagctcacaagttaggatattcagatattattccgtacatcgatagtggctcggttgatatgtgggatatagataatcaaacgaatcggttggtgttttcgtatcaggatgatcgggatgatgatgttgccagttcgggtgttggatttgagtttaatgatgatcaaacagtttctttctataaaggaatatcccaatctgggccttttgtgacggtttcaaatgaacaagttaaagattactgtaattctgttaatgctgggcgtcaggtagaagatttaaatatgaatttagcagatctgggagactcattcagtagcgactcagaaaattaattgggagtgtgactgaaaaaataccggtaacattttttaattgttagttaatgttttgaggatggttggcgtatgtaattatatggttttaattggactaatcagtaaacatatagcgaacacaaactattataagggagaatttaatatgaaacaaaagtggctattaggagtaacggctgttgtagtggtattcataatactgttcggactttttaaattaggaagtcattcgggaaaatcacaagcatcacatacacagacacaggttcagaaaaagcaaagtacatctagcactagccaaaagaaatattctaaagaggaatatgccatgatggcgattgttgattataataaacaggctggaacgcttgtcgcagagaaaaatattaatttttacacgcagtcggatcattttgaagcgattgattctaacggacctaatccgatgaagatcacggtcggacagaagcaaacgaagctggccgatgaggacggaaagtcacatgtgtatacaatactgaaactgaatcaacagcttaaaaaacagcaaaataaagtggataaattgattcaaagcgggaaagctaactatcaatcgtccaaaaaggatgaatctttgtcaacaagtagtagttcaagttcggctgacacgcagtcttcaagtgtggatgtgcataatttaacgtctacgcaattgttagcatgggtgaaagattatggaacacaaaatgaggctgattacgaaaagaagaacgggacatcaagccccgatactgaaagtggcgagccggatcagttttcagttcagaacgtagacggatatgcggaagtttgggttcttgaagaaccctcaactaaggttgtagaacgatatcgagttgatgaaaacggggatttacaaaaccagccgtggaatgtgacagatgagtggacgaccattagtacaacgtatatgggtaactacacttttgataactaggtaaataatcaaaattgaaatcaaaaatgaaggttcgtgctggctttacataaattttgtaaagctagcatgaaccctcatttttggtacaaccgtaaactactcatttaccaaaaataacacacgacaaatctaaaaatatgcgctgatccgaacaattgtgaaacataaactgaaagcattcatgattgcgtcaatttaaaaataggtcgtgtgtcataatccgaatattgaaacttctgccggatcacaggttattgatcaagcatgctgggattaattctatgttctttaaagtaatattcgcgatcatgttggttaacctgtcgtgcgacttggcagggattaccataagcaacgacattatcgggaaggtttttggtaacgatactgccggcaccgatgacgacattattgccaatcgtgattcctggcaaaattgtgacaccggcaccaatccaacaattggtaccgatgcggacaggtgcattatattgatacccctttgcccgtagttcgggaagaatgggatgaccggctgtggcaatggtgacgttagggccaaacattgtccgactaccgacatagatatgagtgtcatcaacgagcgttaggttgaaattaccgtagatgttatcgccaaagtgaacatgttttccgccaaaattggcgtgaaagggtggctcgaggtagcaaccttcgccaatttccgcaaacatttcgtgtaagagttgttgccgtcgcttttgttccgttggtcgagtttgattgtagtcgtatagacgttcgagacaggccaattgtatttctgatatctcggaatcgctgggatcgtaaagtgcttggttatgcatattttctttgttagtcgtaaagatcgccccttagtaggtaatataaaaaatactgaatgctggctagattatagcacgtgtggccgattttgaaagcgctttttaagtgagtaagttaacgtaacgaagcaattctcttaattgggattagagatggtaactcaaccaaatggtataaatcttactttaattggaaatagcccacatgccaatctggaaggtgaaaataaccttagaaaacagacgatacgtcaatctggtaatacggatgtatgttaaaataaccaggagtatgaggtaaaattaatccaactagaaggagactactgatcgggaatatgagtactggcataattgcactatcgtacatttcatcgcttattgtgaatgcagtcgtgctgttgggctgcgtctccttattcatgtggattgagcgggaatccgaaaacgaatttatcaagcagcaccgttattttttgctctgttcactcgggattgcgtacttagcgttggcctatatggaagctcaggccaataatctgctatcgcgcaatttgacgggctttcattggacctatctcaacatggtgattgtcggactctttaatcttattttgagattacggatcaaaccgcagctcgtcattacacttctttttacaatggtgtgggggatcagcggtatgatgacatcggcggtgtcgcccatttccgtggagcaaactgtgggcctgatggtggttgaatgcctgatttatgggtttgccaaacagatcgtggcgcgttcatggctatacgtgatcacatttattgtgttttcgttttttggcctttcaatgggatcaatgctctacaaggggcagacggcgggtgcgtgggcccgtcaaattctggcgttggttgtgctggaaggcgtcatcatattgtatgcacgactactgggaaagcagaatgaaaggattcgggaatttaaacatcgcgcggaatttgatggcctgactggttgtaaaacatttggcgtgttcaataccgatttacaggacgcctatcagcattttacacagacgcgcaaagtctatgccatgtatgcgatggatcttgaccactttaagcaaatcaatgatacatatgggcacgttgccggcaatgaggtactgaagacggtggcccacaaaattaaaggactggttgataatttagactatccggccgcactttatcgcaccggcggggaagaatttacaatgctgatgtacgaggttaacccagatgaagcccgtaacgaagccatttccaaaatgattcaggccgaggtcgcccagttaaattttgtgtttgataagcgccaagtaaagatcacaatttcactcggtgaagatattgtcactgcgaatgatgcgaattatttagacctttataagcgtgcggatcactttttgtatacgtcgaagcatcggggacgcaacacgattacgctgcacggacaaaactaaaatagaggaccagcatacttattttgctgatcctctattttgttaggcgtgatacgagtttattagaaaattgttttagcccgtgaaattaattcgttaagcatagaagctgatacatgaccaacaatttcgccatggcgggcatcaaaatcgtaatttggcagttggaatgtaatgatggaccctgaaataccgctggcatgatcgtcaatggaaacataaatgtgatggtcgtgcttaactttggatgtaattggcattccgataatcattcccattgcttgattataaccgtcgttggacagtaccaccatcgggcggcgaatatgaccactttgcgggcgatgaccgccttcctcatgcccagcatggggttctgcatcgatgaagatcaggtctccttgtttaggagttaccattcaatgttctcctctccgacaggtgattcattcccgaaatgccccacgtcattaagctcggcacgaaaatcaatgttgtcatattcaccagaggtccaaggattttgatcagcaacgacgtactctagtgaatcatcagatttagcttttagaataaatttttgaccttcaggaacgccggctgtaactgggactgtgagaatcaaagaattgccagtttttcgagttgaaaattcacctaaaattcgttcggagggtaatttggtgtttaaacgcgttaacgagttatcgagtgaagaacaggatgatattgtgaggtttatggaccagtataggccgctgatggaaaagttaaaggataagtaaggcggatgcggaaactcatcatttgacgaaatttttttgattttttggtgtattgatattgattatgcaaaaagaaaactaattaagttttttgtaaactgtaagcagctaataaagcatccccgctaagtattttgcttagcggggattttgtataacctatttacttcattaaaaaagccgtttatcacaactaataaattgtggtaaacggcttaatttaatgctagttcttactatcatcagggttcgtaatcttaattcggttagaatccgttgatgagtgggttaattcaggtgcgtcagttgagtactcgctcgccgtcgtcttatccccattttcggagtaaaggctggtcgacttgcccttcaactgatcttcaatcttaatttctttatccaatccgttcgaatagttgtacttcgacgcgttgacggccttgaagccttttggattatagaagcgcagcaggttcttatcgttcaaggaatctgagagactgagttccttgttgaccttggtttgatccttcttcaactgcttcttctgggcggccgttagagtggcctttttacccgtcttattactgtagatgacgtcagaaatgctggtatagtttggcgtcacgaagtcttggttccggaaggcgacgacctgatcgtgttgactagagaagaggtcggtcccgaactggatgtagcgcttcgaactaacaccgagcaaatgcatgagggttggcaagacgtcaatttcaccaccgtaagtgtgggaaatatagcccttaccaccagaattaggaatcaggaacatcagtggcacccgctggagttgcgcgtcgtcatagtgagtccagtcatcagaactcttgccgagcacggaagccagtttcttgttttcggaatcggaaataccgtagtgatcaccgtagatgacgaagatcgatttgtcgtagagaccggtcttcttcaggtaggtgaagaattccttcaaggactgatcgagatagtgggcggtcacaaagtagttatccacggcactatcaccggtatccaccgtcttgaagtttggatcctcatcttcggagtcgaggtcgtacgggaagtgatttgtgacggtaatgtacttcgcgtagaacggttgttgtagtcgttcgaggtacttcacggaatcgttgaacagcagcttatccttcaaaccatagccggtcgacttatcaccagacgtatcatagtagctggcgtcgaagaagtactggtagcccatgttcttgtagacgttgtttcggttccagaaactggccacgttcccatggaagacggcactggtatagccggctcgttgcttcaaaattgatggtgccgcttggaaggtgttgtcgctccccagcgttgcgaagagggacccttgtgaaagcccgtacgtactggtttctagcatgttttcggcatcactcgtcttaccctgtcccacttgatggaagaagttatcaaaggcgtaggtgttgctaccgtgatagatcgagttgaggaatggggtgacttcctgcccgttaatcttcttatcaatcaggaattgctggaaactttccagatggatcacgaagacgttgcgccccttggcaatcccgtacatactcttgttcgggctggcatagtgggcgtcggtaaatttcttaacggcctctagttcggactttgtggccgatttacgcatgttgctggtgtgctgagatttaattccgtcgtaaatggtgaaggcgtcgacacctagatacttgacgatgtaggttcgatcaaacgtccgcgtgagtagctgtggacgactcatttcaccgagcgataggttgacaccaaagagggttaccgccaccgacgtgatggcaaaagccatccggtgattgacgccgcgcggatcgaatttaatcttgcgaaacagcatcatcagtaaaataatgacgatatcgatccagtacaaaatatcgtggacgttagtgagcgcgagcgaactgccactcaatccttgatcaactttcgagtagcccgtcatggtggccaccgtcataaagtcggtaaattcccggaagtaaatgacgttcaaatagagcaataccgtgttaccaatgtatagcgccattaaaatcgggtagaaaaaccgcgatcgcttgaagtaaaaggcgaggccaaacataaagatggtcgtcgcgatcgggttaatcagcagaataaaatattgaaaaacgccttctgcacccaatcgaaaatcgacgaagtaggccagtagcgtttttaaccaaaaaagaaacaccaaaatggtaaagagacccattcttgtgtccttcattgtatttaacttgtgcatgtaattaacatcctcacagtctgaataggtatgaatttaaattataaacattcatattttatcatacattcttcatggccgtttcgagatttagcaacaataataaaaagttaattcttctggattgatttcaggaaaaaagatggtatcgctttaccgattgcggtaaggttgaggtacttcaagcaacggttgattcagggaggttacgatcatgacaaagttaaacgtctacgtcgtcagacatggtcaaacatattacaatatctacaataaattgcaggggtggagtaattcaccgctgaccgataagggaattcaagacgcccaggccgccgggcaaaagctggccgagacgacctttgcggcggcttactgtagcgataccacgcgggccgaacaaaccgcgaagatgatcttagcggccaaccacgcaggggcaccggagacaccgatcgtggcgccgtactttcgggaagaattttacggctattttgaagggacgaatatggatgaagcttggtacatggcgggcgcaccccacggtctagcgacgttcaaacagattgtagaaaagtattcgattggtaaggccaaggattttttgaaggccgccgatcccttccacgatgcggaagataatgcagaatactggcagcgactcgaccaaggctttgccctgattcgaagcaatgaccagctaaaggacggggataacgtcctcctaattagtcacggcaataccgtgttgagcatgatggaaaagtttggtcagggaaagtatgatctgaccgtccggccccaaaatggcagtgtcaccaagctcatcgtgacggccgacgatgtcaccgtcgactactataatcgtaagtagttagcgttgcaggcgctgttcaatttcagcacgctgatcggccagccatggcggtaagacgaggtgggtgcccaattgatcgaggggttcatcaacggtgaatccgggagccggtgtggcgagttcgagccggttgtcactcgggtcacgaagatagatactcttaaaccagtggcggttacggaatagttccagttgccagccctgttgcaccgccttttgccagtatgcaaataattgttgatcatcggcgacctgtaaggccaagtgatcgacgctgccccgcccaaagcgtgtttgttgctgggtcggggctttttttagcccaataaagttgtgatccgctaactgcacctgacccgtggcatcggtgggcgccgcgatgaattgatcgaagaagcgcgcactggcggccggatccggtccgagccagtgcgtgccgagaattttgacaatctgattttgagcaggcactggcgaagcagggttgatttgagccgctgtgagttgggcgtcaccttcacgcaaaatgatgtggaactcatcggggtcatcgaaggccaactggtcggcagtgcgggtgacaacgacatgttgatcagtcaaccattgcgcccaccaatcgctggtgtgccgaggaatttgaaggatgagattgctgatcgaatggttgccatcggtgcgatggccgagataggggacgataaaaaacgtgatgacggttcccggcgatccgaggtagtccccgtagaagaggtgctcgatggcgggattttcctgattgaccgtatctttgacgaggcgcagtcctaaagtatgggtgtaaaacgcgtgattactggcaaaattcgacgctaaaaccgagatatgatggatttgcatgacgtaacctcccaaataactgataagttgttggcttcagtatagtagttgcgcgcgttttgtgcacgaaattagggccattgatgatacaatggagcttagaagaatgtgatggggtgacagcgtggaaattaaacaggtaacgggaaaaagtggagcggtctttgaagacgccctcgccatacggctggcagtgtttgtgcgagaacaaggggtgccagaagccctcgaaaaggacagcgatgatgcgattgcgacacactacgtcggttacgtggccggccaaccggtagtcacgttacgaacggttttgacgaaccaacggcttcatatccagcgcgtcgcgacgatccagtccgcgcggcaccatgggtatgcggccactttgatgacccacgttctcgatcaggcacaagcggatgaccatgtgcagtctgcgtacctcggagcccaactaacggccctcgggttctacgaccggttgggattcacgccacacggtgatgttttcgaagaagcagggattatgcaccgccaaatggtcaagtccctaaaatagaggagtaattatggaatcagacaagcaaaaacgggtgctcgatctcagtaaattacagtttaaaattggggaattaagccggatgaccggtgtttcgacgcgccaactacggtattgggagaaaaaagcattcattgcggctaagcaacgccaagaagaacaggatgcgcgggtgtttgggtttgacgcctacgtcaaggtatcgcttgtgaagcacttaatggatgaaggctacacgctgagtgcggcgaatgacaagagtaaaaccctgattgaggatgccaagtgggcgcaccattttgcccggcaggcgtttcatggaatcgaaaatgtcaacggtcggcggcggttgaaccttggatttatcgacgatgtgcatgaacaagttttgtacggggtgaccgatgatgaaggtaagatccactatgaaattcatccggcacagtcgaatcaggagacgtcgggcaactaaaatgctaaaataaattcaattttaagataagtgaggtcttttcctgtgagtgaatataatgtcgcaattgtgggtgcaaccggagcggtcggcacacgaatgatccaaatggtcgagcaatcgacgcttaaggtaaaaacaattaagctcttggcctcgaagcattcggccggcaccgtgctcaagttcaagggccaagacacggtcgttgaagaaaccacccccgaatcatttacgggaatcgacctagcgctcttttctgctggtggcgccgtatcgaagcagtttgcccccgaagccattaagcgcggggcggtcgtggtggataatacctcggcctttcggatggatcctaacgtgccgttggtggttcccgaagtcaatgcggaggcgctgaacgagcatcagggcttgatcgccaaccccaactgttcaacgattcaaatggtgatggcactcgaaccgattcgtgagcgctacgggttatcgcgcgtgatcgtgacaaccttacaggcggtcagtggtgcgggaaatcgggcggtccaagagaccctcgatgagagccaagcctacttagacgggaaggcatacacccccaagattatgccggttaagggtgacaaaaaacactaccagcaagcgttcaacgtactgccacagattgatgtgtttgaagaagatggctacacccacgaagagtggaagatgattcatgaaacgaagaaaatcatgtgtggtggcgatatgaatagtaatgatattcaggttacggcaacttgttcgcgggtgccggtgccgattgcacactgtgaatccgtgtactttgaagtgctggataagcatgccacggtggcgggcattcaggatgcaattgctaacttcgacggggatgtcttacaagacgatccggccgagcaactgtacccgcaaccaatcacggcgcagggccgacgggaaacattcgtgggtcggattcgccccgatcaggaaaataagggtgcattccacttatggaacgtggccgataatctactgaagggtgcggcttggaactccgttgaaattgcggaatacttggataaaatggatttattgcacgttcctagtgcagcagaatagcaaaacagcggtacgacgacgattgagtcgcggtaccgctgttttttgagtaaatcactatttacgccaccaatgattgttcatcaacaaccacatagtcagaacggctaaaaccagcatgaccataatggttagttcccaaccgatcggggacgactcgaacggcaggtgcacgttttggccgaagaagccgaatacaattgacggaattgtgaggacaatggaatagatggtcaagaatctcatcgtgttgttcaggttgctatcgaggactttggaataggcatttgagatccgctcgatgatgttggaggtcatggtggccatttctagcccttgttcggcttcgattaagacgtcgtcgagatcgttggtttgctgcgttgtgagatttcgtgaccggcgcttcaaatctttgagcaacgaaacgttgcctcggagggaagtcaggatgtagatcaggccggtttcaaggttgacgaacgccgcaatggccttgcgatccgtccgccgttccagcgagcgctgaatttcgacccgttgggaatcagcctgacgaattggggcaaagtagtcggtggacagctgataaagcatcgggagtaccaaatcgatttgatcattaatgtgctgagtgtccgatttatggtcgacctgttcttcgaggagttcggtcacgaagttggtctgctccgtggtaaaggtgatgaggttatcgttcgtaaacatgatcccaatgggtgcagtctgcgattcggcgtcatcgtctgggacacagtagacatcaaaaatgagcagggtaatattggcgcggggatcggcttcgacacgggcccgttcatccgggtcaatggcgtaggctagcatttcgtcggtgacctggtactgcgtcacgagcttgatggtttcttcacttgtcgggttttggacgttaatccaattcaaatgtggcgttacaggggtgactgttaacataatcgtaactctccttattattctcatccattaaacactttgtcttggcgattgtaaaggatctgtcatagaatagaacatgaaaggatggtgatcggcatgtgtaccagtatttatcaagttgctcaggacggcacgcacttactagcgcggacaatggactggccgtcgctcgaaaattcaccggtctttttaccccgtcagtttcactggcagacacggtttgatcatcatacctatacgaaccgctacgccattgtggggggcggtcagtttgaccggttacgggccgatatttccgatggcgttaacgaaaagggcttgtgtgcccagaagctgacgtttgctaacggggctcaattgagaagtcaacgacgcgccgacaaaacgcaactagccggttttgaattcgtgttatgggcgctaggccactgtgcgtccgttgccgatgtcattgcgcaattgccagacattgagttgatggatgatacccacagtgacgtgaaatatgggtatccggaactgcattttgcactgacggacccgaccggccgcattgtggtcattgaacccacgacgatgccgatgcgggtgattgaaaatccgctgggagttgtgacaaatagtccgaactttgacaagcagttggcccaattggatcagtatatggactttacgccggcgtttcggaccggccaggtgccattaaataccgctaaggtcacgacggggagtctctcgggcaaatcgattccaccgggatcatattcgccgggggcccgctttattcgggcagcctactttaaggaacgggctgatcagccccgtaatgaacaagaagcatttatcagcagttggcgattgttggatggcgtaaccgtgcccaagaataccgaccatcaagccacctactcggtttatcgcgcggcgacggtggcggaaagccgcagttactattttcaggcctatcaccaaacggccgtgaccaagttgaccctcgacgagcaactgtgtcaacaaacccatgcacaacggtttgtggcacgtgatgcaccacttgtctttaatttaaacgaaaacggagcacttagacgaccatgacaattcactggcagacaacccaaatcgttccagtaagcgccgatcaggttccactgagggacctattagaacggcactggctcctcccgcaccgcatcgtccactttctccgaatccgggaaaatgtctggttaaacggtcgctaccaaccgatgagtacccccgttcaggcgggggatcaggttgttttacgctttgtcggggatgagtttcgcaccgcgacatccaactatctcgttgatgacacccaaccggtgacggttctctttgaaaatgatgatcttttagttgttaataagccggcggggattaagacccatccaaaccggcaagatgagcggggcaccctgatgaactttgtggcggggtatttagcgcggcagaatgccgtccccttcatggtgcaccgcattgatcaacagacgagtggggcggtattgattgccaaaaatccaatcgtcgtgccgcttttggatcgcttgattagcagccggcagattcaccgccactatttagccattacggacggggtgttccccgaaccggcgggggtcatcacgttgcccatcggtcgtgatgagaccgaccgccgcaagcgacaaattgatggcgttcatgcgcagactgcccgaacccactatcaggtgttgggggcgtacggcacgcatagtctggtgaggttacaattggaaacgggacgcacacaccagattcgggttcatctagccgccatgcaggccccgatcgtgggcgatccattgtataacgagcgaccaaacgccaaaatgatgttacacggaacggccttgacggtcgtgttaccgtttacgggccaaaaaatcacggttaatgcgccaaatccgcgctattttgaagaaagtatagtaaaatggcacttgaaataattgaatcggtgtaagggggaaactaattgtcacttattgaaaagctctatggtccgttttttgacctgcacaactgggctgcggttattggctccggtcaggactggctggtgattttatcactggtgatgattgagtgtctgttgtcggtagacaacgcaattgtgttggcaacgcaaacgagagtgttaccaacgttgaaagaacaagaaaagtcactgttttatgggttgtggggcgcctatctgttccgctttttgatcatcggaattgggacctacctaattcatatctgggagatcaaggtaattggggcactgtacctgatgtacctcgtttaccgcttttttcatcacaagatgtttggccgaaagccggtcaaagtaccgaaggaaaagaagcatcgggtactccccttattttggtccgttgttgtgcaaattgaattaatggacatcatcttttcagtagattccgtcctcgcctccctcgcaatttcatcgaatccggtgattgtgctgattgggggcttgatcgggattttgtgtatgcgggggattgcagagattatcatgaacctcatgcgcaagattccagaattggaaccgatggcgtacgtgttgattgcggtcattgcgattaagctatttttgacgattccagcgatcgacattgaaattccgtcgggcctgttcggcgtctttattctggcaatgttttttgtgaccctcctcattcatgttatccgccgcaaggccaaaaaggagtaatacgaagatggcagtaacagcaacagcgaccaactttgatgaacaggtcgcccaagataaactcacgatcgtcgacttttgggcgccctggtgtgccccatgtaaaatgatggaacccgtcatcgatcagttagacgaacagttccgagatcgggtcacctttgtccggtttaacgttgatgatagccaggaaattgcggcacgttatcacgtattgagcgtgccgagtctagtcgtttttaacgatggagtggcgaaagaaaagcttaccggtctgtttagtcgtgacaagttggcacgctacgtggaacaaaaaattaaacaacttcaatagggatgatcgttgccggatgcgggcggcggtgatcttttttttaacgatctcattcgggtggcagacagtttttgagccaattttccataatgttcaggcaaaaaagtgcgccaatgacgatgaaacgtaatacactaggaataactaaaaaataagggagtgcgggtaatgcttgattatacgaaacaggaacagtggggaaacggctttggtcagcagcagtcaccagtgccgctgaatactgccacggcccaagcggccgtcgctaaccatctactagtgtggcaaaacgatatcgaaggggtcagcctgagcgataaagagattaactttcaaatgaacggccatggtcatgcggtactcgagcaacgaccgtatcagttccaacaacttcattttcacgcgcccgccgagcacgtgattgacgatgatcaggcagcgatggaatggcactttgtgttccaagacgtagctgggcagctggctgtcgttgcccgtgtggcccacattggcgcccctgatcccgtatttgaacagcttttaacgcagtttaagccccacgagacggtgcccctgaagcaactgctagatgtgcatgcggagctaccagctacggggccggtgttacgctatctcggttcactgacgaccccgccattgaccgagggcgtccggtggtacgtcgcgcaaacgccattaagcgtctctaaagaccaacttgcgcgctaccatcagctatttgaacaccccaacaatcggcacctgcaagcactcaatgggcgcccagtattgcaaacaaagctcaactaagaggaggatccgacaatgaaaattggatttattggcaccggtgtgatgggcactggcatcattaataacttattggcagccggtcatgaggtcactgtttataatcggacgcagtcacgggctcaaaccgtgattgatcatggggcccactgggcggcatcacccgtcgcagcggccaccggtcagcaacttgtttttacgatggtgggatacccacaagatgtcgaggccgtttatttcggacagcaggggatttttcagcaggccacaccagaccaagtactgatcgatatgacgactagtacgccctcattggcacagcgaattggtcacttcgccgataagcagggattgcatgttctcgacgcaccggtgtcgggtggtgatgtcggcgcaaaaaatgcgacgctaacgatcatggttggtgggcaccgcgacacgtatgagcaggtcgtcccggtctttgaacagatcgggcagcgccataactattttggcggatacggggccggacaacatgcgaagatggcaaatcagattatgattgccggcacgatgactggtttgacggagatgctggtgtacgctaaggctgccaagctggacctgccaacggtcttggaaacgttaagttcgggtggcgcagataattggagcatggataactacgtgccgcgaattttaaaagacgactacactcccggcttttttgcgaagcattttctgaaagatttgagaattgcaatcgatgaagcggaaaagatggaattgaatttaccagccacacaacaagctaaacggctgtatgaacagttggttgatgaacgccaactgggcaatgacggtacacaggctttggtgaaattgtggtgggattagtaagttaaacaaaaaatggcacgactcacatgattttgattgtgagtcgtgccactttttaaattgaacaatgtttttcactaagcttcaaagtattcgtataatttttcagccgttaattgttgcttttcttcacccttgaagtcggccttaatctggccgtcaccaagaacgatcaaccggttaccatagatcaatgcgtcttccaaatgatgggtaatcatcaaggcggttagcccgtcttcggtaatccgttcgttggtcgcattgagcaggttttgactggttcgggggtctagcgccgcagtatgctcatcaagaagaatgatgtcgggacgtttgagcgtggccatcagaaagctcagtgcttggcgttgaccaccggataggttgccggtagcggtattcatccggtcttccaaaccgttatgcataatccccgcaatacgggtgaaatctgtcatttgctgtttcagtttccggggaatgaggtggcgcttttcgccccgtttttgtgccagcaacatgttttcagcgaccgtcatacgaggagcggttcccagcttaggatcttggaaaacacgactcaagaacttggtgcgttcctcttcggtttggtgggtaatatcgttgccatgaagtaaaatgtggccgtcatcaaccggtaaattacccccgatgacgttgaagagggtggatttaccagccccgttggagcccacaatcgtgataaagtcgccttcattgatggtcaagttgagctttttcagaatttcagtttcgttactggtgcctttgttgaccagtgtgacgatgtcttttaattcgagaattggtttagtcatgggctttaacccccttggtaaagatccgatcgagatgtagggcgtgacggaactgcggtagcatcatgcagattgcgagaactagtgatgaaaggaggttcaggtcgttggcgctgaatccgagttgcaaaacagccatcaagatcaaccggtaaataatactccccatggtcactgccagtaggcgttggttcagggtgagttcaccgaaggccacttcaccaatgatgatcgaagccagggcgatcacgatggtcccaatccccatgttaatatcggcgtacccattactttgcgatactagggcgccacagatccccaccatgccgttagaaaccatcaggcccataatcttcatgttgtcggtatgaatccctagcgacttagccatcttctcgttatcgccggtcgcaataaaggcttgaccgagatcggtttgtaagaagaagacgaggatgatggtaataatggcgatcactaacatccccaaaaagaccgtgtcaaagtagttaggcatcgcagccaaaaacttggctttgagaagggttgagtgccctaacagcgatgtgttggacttacccatgatccgcaggttaacggagtaggcggccgtcatgactaagattccggccagcaggatgtcaatcttacccttggtgtacagcaggcccgtgaccagccctgcggccatcccagccagacaggcgaagatggtggccgtcagtggtgagtaaccatggacgatggcggtaacggcgacggcggcccccattgggaaggttccttcaaccgtcatgtcggcaatgtttaaaattctaaaggtcaggaatagtcctagtccgaggatcgcccagagtaggccttgaccgattgcagaaacaactaaactcattatttgtagacctccccatgttgttcggcgtccttcaagaagcgggcgggaacgtgtaatccgagtttcttggcttgcttgagattcaaagttggatctccgttcttaatgtacttgattggtgtcgtggcggtctttttcttaccctttaagatttgaccggctaggcgaccaccttccacaccgagcttgtattggttaatactgtaggtggccaccccaccatccttcaccatcgtatcgacggcggggaagactggcttgttggcggcgttggcgttggcaatcagcgtttgcatcgcaccggcgatcgtattgtcggttggaatgaagatggcgtcaacttgggtgagggcttcttgggaaacctgattcaaatcgttactgttagaaatggagtacgatttcaagttaacgtgttcttccttacacagcttgacgaaaagggcgtgttccgttgttgcagaactgtcgctagatgtgtaaatgattccgagggtcttcatgtgaggcatgaattccttgatcagtttcaattgcttcttgagtggtgcctgatcggaaacaccggtgatattgccgccgggcttcttgttgttcttaacgagtcctgcaccgtggggatcggtaaccgctcctaaaacgatgggaatcttcgatgtggcattggccaatgcttgtgaagcgggggtcgtaatcccgacgagaacatcgttgttttcgttcacgagtttagaagccatggccttcaagttactttgatcaccctgagcattttggtaatcaattttgacgttttttcctttatagccttctttagctagtccggcgaccacgcctttatgaatctgatcgagggcggggtgatgcatcaaggtcaaaatcccaaccgtgggtgttttttgcttagtgatgccgccgccttcttgaaagtacgcgaatccgagaaaaactaatagaatcgcgatcaatgtgtacatgcgtttcatttgtattccacctcgtcaaataattgctgaaacaaaaaaataaggagccccacacgaggctccttttatccaaagaaaaagcctgcatgagagaatccatgcagactatggaaagttaaacaagtcagcacagatacaatctgaaaagttcaggttgcacctgcgatgagcacacaacctgattaccgactttgccaccaaatattcagttgttgtgttggataactcatctgaccattctcctaacgtcgtcttaatgtgttcaagtatagataagaggagaaaacttgtcaacgcgtatttgaaaaaaggttcattgaaaaaacatggtttgttcttatataataatatttgtacaaaataatttataataacgacaaagtggagaatagcgcgattatgagccactaattttcttaaaatcattaatattaaaatatttatattaaattttgaaagttgtgataaccgttgatataccagcgataaaccgtcattttttgataaaccgaaaatgaagtgaattgtaatgtgatggtttaacggtatgatgagaataaattgaaacgggggaatttacagtgggatataatttttcagcaggaccaggaatcatgccagcacaggttgttgaacaaattaagcgtgatatgccatcttatcaaggaagcggtatgagcattatggagattagccaccgttccgcgctatacacggatatggccgccgaagcgcagcaggacttgagggacctgatgcacattagcgacgactacgccgtgttatttctgcatgggggtggcacgctacaattcacgaatgtgccccttaacttggcgcaacagcaccatcacgtggcctacttaaattccggacactgggcccaaaaagcgctcgaggcggcccaacggattgaaggcctccaagttgacgatgttccgtcacttgatggcaatctacccaccattcaggacccgcagcgcggggcgttggattacctgcacatcacgacgaacaataccattgaggggacgacataccaccacattccaacgatcgaccaaccgttggtggcggatatgtcatctaatattttggctcaaccttacgatattaatcagtttgacctcgtctacgccggcgcccagaagaatatcggcccggccggcatggcgattgtgattgtgaaacgtgaacggctaactgaccaaccaatcttgtcggaaattatggattaccgtctggaggataagaaggattcggcgctgaatactccgcccgtcttctgtacttacgctgcaggcttaacgtttaagtggctgaagcagtttggaggcgttgatgccatttatcagcgtaaccaggaacaggccaagatgctctatgactttatcgataactcgaagctcttcaataatccggtacttcccgcccaacggtcactgaccaacatcgtctttgtgacgggggatgcgcaattagatgcacaattcatcgcggctgcccgggctcaagggctcgttaatcttgcgggacatcgattagtgggtggcatgcgggccagcctgtacaatgcgatgccgacggccggagtgacagcactgattaacgttatgaaagattttgaagttcaacacggaggacaattctaatgtatgcaattaaaacctataatgtgatttcaaacgtcggtttggcggtttttcccaaggatcagtatgtgattaatggcgaacaagaaccagatgcccttttgatccggagccagaacctccatcggggcgtcttgccggtgagcctgctggcaatcggtcgcgcgggggcgggggtcaataacatccccctcgataaggcaagtgaaaacggggtggtggtctttaacgcccccggggctaacgccaatgcggtcaaggaactggtgattgccatcttgatcatggcggcccggccaattttaccggcgattaattggaccaagtcactcaccaatggcgacgccgcggacgtcacgctacaggccgaagccgggaagaaccactatcgcggtaccgaactggctggcaaaaccctcggcgtgatcggactaggagcggtcggatcgaaggtcgctgatatggcgcaccaaatggggatgaacgtgattgggtacgatccctatatttcggttgagcacgcttggcaggtgcaaagcgacattccacgggccgattcactcaaggaagtgcttgaagccagcgactacgtcacgattcacattccctataatgaacgaaataagaatctgatcggcgctgaagaactattaatgatgaaaaaaggggccgtcctactcaactattcgcgcaacggcatcgtagaagaaacggctgtgatggccgccctcaacgtgggtcaactcgatcaatattggacggacttcgcgtcggatgcgctcattaaacacgataaggtcgtggtgacaccccatcttggtggtaccactaaagaagccgaagataactgtgcccaaatggtggccacgacgctacggaagtacttagagacaggggagattgaacattcggtcaactacccagacgtgcggatgccgtttaattcaccgtatcgtctgaccctcctgcaccaaaacgtgcctaacatggttggacgcgtggcgacgatcttggcggatctcaacattaacattgccaacatgattaacgcgtcccgaggcgatttcgcctacaccttgattgacgttgatcaaatggatgatgagctctaccataagtttgaagaaaagtgcctgtcaattgatgagatgattcgggtacggggcattcgtaacgccaagtttaatgaatgaggaatgaatcgttaaattaaaaaaagatgagaaattgtgttgacactgtgcaagaaattttgtatactaatgtcaacaatttgatgaacggcgcgtgaatgagtcgttggattagctgtgagcgaacttttcaggaagcatcggtaatgagaagatgcaagctccttgcagtgaaagaacggttttggcgcagatccttttcgagggatcatgggcagacacccaatataatgtcagggtattggttttcagtacctggtgagatggtatatgtgagtatgccataaacaaaggtggtaacacgcgagagcgtccttgttgtaaacattcgtttacagtggggacgctcttttttcgttcatcaaaccacatagtgccacatagaacaatcgattactcacaacacatatttgctacatatacacatagaacacgctggtcaaaacacataatccctagtgaaaggatggtagcaaaccatatgacacatactaatgagagaaccacaaacgttaattggccgcatttatcggtcttatactaaaaattaaaatcacattaaattcggtgggtggactattacgatagtgcactcttttttcgtggctaaaaacgcagatatcaattgaaatgtaaccgatttcacaatataatagatgctagatgacttgttgctgatggatgatcgaaaggcagggattgtatggctgaagaacgaattttgatcttagtaaaaccggacggcgtagcccacggacacattggggaaattgtgacccgtcttgagaaaaaagcgtaccacgttgatgcccttaaaattgtgatggcgaccaaggatcagctggcgcggcactattcacagcttgttaaaaagccgttttatcatgaaattgaagactacatgcaagaggggccgatcgtcgcgatggtcgccagcgggacgaatattattgatgtgttccaccggatggcaggggcgactaatccatcggacgccgctttcggcacgattcgcgctgattttggtcgtgaatggcccgatggcattttgagaaacgtcgtgcacagttcggacagcgttgcttcagcagaaaatgaaattcaaatctggttccctgagttggctgatgagacggcatagctggccgcatcgggcggtgaggaggaaccagcgatgaccatctttaccgagtttcaattgacaggtgacctgcaaaatcaggcaccgatggaaaagtatatgagacaccagtttccgtttgccggtgtgcggacgcccgaacgaaaacaacaggcggcccggttgattcggcaaagcaagcaggtgcccctccctgagctgcttgcgggaattgatgtcctgtaccggcgaccagagcgcgaataccagtacgtcgcgatcgatgtgagcgtcgccaatgttcgacgattgtcactgaccgagctcacgcagctgacgcagtatgtcacgcaaaccgcgtggtgggatagtgtggattcgtggcggaagttgtatggcgagtatgttcgatacgttcccgaggacaagctgacggtgtttgcgctattttatcagcagcctaatctgtggatgaggcgaatatcgatactcttgcaattattagaaaagcaaacactgaatcggcagctacttacccaagcgatcgagttcgatgccctcaccgatgaattctttatccaaaaagcgattgggtgggcgctccgtgattttagcaagtatgatgcggactgggttcgtacttttatggatgaacacgcgttgagtgcgttggccgttcgtgaggggagtaaatatttatagtcagtaaaaaagcacgccattgatgagcaaatcaatggcgtgctttatttgaaagttaaccgattaccggctggcagcgagagcgtgtagcgacgcgtcgaccttttcggcacacatccggccttcgtgaatcccccagatgaccaaactaggcccgcggcggcaatcgccagccacgaagagttggccgtcattagtggtgtaatctctatgcttgtcggtgacaccgaattcatcgaagagccattgttcggcgccggtgaagcccatggccagcaaaacgaggtctgctttgatgcgcttttgggtgccgtcgatgggttggaagtgtgagacttcactgacttcgacttgggcaacgtgcccgttctgaccaaagaaaccggtcgccgttgcggtgtaacgggtgatatccccaaacaggctgcgggcttcctgttgcccgtaaccgtttttgagcaccatcggccattccggccattggttctccgccgtccgctccttgggcagggcgggggtgatttcaagctgggtaatccccgcacagccctggcgaatcgccgttccgatacagtcgttacccgtatcgccaccacccagaacgaggacgtgtttgccggctaacttggttgttgcggccgttccgtcctctaacacggactgggtagctaatttcaggtagtcggcagcttgataaataccatctaagtcacgtcctggaacggtgagatcgcgcgcctgccgagctccggtacagatgacgattcgatcgaaatcttggcgcagctgagcagcagagatgtctttaccgacctcggtattggcaactagctcaataccaactttccggagtgcgtcaaagcggcgtgcaacgatctctttagggagtttcatgttcggaatgccgtacatgagaaacccaccaaaccgatcgtcgcgttcaaagatggtgaccgaatgccccagttggttgagacgccaagcggccgaaataccagcggggccactaccaatcacggcgattttcttacctgttcggtgggccggtttgccagaatcaacgacccaaccatttttgaaggcttgttcgataataaatttttcattattgcgaattgtgacaccggggccgttaagggcgttgacgcaggaaacctcacagggggccggacaaacccggccggtcatatctggtaggtagttcgtgcgtgttagccgttcgaacgcccgcttatcctgatttttgtagaccaggtcgttccattcggggatcaggttatcatttggacacccactgacggccttgccatccccgtaaaagacgccgtgatgacagaatggaatcccgcagttcatacaacgagcagcctgttgccgacgatcctcatcgtttaagtccagttccatcacgtcaaagtctttgatccgtttcattaccggacgcatcgggttgtttttccgattatagagtaaaaagcctctcggatttcccattgatgattcctcctaactttggctgctggttgcggcgtagaaagctttttctacgacttgatccttgggaatcccagcatctgaatattgtttaattagatcgtgcatcttgtggtagtcacgcggatagaccttgatgaaagtttgcttttcgtcttcccagtgatccaagatctttttcgcggtgactgaatttgtgaagtagtagtgcttttggagcatgtcttttagaacatgactgtcatcgccggtttcgtcgagatggtacagatcaacgagttcgggattgcattgttgttcaaagtcgtgcttccaatcgtagatgtaggcgacaccacctgacatccccgccgcaaagttccgaccggtccgtccaaggatcacggcgacacccccggtcatgtattcacagccgttgttgccaacgccttcgacgaccaccttggcaccggaattacgaacgcagaatcgttcaccggcccgaccgttgaagtaggcttcaccagccgtggcaccaaagcaggcaacgttccccacaatcggcgcgtgggcgtacagcgtttgggcttgttcgggggcggcgacgattaagcgaccgcccgagaggcctttaccaacgtaatcattggcttcaccagtgagcttgatttctagtccctgggtaatgaaggcgccaaaactttgaccagcagtcccgtggtagttgaacttcaacgatcccggtttgagaccgtcgttaccaaagtgggcagcgatccagccgcctaaacgggcaccggctgaacggtcagtgttgttgatcggcaggtcgacggttgtggcgttgccgttttccagacttgttttggcaaagaggtccaaatctggccagtcgtacttggccttgaagggatccttgacctttcgatcgatggtgatggttttgccaatcatccggtcgtaatttaaggtcttggccttgccagctggaacgtagcggggggtcagatgttcgccgtggccgaccatttcatcaatggtacggtacccgagttgcgccatctgttcccgtaaatcctgtgccaaaaagcgcatcatgttcatgacgtgttcgggtttgccggcgtagagtttccgaaggtctgggttttgggttgtgatcccgatgggacaagtgtttaagttacatttgcgcatcatgacgcacccaattgaaaccatggtgagcgtggcaaaactgaattcttccgcgccgagcatgacggccacggcgatgtcacggccggtcattaacttaccgtcgacttcaagggtggtccgttgccggaggtgattgagggccaatgtctggtgggcatcggcgagtcccatttcccacggtaggccactatcgcgggttgagttacgtggtgccgccccggtcccaccatcgtagcctgcaatgaccacggtgttggcgcccgccttgacaactcccgcggcaatggtgccgacgccggtcgaagaaactagtttgacgttgatcttggcgtaggggtttacctgcttgaggtcgtaaatcagttgggcaaggtcttcaatggaatagatatcatggtgcggaggtggcgaaatcaattgcaccccagcgatcgaaccccgaatatcagcgacccaagggtaagccttaccggctggcagttgaccaccttcacccggcttggcgccttgtgccatcttgatttgcagttcttcggcgttcatgaggtattcggtattgaccccaaaccgggcggttgaaacctgcttgattttactgtgccgatcgaggccgtccggaccaaccttgaaacgccggcgatcttcgcccccttcaccagtgttactacgggcgccaagcttgttcatggcgatagcgatggtttcatgggcttcttgtgacagggaaccaaaactcatggcgccggtcttgaagcgtttcacgattgaactgacgggttcgacttcactgattggcaccggcttacgatcggtggtatcaatatgccacatggaacgaagggtgactggatcggtcagcatgtcggtattcatctggtcggcgtacttttggtactcttcgtagctaccagagcgcacggccttttggaattgataaatggatttgggattgtacaggtggtgttcaccatcgaccttatactggtagctgccaccggaagggagatcatcgattgcatgagcgtcgtaggcgtcttggtagtgccggtagtactcggcttcaatttggttcagatcgatgcccccaatccgactcggagtgcccgtgaagtactgggcgatgacatcatctgccagaccaatcgcttcaaatagctgcgccccttgatagccggcgacggtcgaaattcccatccggctcatgatcttaacaatgcccttaacggccgcatgacagtagttatcgagctgttgtgcgtaaccccgttctaccaaggtcgcaaaggctccgtaaggatgaatagctgcggccccgtaaccaacaaggcaggcaaaatggtgaatttcggtcgcttcagcagtatcaacaacgagggaggcggcggtactcttgccttgacgaaccaggtagttatgtaacccggcaacggccagcagcaccggaatggtcatttggtgatcaccaaccggccgatcggtgagaatcaagatggccgccccatcgtcaatcgcgttttcggcctgtttgaagagggcttccagcgcatgcgccagccggttgggaatgtcatccagcgtgtaggcgagtgacagtgttgcaacttttaaggtcggcaggtcgatactattgagtttggcgtagtcttggttatttaaaataggagactcaatttttagcttttgacagttgtccgcaatatcttgggtgatatcaccatcacgcccgaggaagagggtggtatcaatgaccaccttttcacggagtggatcgatggggggattggtcacctgcgcaaatgactgcttaaaataggtaaacagaagttcagatttacgactcaacacggcgagtggggaatcaaagcccatggcgaccacgggttctcccccgttttgggccattggaatcaaggcggtttcaatcacttcatgggtataaccgttacgccgccaaagctgttgcaaagcggcgtcgctgattttagcctcggctttgacttctggcaggttgctcagcgtcaagcggttagcagtcaaccactgctcatagggatgtgcggtggcaaactcgcgctttaactgatcagacttgtagattgtttttttactggtatccaccagaatcatttctgcgggagaaagaatgcctttttccttaatgtcggtgggctcgatatccacaatgccggattctgaaccaaccaccaaaacgttatccttggtcagggtgtagcgggatggccgtagcccattacgatcaaggaaggcgccgacttgaatcccatcggtgaaacatagggcggcaggaccgtcccaaggggccatgaaggtcgcattgtattcatcaaaggcccgttgctgttttggcatcttggcgtcgggaccccaggcttctgggatcatcatcatgagggcttgaggaatggatctaccgtgtcggtaaaggtattccatacagttttcgagtttggctgaatcggaatcatcctcatcgtaaacttcaatgccgtgactgataagccagttttcggcgcccttcagcgtgttaatttcaccgttgtgggcgagaaagcggaatggttgggcgcgttcccaactcggaaatgtgttagtggagaagcgggagtgaatcaggcaaatcgcgctttgcatgctttcgtcgtgtaaatcggggtaaaagagcccgacttggtaggcgtgcagcatccccttgtagacgattgtgcgacttgagagggaacagatggccaatgattgatgaccaaatgttttctcaagttgacgccgtaaccggtacaggtgatcctcaaatggccggcccgcggcaacgtcaacgggccgctgaataatgacctgaatgaatccaggcatcgatttttgggcagcagggccacaactttcgtagacaaatggcacgctccgggtcaagagcaccggaaaaccagcgtcacgcatttgttgctgaacggaagcgagcattgcggcttgttcctgttcatcgtgcggtaaaaagagttgggccacggcgtagtcgccaaatggtggcaacgttagttgagcctgtttcatttgattacggaaaaattgatcaggcatcgccatcaaaattccggcaccgtcaccagtgtctggttcggccccagtaccaccacggtgattcattcgttgcaacattgttaaagctttttccacgagttcatgactcggacgtccgtcgacttgggtaatgaagcccatcccgcacgcatcgcgttcaaactctggggaatacattaattttcctgtgggcatcggactgctcatttaaccacctacctattaaacatgagttaaaaattaaaatatggacttaatttctaatgttattctaatgaacgtggttcagcaatgtaaaaacaactaaaataaattctgcttttagttaaaatcactaaagaaaaagccaatttagccggtaaattcgataaatagcgcaatttgtgaataatattccaaaaatagatgatagatggttttaattttgttgtaatgaatcatataaaatactagtcaaaaatcccgcaaaatgcttgaataatcttgcaaaaatgtggaggatgtggttataatttaattcaattttaataaaaatgatcactttgaaaatgaggatcattagtcgtagcaaaccggccaactgcccgtggtactggcggttctacgatgtgatcgggaggtgtttggctcagcgtagtgatgtgatcaaccggttgattgactattacctgtcgttattcacgtacttttcgtaagcaatttattgggaagattaggcgaatgtcggttgtaaccgtgatatgataatagtaatttgaagcacgatcagcaccaagtacataattttaaatttgaaaggggtttgtcagatatggcaactttaaaagtgacagatcttcacgtcagtgtttctgatgatgaagaaaaaacacaacgagagattttaaaaggggttaacttaacgttaaacaccggtgaaacgcacgcgatcatgggacctaacggaaccgggaaatcgacgttgtctgagaccatcatgggcaacccaaactatattgtgacacagggggatgtcaccctcgatggcgaaagtatcttgggtaagcccgtcgatgagcgtgctcgcgcggggttgttccttgccatgcaatatcctgctgaaattaaggggattacgaacgccgaatttatgcgtgcggcgattaatgcgcgccgtcccgaagatgaccccatttctattcgggccttcttgaaggaactggataaaaatatcggggtccttaacatgtcagatgaaatgacagaacggtacctgaacgaaggcttttccggtggtgagaagaaacgtaacgaaattttacaactgatgatgatcaagccgaagtttgccatccttgacgaaattgattccggccttgatattgacgccctccaagtggttgccaaaggcgttaacgagatggctagtccggactttggtacgttgatgattacccactaccaacggctgttaaactacatccatccggatcaagtccacgtgatgatggacggcaggatcgtgaagaccggcgacttctcactggcccaagaactggaagccaagggttacgcagggttacgcgatgaactcggattagatgttaacctcgtcgatgatgacgtgccaacaggaaacggggatgaatagaatgcctaaatcagcaacattggaactcaatccggcactgctcgaagctgccaagttcgaccaagaaccacaatggtttgctgacctgcgccaagcggcttgggaccaggcaccaggccttgcacttcctgactttgccaagattaattaccgtcactggcccctactcgactttgccgctagcgggaccgcaaacgagactgttcccgccgaaattgcggcccagcaagacgagtacaactttgtcagtgtgggtaacgcgacggtgaaattgactttgcccgcaggtttagccgctcagggcgtcgtgttttgcgatctggccacggcggttaaagaacatggtgacctcttgcaacagtatttgttaaccaaggccattaaggccgatgaagatcgtttaaccgcggtcaatgctgcattgatgacgaccggtttcttcctttatgtgccggccaacgtcacgattaaagccccgatcagtattttgcaggtgcaagatagtcgtcaggccagcaattttgtgagccattccgtgattgtcgggggcgacaatagtaacttccaagtactccaacgggtgacgacggtgggcgaggaaaagaatccagcaagccttgctgtcgaagtgattacgcttcccggcagccacgtgaagttctcttccctagattcattaggagaacaaacgcatgcctatttcaaccgtcgtggtcatttggaacgcgattcagagattgactggacgatgggtgtcttaaatgatggcaatacgattgccgattttgattccgacctcaaaggcgccggatcacacgcggaagtacagacggttgccatttcgacgggcaagcaaacccaaggaatcgacacaagtgtgactaactatggtaaacattcggaaggcaacatcttacaacgtggggtgctccttgaaaagtcggcgctggtctttaacggggttggtaaaattattcacggtgcacacggtgcgcaggcccaacaggaaaaccggattttgatgttgtcgccggaagctcgtggagacgccaatccgattttgttgattgacgaaaacgatgtgattgccggtcatgcagccagtgtaggtcgggttgatcaagggcagatgtactacttgatgagtcgggggctgaccaaagaagtcgcacaacgtttagttattttaggatttttaggggttgtattgtcagaaattccagttgctagcgtccgagatcagatgatagcaatgatcgaaaggaagctaatcaatggacaacgggctgaataattcacgcaaagattttccgattttagatcaaacggttaatgatgaaccgttagtttacttagataacgcggcgacgactcaaaagccaaaccaggttttacaagaaattatgcgctattaccaaaacgataacgctaacgtgcaccgcggtgtgcacacgcttgccgaacgagccacgaccagctatgaagccgcgcgtgataaggtggccgcctttattaacgcgccgagtcgtaagtgtgtcgtatacacgcgatcgacgacggaaggcctcaactgggtcgctagtagcttcggtaatttagttgttaacgagggcgacgaaattgtgatttcagaattagaacatcacagtaatattgtcccttggcaacaggtggccgccaaacaacacgcgaccttgaagtacattccgttaaccgctgatggggagctggatatggtcagtgcccgccagctaattacgaatcagacgaagattgtgtcgattgcgcaggccgctaacgtgatgggcgtggtgaatccgatcaaggaactcgcccagctcgcccatcaacatggggcgtacatgattgctgacggggcgcaagccgctccccatatgcgggtcgacgtgcaggacttagatgtggacttctacgccttttccggccacaagatgttggcaccaacggggattggcgcgctatatggcaaggaagatctgcttgaaaaaatgcctcccgcccagttcggtggtgaaatgatcgactttgtgcaccatcaaagtgcatcatggaaagaactaccgtggaagtttgaagccggcacgcccaatattagtggcgccattgcgttaggcagcgccatcgactacttgaatcagctcgggatggctaacattgaggcgtacgagcaagaccttgtggattacacgttaccaaagttattagagatcgaggggctcaccgtttatgggccgcatgatccggctaagcacactggtgtgatggcctttaacttggataacctgcacccccatgatgtggcgaccgggttagacatggaaggaattgcggttcgggccggccaccattgtgcccaaccgttgatggaatatttggatgtcagtgccactgcccgcgccagtttttatttctataacacgaaggcagaagcggatcggttagtgaacgcaatcgaagcagtaaaggagttctttaatcatgggactgtctagtttaaatcatttgtaccgcgaagtggtcttagatcattcgcaacatccgcgtcatcacggcgcactacccgccgccacggatcacttggaattacgtaatcccacctgtggggatgtgattgatgtgcaggcgcaaatcaaggacggggtcattaccgacctggcctttgatggtagcgggtgtacgatttcacaggcgtcagctagtatgatgacgaccgttttgatcgggcaaccggtagaccatgcgcgggagttaattttaaatttttccaacctgattacgggaaaagaaattgatgcaaaaatggaagacgagttggaagatgccgcggtcattggttccgtggctgaatttccgacgcggatcaagtgtgcggcactcgcctggcacgccttagatgaactactggataagaagggagctgctgctaaggatgactgatgtaagagacatcgttaaagatacagactacgagtacgggtttcatgacgatattgattacgcctacaagacggggaagggcattagtgagcgaattgttcgtgaaatctcagctgaaaaagatgaaccgcagtggatgcttgactaccgtttagcggcttatcatgcttatttaaaaatgccagaaccagcttggggacctgatttatcgggactcgaccttgaaaatatgacgttttatcaaaaagccacggataagcagtaccgcgactgggatgacgttcccgaaaaaattaagacaacctttgataagttaggggtgccccaagccgaacggaagtatttggcgggatcttctgcccagtacgaatccgaagtggtctatcaccggatggcagaatcgtttgaaaagctgggaatcgtctttacggatacggatactgccttaaaggaatacccagagttgttcaaaaaatggtttggcaagctcgttaaaccaacgaacaacaagtatgcggccctcaactccgccgtgtggtctggtggcacgttcatctatgtgccaaagggcgtcacggtgacgaccccgattcaatcgtatttccggatcaatgccgagaagtcgggacagtttgaacggacgttgatcatcgtggatgaaggcgcgcacgtcgaatacgtcgaagggtgtacggctcccacttacacgagtgatagtttgcacgcggcggttgttgaagtgaacgtactaccgaacgcctactgtcggtacacaacgattcaaaactggtcgaataacatctatagtttggaaaccaagcggtcccaagcaatggaaaatgccgtaatggaatgggtcgatggtaacctgggatcgaaggttacgatgaagtacccttccgtttacctgaatggtgagggggcgcggggaacgatgctctcaatcgccgtggcgggtaaaaacatcgattcagatactggtgcccaaatgattcataacgcaccgaacacctcgtcatcggttgtgtctaaatcgatcgccaaggacggcggggctgtcgattatcgggggaaaatcaagttcagcaagcattcggatgggtcgttcgcgcatgtggaatgtgatacaatcatcatggatgacaagtcctcaagtgatacgattccgtttaatgaaattttgaataacaatgtttcgatggaacacgaagctaaggtgtcaaaaatttccgaagagcagctctattacctgatgagtcggggtatttcagaagccaaggcgacggaaatgatcattatgagctttgtggaaccctttacgaaggaactaccgatggaatacgcggttgaattgaaccggctaattagttttgaaatggaaggctcaattggctaagcaccgattaaaatgatgatcaaaaacgcgttaagcaacctaaggaggacgtcaaatgagtacatcagctgactttaaagaacgcgcactggctgcgcttgaaaacgtaattgacccagaactgggaattgatattgtgaatctcggtttaatctataacgtcgaactggacgacgaaggtacgtgtaaggtgaccatgaccctcacgattgcagggtgcccactgaccgactacttaaacgacgccatcacggaagagatttctggttttgacgaggttaaaaacgtcgacatcaaccttgtttgggaaccggcatggtcgattgaaaagatgtcgcgggaagcacgaatggaattaggtattcattaagcagatacctagttagacgttaaatgatcctcactgcagagttaatctggggtgaggatcattttttatgagtaatcagtggcggttgaccgcattactgataacgattttctcatttttagattaatatcaggatgtgttaattgttgacataccggtggtaaagaatggataaaactggtgatgaaaataaaattaaataaaaatgagaaaatgtcttgcattctctaattatgagcggtatattatgagtatcaaatttgaaggaggttacgaccatgaaacaggtagaaattaacagcaaacaaattattgcgaccgcggccgtaaccgcaaaacttcaagccttattattatgatgctggactctgacaattaatgtcgagtcctatttgcgttatgaaatggggcttgaccagcaccccatttcaatggggtgcttttttatttgctaaacagggattaaggataaggaaaggtgattcatatgactaaacaaattcaattttttgatacaacattgcgtgacggagaacaaaccattggggtgaacttcagtattgaagaaaaggtagaaatcgctaagcagcttgaagcttggggcgttgattgtattgaagccggcttccccgtcgcctctgaaggagactttgaagcggtcagtgccgtcgctgcagccgtgaagcacacatgcgtcactgggctggctcgcgcacgcaaaggtgatatcgacgcatgtgttaaagcaactgcgcaagccgctcataaacagatccatgtctttatcgccacgagtcctgttcatcgtgaatcaaagctacatatgacaaaggaacaggtccttgaatccattaccgattcagttacatatgcccatcaattcttcgacattgttgaattttcacccgaagatgcgacgagaaccgaacatgattatctctgtaccgcaatccaaacggcgattgatgccggggcttccgtgatcaacattcctgatacggtgggctacaccaatcctgctgaattcgcagaactcttccaatacatgcaaaagcacattccatcatttgatgacgtcacgttctcagttcactgccacgatgacttggggatggccgttgcgaacagccttgcttccattgaaaatggcgctactcgaattgagggaacgatcaacggaattggcgaacgtgccggtaacgccgccttggaagaagttgccgctgccctctacgtccggaaagattattacaacgcggaagataatattgatttgaaggaaaccaagatgacgagtgacatgattagcaactatgcgaacatgcccgttccccggaacaaagccgtggtcggcgcgaacgcctttgcacatgaatctggcattcaccaagacgggatgttgaagaacccaaacacctacgaaattttgacacctgaaacggtgggggccaataagacaacgttgcccctcggcaagctttccggttcccatgcggtgatggccaagcttcacgcaatgggcttcaaggttgatcgtgaagaaatgaaggaaattttcccaatctttaaggataaagcggatcatacttcaatcgtgtccgaagatgatcttcgtgaaattatgaaacaaatcaaaaaggtggtcgcatagtatgcaagaaaacaaaacagctcaaattgccgttctcgccggtgattacattggtcccgaaattatggcagccggactaaaggtcctgcaagccgtcagcgaagaggggcgctttgaatacaaaattcatgaagagccctttggaggggcggcaatcgatcaagcgggtgatccgttaccacaacaaacgcttgaaacgtgccaacaaagcgatgccattttactggccgctattggggggccaaagtgggatcaggcaccgaaacgtcctgaggccgggctgttggaaattcggaaggcattaaacctatttgctaatattcgaccgaccgcgattagttccgcgatgcaacagtattcaccgattaaaaacgagaagcccgttgatttcgtcatcgtgcgggaactaacgagtggcatctactttgggacaccgcgtgaaaaacacgccgattacgcgcttgataccatgcggtataccaaagaagaggttcagcgaatcacccacattgcctttcaaatggcgcaaaagcggcgtcatcatgtcacactcgtcgacaaggccaacgtgctggcaaccagcaagttttggcgcgagattgtcggtgagattgcacgggactatccagatgtgacttacgataccagctacgtagacgcggcgtcgatgaagatcatttcagcgcccgatcagttcgatgtgattctaaccgaaaacctctttggggatattctcagtgatgaatctgccgaaatcacggggtccctcggaacgattccgtcgatgagccaaggcagtgatggcccggcactctatgaaccaattcatgggtccgcacccgatattgctggtaaagggattgccgatccgatctcgatggttaaatcggtggcgatgatgttagcgaacacgtttgatcgacaggatctcgcaaccgaaattaccgatgcgattaacgagacgatcagcaagcaaattgtgactcccgatcttggcggtcatgccaataccgacgaggtaacccaagcaattattaattcgattcaagaaagcaggcgtgcataatgcaacagacaatgtttgataaactttggaaccgacacgtgatttccggcaagcccggtgaaccacaattgatttacgtggatcttcacttacttcatgaggtgacgtcacctcaagcgtttgaagggttacgggaaaacaatcgtcaggttcggcgtccggataagacgttcgcgacaatggaccataacgtaccgacgattgatattttcaacgttcaggatgccatttcacgcaagcaaatcgaaacattggataagaacgccaaggaatttggggttcgtcttgcggggatggggcatgaagatcaggggatcattcacgtgattggcccgcaattagggttaacccaacccgggatggtagtcgtctgtggtgactctcacacggcgacccacggggcatttggttccattgcctttggtatcgggaccagcgaagtggaacacgttttagccacccagacaatctggcaaaccaaacccaagacaatgggcattcatgttcacggaaagttaccgcacggggtctacgccaaggacattatcatgggaattattgctcgtgaaggggtggcctttgggaccggttattcagctgaactttacggtgacacgattgaaaatatgagtatggaagaacgcatgacgttgtgtaacatgggcattgaagggggcgccaagatgatgaacatcgcgcccgatcagaccaccttcgattacgtggcgggacgcaaatacgcaccaaagaacatggctcaggcgattgaagattggcaacagttttacaccgatagccccgacgcgtttgataaggtgattgactttgacgttagtgaccttgctccatttgtatcttggggaacgaacccgggcatggcggtgcccgtggatcaagcctttccagccgttcagaatgcagatgatcagaaagcttatgattatgtgggcctgcaacctggacaaacggcgccggaaatcccaattcagtttattttctttggatcgtgtacgaacggtcgcctatcagatttgaagatcgccgctcatattttgaagggccagcacatcgcggatggggtgacagcactagtcgttcccggatcgcgggcggttaagaaagcggccgagaagatgggaatcgatcaaatcttcaaggatgccgggtgtgaatggcgtgaaccaggctgttcggcctgtctggggatgaaccccgatcaagtaccagccggcatgcactgtgcgtcgacttccaaccgtaactttgaaggccggcagggtgccggttctagaacgcatttggctagcccagcgatggttgcctatgccgcaattaacggccactttgttgatattagaaaggaagaagcctaatggaacctattacaactgtcacgagtaccaccatccctttgatgaaggaaaatattgatacggatcaaattattcctaagcagttcttgaaaaatattttgaaggtgggttacgggcgcaatctcttcttcgattggcgctacatcggccccaacaaaccaaatccagatttcattttgaacaagccagaacgtcaaggtgccgaaattttggtaacgggagacaactttggctgtggttcatcacgggaacacgcggtgtgggcactgaaggattttggtttcaaagtggtcattgccggtggctatagcgatattttctacatgaacagtacaaaaaacggggtcttggcgattatcttgccggaagatcaacgtcaaatcttggccgccattgcgcccgacgagaaaattacggtcgatctgccgaatcaggaggtccggtacgcggattacacgttcccatttgagattgaccccctgtggaaggacaagttcattaagggactggacgatatcgccattacaatggggtacgaagatcagattgaagcatacgaagctaagattccgagctataactagggcgttagcctaactcgttatcaacaggcaataacagacgcgtgaaacgggaatcacgcggatacatagtaaagagggtaactaaatatggaaatgcaaagtggtatagaactgcagagaagaattgatcgaacacacgaatcaccattgttttacaagatttttgccttggttgctggtggcatgtttttggacgccgccgacgtctacatggcgagtgccgtggccagcaccgttttaaaaaccggttggtcgaccctcgcccagaactcctactttctatccagtgggtttttaggcctctttatcggatcgctaacggccgggtttatcggggatctcaagggtcggcgggtcgcttaccaaatcaacttgcttttgtttggtggctttacgttcctcgccgcctttgcccccaacatgtggatgcttatcatttgtcgtttgttctcaagcatcggcttgggttcagaaattgtgaccggctattcaatggtcaatgaatttgcacccattcacagccggggtaagtggtgtgcggcagtgtcactaattgcgaattccggggcaccaattacgatgttgctctgtacgcttatcattccacactatggttggcgggtgatgtttgctggaatcgggattgtggccgccattttgtggtatctccggcgtgatattccagaatcaccacgttggctgatggcccacgggaaggaaacccaagcagagcagatcattgaacaactcgaagttaatggtagcgatgattttaccgataccaagacaacgaagcgggagacggttcatcactcaatcggaatcagtttgtttgtggccattgtggcggtttcggcaactattatttgtcagtataccttcacctcatgggtcccaaccttgttgctaaagcggggaattaatatttctggttcgctgggtctgtcaacgttgatgatgcttggagcgccagtcggttgtgccatcggggcctttctggttgaccgaattggccggaagaagacgatcgtgccagcctttctgttgaccgccgtttttggaatgttttatgctcgccaagataccatgactggcgtggtcatcattggctttctgttgactgcctgcttctatgtattgatggctgcggttgtcgcggtctatgtggcggaactattcccaacaacgttccggttccgtggttctggtattgccaacgggatcgctaaactgttcaccgttgccatgccgattgtggtggcttggatgctaaaggtgaccacgacgaacatgattttctggacgattagtgcaattgcgctctttgccggtattgtggtctggtcgttgggcgatgaaacgaaccaaaaggatattggttaaatcgaggcgtaaaatgacagaatggaacgcgacactttatgatcggcaacatgattttgtggccgaatacgggaagggcttgttaacgtttgtcccacagcagccaaagcaagcaattttggatctgggttgcggcacgggcacgttgacggcccaacttaattcattgggggatgatgtgaaggggacggaccgctcgccggcgatgatcgcacaggctcggcgttcgtatccgacgattcagtttgaagtggaagatggtctacaaatgatggatgttaaccggtggaatgtcatcttttccaacgccgttttccattggattcaagaccatccccgtttgttacgccgaatttatcaagcgttacggccggggggccaactcatttgtgagtttggtgcggccggtaatatcgcaacgatcgaaaatgggtttcgtgaggccattgcggcatatggcggcacgtatcaccccaaattcaactttgcgacggtcgcccagctgacccagcaggcgcaagctgccgggctcgttgttgaaaaatgctatgattttgagcggccgacaccgttaaaggctggtgaacaaggactagccaattgggcccgtcagttttttgccagtgaactagcatccttttcacccgtcgagcaagatgaaatcctagcacgtttagccacgcgggttcgggacgaattatgggacggtcatcagtgggtggccgattaccgccggattcggtgtgtggcgcataaagactaaaaaatgtcagaaccgtgagatatcggttctgacattttttttagtttaaggtaatacctgaacgccatcggtaacaatggcgagctgaacagtttgggcggttaacccgtgatcgatcagggcttgttggaacgcaggaaacgcctgatcatcgatgatggtcatgaccgttgggccggcaccacttaagtaggtcgcgagagcgccagtctggtgggcgatcgtccgaatttgttgtagctcaggaacgagtcgttgtcggtagggttcgtgaaactgatcggcttcgatgagcttaccgagggtcgcataatcctgcgtgaatagtgacgccacgaacgtgtttcccactgaactggcatggaccgcatcgtgaaaatcaagttgtgctggtaacaccccacggctgtcgctcgttttgagctcgtagtcgggaatgtaggcgacaaacgagagtcggggaaactgggccttgatggcgacaaattggtcatcaacgttggtcccaatgaccagatcgccgaagatagcgggagccacgttgtcgggatggccctcaatttggcaggcaaactcgaccttttgctggtcggttaagttcaggtgcccaagttggttggcaatttcaatgccggccacaatggcagccgaactactgccgaggccgcgagttacagggatttcagaaaccatcttaaacgcgtggggctgtaagtttggtgcgagctgtagcgcggtactcagaatcatattggtttcatcagtaggaacctcggcgcccagatcatggtcaatgaaccagtggtcggtcgcttcgagcacgtcaacggtcaggtacagggaaacggcaattccgatggaatcgaatcccggtcccaagttggcgctagttgcaggtacttttatctgcatatgaatgacttcctttacgagagaactttgtaagctgcaagaagattgatcgtgtccttttgttctagggcgtctttcaattctgccagctgggtttttgacatatcgtgagtgataattacgacccgtgcagtttggttatcggtgggattatcatttttggtctgaacgatttggctaaagctggccccgatcttagtcatgatctgggtgagcttcaacatttgacccggaatatccaacatttctaatgaaaggtagtaggggtacaccacttcgtcagccttcacatggtcggcttgattttgatagttgttaaacgagtttccggtggttcccaagacaatgtttttggtgacggagacgatatcgcttaagacactgttagcggttggtaggccaccagcaccggggccatagaagagggtctcgccaacggcttggccggtcaccatgacggcgttgttttcattgttaatcgttgcgaggggatggtcggctggaacgagaacggggccaacttcagcgaagacgccatcgttgatccgacgggcaatgcctaatagtttgatggtgtagcccaatgatgcggcggtttcaacatccagtagttgcatgtgccgaataccagagaccttcatttcgttgagttttaagtgggttccaaacgagaactggcttaaaataatcatcttgtaggcggcgtcgatcccgtcgacgtcattggtcggatcagattccgcaaagccgagttcctgggccttttgtaaggcgtcagcatagctccagtttttttgctgcatctgcgttaaaatgtagttagtggtcccgttgacgatcccctttacttcgagaatctgatcagcggagaagctgttgacgatggtccgtaagattggaatcccaccggccacgctggcttcgtacatcaaatcgcagtggttttgctgggcaatggacgttaattcttctcccgccgaggcgatcaaatccttattggcggttacgacgtgtttcttagcggtcagtagttgggtgataatttccttggcgggatgaatgccccccatgacctcgactacgatactgatttcgggatcgttgacgatgtcatccaggttgtcggtgaggttgatgcgactggtatcgacatcgtcacggtgtttcgccacgtttctgacgacaatcgttttgacactgagttgccgaccggtaatgtttgaaattttatcttggttattttcgaccatttgtaaaacaccgctgccgacggtgccgaggccgattaacccaattttaattgtttccatatttgagtccctcattttttccatcatttcctaccattttagcatagcaaaatacattacgcatagtttataatgagaatattatgaaaaacggagggtatctttctaatgaaatatcgaagtacacgaggcactgccgatcaggctattaattccgccgcggccattattcaaggattggcaccggatggcggcctatacgttcctgtgacatttccacaaccaacattttcgttggaccagttagttggactatcctatcaagaaacggccaagctcgttttaagctggtttttcgatgattacagtgatgaacaactacaagatagcgtgacggccgcttatggcagtcagtttgatgacgccaaaattgtgcccgtgacggctaaaacggcgggcaactactacatggaactgttccatggcccgacgttggccttcaaggatttagcattgcaagtcctaccacaattgatgacgcgggcggtgaagctccaaggcgttgatcacaatatcgtcattttaacggccacgtctggtgatacgggaaccgcctcgatgcgcggcttccaagacgttgatggcacccaagtgattgtcttttatccccacggtggcgtgagtccggtacaattgcgccaaatgctcacccagcaaggacagaatttaaaggtcgttgcggtggaaggaaactttgatcaggcccaagcaaacgtgaagaaaatctttggtgatcgtgaatttgggcagcaacttgtccaagctggtcatcagttttcgtcagccaattcaatgaatatcggccggttgattcctcagattgcgtactacttctatacgtatgcgcagatggtggcccaacaaaccatccagctcggcgatcagcttagctttacggtgcccactgggaactttggcgatattttagccggatactacgctaagaaactgggattgccaattaaaaagctgatctgtgcgtcgaaccagaacaacgtgctgacggacttctttaagactggcaagtacgatcgcaaccggcccttcttcctgacgaattcaccatcaatggatattttggtgtccagcaaccttgaacgcctactatttgatgccgctcatcaggatgaaacggtggtgcaggacctgatgcaacagctggcacagaccggcgcctaccaaatttcggatgacatgcgggcccaattagcggactttgcggccgggtttgcgagtgaagccgatattcaagccgaaattaagcgggtctacgaaacggatgggtacgccatcgatccgcatacggcggtcgcgtcagcagttgctcaccggtaccaagctgaagaagatgggaccaccccgatggttgttttatcaacggcgagcccatacaagttccccgaaacggtgttaaaggccattaccgagcaacccgttgaaccgggcttgaaggcagttaatcagttaaaccagttgttgcaagacacattaccggccggcgttcgcgatttatttgaacttaaggaacgggcagaagtcgtggttgagccggacgaaatgaaacagtacattcaaacccatttatagaatcaccttaaaaaacacagtggcgcctcgcgcactgtgttttttgtatgacttaattttactaagtagtgaaagcggataactaagaaaaagttagtcaaaatccctaaaattaaaatataattagaaaaatccgttgacaatgagaaaaacgatgatagaattctaattattcaaggagttagagcttgcttaatttaattgaaggagatgaggcgttaatcggacgtttgtttggacgtccgaattcgaaaacaaggattatgcgtagcacttcagcagtggttgaaaggttggcgattgagttaagacagagaattgatgaatcaagtcgttaggaaaagcacttatagcattattttcgggaaatacatatttttaagtcgaatggtcgcaaagaccgatcaatttagttagcaccatcttgtggcaaccactagcacaggcttatttgggtggtgctaattcaggattcgttttcgttatggtgagaaggacaaatcgaaaggaaacttgattatgcaaaaaattgaagcattgggaaaatgggtaagccgctggtttaccgtacttgttattgtttgggccgcgtttaactactttttaccaggtaccagtacttgggttgtgccgaacacatcgtacttactgggaatcatcctgttcgggatggggttaaccttacggggtgaagattttgcccggatcattaagaaacccgttcccgtcatcttagggaccgttgcgcattatgttatcatgccaaccatcgcatgggtgctatgtttaatcttccatttacaaggggcgactgctgcaggggtcattctcgtgggatcttgtcctagtgggacatcatcaagtgtgatggcctaccttgccggtggggatgttgcgttggatgtttcgattgaaacactgtcaacgttactcgcaccaatcgcattgccaagtcttttgttattgtttgccggtcgttacgttgctattccaacccagtcactattcttaagtaccattgaaatcgtgattgtaccgatcgtcttaggggttgtgattcacacggtatttgggaagcacatcgaaaaaatcaccaaggctttgccactgatttcgcaagttgccattctactgatcattggtgcggttatctcagctaaccatgctaacctcttcaccgctgcaacagcaatggttatcccagttgttattttgcacaacttgtctgggtacggcctaggcttccttttctcaaaactaatccggttacgtgatccacaacgcaaggccattacgtttgaagttgggatgcaagattccagtttgggtgccacactggcaatgaagtattttgcccccgctgcagccattccttcaacaattttcagtatctggcacaatatttctggttcagtgctgtcatcatattggcgcacacacaccgaaaaaaagcaggcggcaacaaccagcagcgtgcatcacgcacatcacgcagcgggttataccaactagtcatgaatgattaatgcgacgtctatcagttaccggcaagtatggcggtagttgatggacgttttttaatggaattgaaggggtgaaacatgtgaagcaaacaaataattggcgccggaacctctggtttttatggggcggcaactttatgactggaatgggcttttcgatgacggtgccgtttctcgcgttatttatcgatacactggggaccttcaataagtggcaattaaatatgctgacggggattgccttcgcgattaccttcttggcaaaggcgattgtttcgccgtactggggcaaactagctgatcaatacggccgcaagccaatgtgtttacgtgcttcgctggggatgacggtaacgatcacagcgtgcgggtttgtccccaacgtggcggtgctaatcgtgctacgggccattcaggggtgtttttcggggtatatcaacaatgcgaatgccatcgtagcggcgagtgtgccgctagatcacagtgggaaagcactcggcactttagcgactggcaacgtcgtgggaacgctccttggtcctctaatcggtggcatcttagcggactcgtttggctatcgtgaagcctactacgtgactggtatgatgatgtttgtcgtgttcatgatgacgctgttatttgtgcatgaacagttcacgccggttcaaaaggacgaaatggtgccgacaaagcagattttccgagaactacaatatcctctgttgatttggggattgttcatcaccacgatgatcatccaagcagccaacatgtcgatgacgtcggtggtcagtttgctgattaaggagttgtgtcataatcacggacagattgcactcgtcagcggtgtcatcacgtcccttccgggggtggtgacgctgattgcctcgccgttactggggatgttaagtgatcgaatcggaccggaaaaggtgctaatgaacggccttgtgctagcggtaatctgctttattccgatgggctttattacaaacgtttggcagttaggcgcgctgcgggccctactgggaatttcggatgcggcgttgttaccggcaattcaatcgttaatgacattttacgtgccgaagagtgggtttggtcggatctttagctataatcagtcgtttcaggctctgggaagtgtcggtgggccgatgatgggggcggtggttgccagcatgtttgagtaccggagcgtctttttagcgacggcgattttggaaattgcgaatgtcctcttcctgattccagcaaccaaggcgttatggcatgcgggccccattcgccagcgtgggccgatcggtgggcaagccaatatccatgaaattaatagttaagtgaactaaaatgggagccatgacgaaggtcacagctcccattattaatgataagaaaattagtggtattcggagatttcgatcaggttgtggtcgggatcattgatgtaaagcgaggttaatttgccatgggccccattgcgttctacggggccttcaatgatgtcgacgtagtagctttcaaggtggtttttaacctcatcgagcggatctttgacgatgatgcaaaagtcagcggcaccgggagtagggtgaccggcaaccggttggtgcggagtagccaccacctgtagcttaatggcttgcttgccgcacaaaagggtctggcggccatcatcagtttcgatgattggcatgtcaaaaacttcgtggtagaagcgcaggcttttttcgaggttcgtgacggtgagggtaatgtgatccatatctttaattttcattgttaggcttcctttaagtagcgaattgcgctgattagtggcgtaatttcgggtgatcgtgagtgttatgcggcccaccgctaaagtttgtggtgcattcaataatgcggtgaagggccggtgacacggtcgcttacgtcgttgtgtaactagtatagcatataaattggcgttgttaatttagtgatgcaagtgttaacattggttcttagcgatttattaatgaagacaagggccgcgatcgtggcggcagatagaaaaggaagaaaaatgagtttattagaagttgacggcttaagcatgagctttgccgataaaaaattgtatgatgatgcgagctttcagctcaacgcccatgaacacatgggaattgtgggacaaaacggtgcggggaaaagtacgctcatcaaaatcttgacgggaacggtgttggccgtagaaggaaccgtgaagtggcaaaatcacattcgcattgggtacttggaccaatacgcggacattgaggacggcacgacactgatcgaatttttacacaccgcatttaaggatttgtatgaaattaatgatcagatgaacgactgttacgcccagtacgccgagaccatggacgataagttgctggaacgggcggggcgctaccaagagcagctggaagcgcgtaatttctacgatattgaaaccgaaattaaccgggttatgagcgggctggggttaaacgaactcggtaacgatcatattgttgcacaaatgagtggtggtcagcggtcaaagattattttggccaagctgttactggaaagtcccgatgttattctgttggacgaaccgacaaactacctggatacggcccatattgactggctgatcgagtacttaaatgactttgatggtgccgcgatggtgatctctcacgactacgatttcttggaaaaggtcacgaactgtatctgtgatgtttcgtttggcaagatcaccaagtatcggggcagcttcaagcaggcgatgcggcaaaaggaagaacggaaagaaacccagttgcgggaatatgaaaagcaacaggtcgaaatcgaaaaggctgagcggtttattcgaaagaacaaggccggttctaaatcgacaatggctaagtcacgggagaaaatgttggcgcggatggatcggatcgatccgccttcggaaaatctcgtggcgacgtttaattttccatacgaagatacgggatcgcagaatgcgctacgggtggaagacctttccgtggggtataacaagccgttactagcccccgtgacgttctcgatgacgatgggcgaaaagctgattttcaagggcttcaacggagtggggaagtcaacgctcattaaatcaattttgggcaaaattccggctaagggtgggtcatcacagttttcaccatctgcacggattaactattttgatcaggatttgatttgggatgacgcttcgttgacccccttacagaccattcaaaaccaatttccaacaatgctgccgaaaaccatccggacacgtctcgctcgggccggcattaatgcggccaacgcgatgaagcccatgaacctcctttccggtggtgaacaaacgaaggtgaaactcgcgatcttggagttgacgccatgtaatttcttaatcatggacgaaccgacgaaccacttggatgatgagaccaaggatgggttgaagaaggccctccaaaaatttccaggcaatttaatcttggttagtcatgaggaaagcttctatacgggctgggttgataagattttgaacgtggaaaagctgagtttgaaataataaaaaagatcataacaaataagcgatcactgacgagttaagtgtcagtgatcgcttattttgtgtagttagattaatttcagcaagtccgacggtgtttgcaatgaaaattctgcgtcaactaagttttcgggttgggcagaaccccagagagcggcaccaaaatgggcgccagccgccgtggctgcttttaagtcgttgatggtatcgccgatgtagatcgactctgccgccacgccgttgactttagcaattccagccagtaccggatccggatctggcttgtgcttttttgtatcatcggccgtgacgtagtggtcgaagtacttagcgatggcaaagtttttcgcaaactcgttgcggtactcatcagtggttttcgaagtggctaccacgaggttaatctctggatgagtggctaactgtgaaaggacatcttcaatttctggaaaaactttaacctgcgccgtattttgataggccaaatcaaaccattccttgaagatcggttggaggtcagcttcggctaccccggcgccccggagtgcatccagagcggtgatgccgaagagcttggtgaggtcgtggtagtcacgatgataaccgtgcttttccagggtcacctgaagtgcgggcatgtacatctcaatcgtatcaatcagtgtgccatcaatatcgaaaataaagtttttcagcatatgcactccttgtgttagtcgttgaagttgtcagtttcgacgtcccgcaggaaatcagccagatgcttgaagtaaacgggggcgttatcgatcatgtggtggtggcccccattgggagtggtggctaaccgagcgtgtggaatctgatcggccatccgtttagcggtggcaattggcatggtttcatgttctccgaacgtgattagggttggcattgtgatgttatggatctgatcacgcacatcccattcctttaatttacctgtgatcacgaattcgttatcgccttggaaagcgttataaacgggagtggccatggtgctgaccaaatgagaaatcgcagcgggttgcttgcgatcaacgtagccttcgttcagcacgtcgacgtatttttggtaacgatcgttatcataatcgttgttggcctcgcactgtttcataaaggccacggcatcagctggaagtgctgtttcgcgcacgtgattgatgttagtgacgtattcgtcgatgttgtcgaccattgatgagataatggcgcccttcaggtgttgaccgtacttcaacgcatacatttggactaaagcgccgccccaactttggccaatcaagtagaagttgtcgagtcccatcttttggcggacttcttcgacttcgtccaggaagtagtcgtaagtcaggtatttcttagcgatttcaggatcggagtagtcgggttggtctgagtaaaatgacccgagttggtcatacatgtgaaccgtgacatcgagtccttgtttcttgagttcttcagcaaagttctcccagtattcgtgggttccaccggggcccccatgcaagcagagcagatggatggcaccagttccctgcgtgcgtgtccataaatggtagccgttatcgagtgtcaaaattgtcgttccttgtttcattacttcacccattttctaaaaattagttgcttatagtgtagctcaattgaataggggttgccaaataaaacttcttctgttaacctgtattaaaaataaggttaacaaggagcgcggcatggatacaaaacagacggtgttggattatttagcccagcatgaggggcagtgggtgagtagcaaggagatcgtgacgacgctggccgtttcacgaacggcggtgtggaaggcaatcaagcaattgcaagagcaccactatcagattgatagtcaaacggggaaggggtacttgtataccccgaacgcgacgctcagccagaccgtgatcgcgcagcaaattgcccccgaatggacgctagaggtgcacgatcagattgattcgacgaacattcgggccaagcagttagccgcccagccccaaatgacgcccaccattgtggtggcaaacgaacaaaccactgggtacggccggttcggtcgtcacttttattcaccgagtcaaacgggaatttacatgagctttttactgccgatcggggaacggcaactcaaccccggcaaactgacgacgggggtcgccgtggcggcagctaacgcgatcgaacaacaatatgacgttgatgtgcaaattaagtgggtcaatgatctggtggttaacgaacataaagttgctggaattttgtcagaggcaattgcggatgtcgaatccgggacgatttcgagtgtgattgtgggtattggcatcaatatcgcgccgagcgacgtggttccggcagaattgcggcgcaaggtgggagcgttgacgtcattgacccagctggatcgtaataagacggttgtgaatgtgattcaagcggtcacggccctacttaagaatgaagatcatcacgccattatggatgagtaccgtcgccgctgctttgtcatcgggcaacgtgtacaggtgcggattggaaaacgcgaactggatggcgtggtgcaaaccatcgatgatgatggggccttacaactgcaaacaaaaaccggccgccaaatggtgggcgccggtgagattactaagttaaatttaaaggatggtggttatcgtgggtaagtcacgattaaaagaaaatttatttgccgcagaactcgcaatttttctagcgattagtgcacaactgacaattccattaccgctggtccccttaacggggcagacgttagcggtgggggtcctcgcctctattacgagttatcggttagccaataaaagtttgatcgtctacgtcttgcttggtttaatcgggttaccggtttatgcgagcgctggtgctggcgtgggcgttttattcggtccactggggggctttatctggggcttctttattcaagcatggctaatcattgcctgccggcaccggccgacgtttggctatcttgtctttggaaatctcgtcgggggcctcgcacagctgattattgggagcctgtggttgatggctttcaatcacctatccctgatggcggccgctgctagtggtctaattccgttcttaattcccggtgcgattaaggccgtgctggccgcaatggtcgccaacattttactagccaaggttaagttaccctttcacgttaacgaacggtaggaatgacaaggtggctctcacctaactcaagccggtacgtaatggcctcgttaccgcgaacggtcataccaaagtcggtgctgaatagtaccagtcctaagcggtgaccggcggcgaggtggtgaaagatgggttgcaacttcaaggttaaagcgacgcgttgaccggccgccagtgcatcaatttgtgcgctactatgccggttttgtaaattaatatgaccaaatgaaatcacatggtaatcactaggacgatcggcgagggtaaattctcgcaggtcgtctttttgccagtgataacctaattccaatccctgccgattgagcatggttggagaaacgttgaagcgtcgagccgtaccatagtcgactagctgggcactgagcatgccgtgatcggcggaagcggtcagtgaaaccgtcagttcgggggtcccctgaaggagaagatcatccttgaactggggtgttttaaactgacagctaaaggcgttattagtggtgacaagggccgtttgccaaactgtgggttgccgggagaacgtttgaaattggtcgactggcaactgatcgttaaaggtgaccgaatcagttgttgccgcggcgcgttcacggagaccgtcagtggttagttgccattgacgggcgtgccccggttgttcccactgatcagtactggtccatgtttcagggaccacgttatcttgggtaattaaatctggtagcacgtcgttagcgtggttatcaacctgccacagtttgtttgaaagccaaagattaacaatatcggtaaagtcaattgaacgaaaggcgttgatgtaaatatgctggccctgatgcaatacgagtttacgagcaacgggcaggtcggctaggccatcccagagactcttaacctgattaagttttacgttccaatcattgagaccgtggaccatcataatatcggcctgaatatttttaatgttaggccggtagtttcgctgccgccagaagtcgttgtagttaccggtggcgcgatccatggcgcgggccatttgctggaggtagtcgttgaacgcggtctgaacgtggtgataatcccccacgtttttggttcggctaaaggtctctgccgccaggacgtcggcgtcttcaccgggaaagccaccgggggccatgacaagcccgttttcccggtagtagtcgtaccaacttgagatggccgcctcactaataatggttttgagaccagtcacaccggttgtggccgccgcggttgccagggtgccaaggtagctccggccggtcatagcaacgttaccactgcaccaccaagcagagatctcaatttgatcggttcggttggtgaacgcccgccgctgaccatttagccattcaatgactgcgattgttgccagtgtttgttcaggggagccacaggtttggaacccgtctgaatctttagtaccgatgcccgcactatagatgatcgcaaagccccgtacggcgaggtagttattcaacgtgtacgtggcctgctggtgcacggtttcctcagcagtagtggtttcaccctgcgttgaccggtgactcgtcggtgtgggaaaggcgggaatatcgggctgttgctggggatctttatgcgtcagtttggtggccactgagtgggtcagtttttcgccccaagcatcgttagttccctgattgtaaggactagcggtgtaaacggcgggaatttggagaccgtcatttgtttcagcaggccgcgtaatctcgactttgatgaggtcgcgttgtccgtctgagtcggtgtccaagtcagtttcgacgtagaccacctcgttgattaaccgggtgggatcgaaaacggcaagggccttaccattaaagaacagtggtttttgggtggcggggagctgatacagggggactaaaaaaccacggctagtgagcgcatcgataaatgattgcccgtttttggtgtgggtgcacaagagcaggtaccaggcatcgatgatggccgctggctgatccagcgcatgctcgagggcggggagctgaatggtatgccatgccacgtctggatgggcgggatcgtaatcgacatcgacttcgaatgcgagtagttgcaaggcaacgagttgaaacatatgacgcgacacggggcgctgctgggcacggcattcagccagtgttaagtcactcgtggctaaggtttgtgtcaaaaaggtatgccaaccggcttcactggggttctcaagcatggtatggcggagaaagtggtaccataattcggtagcggtcagttggtcggtctgatcgtcgagaaatccgagctgggtgagttcagcgattttttgatgggtagaaacgggttgaattgcaaattggttatttttcatagcgggcctctcaattttttgcggacagaaaagattttagttcacggatactattcaattccgtataatggttaaggattagtttaacataagttatgataatggtttaatgatgataatcatgtgtcaactagagaaaaacgtaaagaaggtttgggattggctggaaacgttattgaatttcgtcacattagcaagagctacgacgaaacacaagtattgaagcaaattgatttcgaaatcgaggcgggaaaattttataccttattgggcccgtcaggatgtggtaaaaccacgattttgcgaatgattgcgggatttttacaaccgactgcgggtgacatcttgttcgaaggccaacgggtgaacgacttaccggccaatcggcgccaggttaacacggtctttcaagattacgcgctgtttccacatctaaatgtcgcgcaaaacgtagcgttcgggttggagattaaaaaggtggcgaaggggcagattgcacagaaggtggaagaagccctgcgactagttcaactcagcggatatggtaatcgagaaatttctgaactgtccggtggtcaaaaacagcgggtcgccattgccagagcgattgccaacgagcctaaggtgctcctcctagatgaaccgctatccgcattggatcataagctacgtaaggaaatgcaaagtgaactacgctcgttacagcggcgcttaggcattacctttatttttgtgacccacgatcaagaggaagccttagcaatgagtgatcaaatttttgtcatgaatgccggcaagattctccaaagcgggacgccggttgatatctatgatgaaccgatcaaccactttgttgcggatttcattggtgaaagcaatattattcccggcaaaatgaaggccgattacgtagtgagttttgacggacacgagtttgactgcgttgatgcggggatgaagcaaaacgaacccgtcgaagtcgtgattcgcccagaagatttggatatcaccgccgctaatacaggacaggtcaacgtcacggtcgacacgcaactgttccggggtgttgactatcagattaccgcccatgatgttaacgacaatgaatggaagattaattcgattcacaaaaccacggtcggccagttagtcgggctcgcttttgatccggaagatattcatgtcatgcgttacggtgaagacgaagcgaccttcgatgcgcgcttggaacgctacgaatagggagggcgaacaatgaaaagcaaaacagcctacctcacgccctattttttgtggattgccctctttgtgatcgcccccatggcgttgatcctataccagtcgttttttagtatcacaggccatttcacgtttggtaactacgagcagtacttgtcatcgggcgtctacctcaagatgacggttaactcgatttggtacgccttcatcatcacggtactggcacttttagtgagctacccaacggcctatctgattaaccatttaaagaataaacaattatggttactgctaattatcctgccaacgtggattaacctcctattgaaaacctatgcgttcattggattgttcagtcaaaacggctcgatcaatgattttctccgatttgtcggtctggggagtcatcagattttgtttacggacgcgagctttatttttgtggccacctacatcgaaattccgttcatgattctgcccatttttaacgccctcgacgagttaaatccatcgctggtgaatgccagtcgtgatttaggcgccagtgcgtggcagacgtttcgacgggtgatttttccgctgaccatgccgggcgttaaggccggtgtccaggccgtattcattccatcactttccctcttcatgattacccgtctgatcgggggcaatcgtgtgattacgctggggacggccatcgaggaacacttcttggtgacccagaactgggggatggggtcgacaattggggtgatcttgattctagccatgtttgtggtgatgtttttgacccgggatcgtaagaacaaaggggggcagattcgatgaaacgtgttcacccaattcgatggagcaacctctacctgttgctggtctttatcgtgctctacttaccgattatttatctgattatttactcattcaatgccggtgatacgatggatcgcatcaccgggttctcatggcgacactatctcacgctgtttgcggacacgcgcatgatcagtattgtgctcaataccgtgattattgcggtattgtcggcactgctagcgacgatcattgggacgttcggtgcgctcggtattgatcaactcaaaaagcggagtctccaaaatggcattctgtcattaaataatgtcttgatggtttcgccggatgtcattattggggccagttttttaatcttctttacctttctgggcgtcaagctgggatttggttcggtcctcctcagtcacattgccttttcggtgcccattgtggtgctcatggtgctgcccaaaatcaaggatatgtcgcaaacgatgattgatgcggcctatgatttgggggcaaccaagtggcaaacgttgacgcgtgtgattctgccggcgattacccctgggatttttgcggggtatttcatggcgttcacgtattcactggatgactttgcggtcacttttttcgtgactggaaacggcttttcgacgttatccgtcgagatctattcgcgcgcacgacaggggattgatctggaagtcaatgccttatcgacgttgatgttcctcgtatcattgttgttggtgggtgggtattacctgttaaaccggtacaatgaaaagaaaaaaattcaccgtgcgaaggcgagtcaggaggtggatgacgcatgaaaaaattaacgctcatcattgcggccattctgattttttgtggcgtcctctttggaatcaaccacgagttgaatgccaaaaccagtgctgacggacaaaaggttctcaatatctataactggggcgattatattgaccccgcattaattaaaaagtttgaacaccaaacgggctaccacgtcgtgtatgaaacgtttgatagcaacgaggcgatgttgaccaaaatcaagcagggggggacgagctatgatttggcggtaccgagtgattacacggtccaacgcatgcgtaaagcccacctgttagtgaagctcgacaagcggcgattaccactgttaaaaaatattgatcagcgttttatgaacttaacatttgaccccggtaatgattattcggtaccctatttttgggggaccttaggcattgtttataatgatcagatggttaaagcgagtcaggttcagcactggtcacagctatggaatccgcagtttaagaaccagatcatgctgactgatagtgcgcgtgacatgctcgcgattgcgctgattccactaggctattcggttaataccacgaacaagacgcagttggatcaggccgccaagcgcttggaccagttagcgccgaataccaaagcggttgttgctgatgaaatcaagatgtacatggaacaagatgaggcggcagttgcggtcacttattcaggcgaggcagcggaaatgatggctaacaacactcatttacactacgttgtgccaagtgaaggaagcaacatgtggtttgacaactgggtcattccaaagacggccaagcaccgcaaggccgcctatgcctttttgaactttatgttggagccccaaaacgctgcacaaaatgctgaatacattgggtactcaacccctaataaggcggccatgaaagatttaccggtcagcgttagaaatgacgcccaattttatccgagtcgtgaaacggtgactcacttgcaggtctacaaggacttaccgttaaaaacgattggcgattataacgatttatttttagagtttaagatgtttaagaagtaggccaacacgaaagttgaggacgatcatgactgaattaggaattattgcgatgttactgatttgcacggcggtggtgggaaccctcgcacagcgcattcaggtaccagctgtgatcggacaaattctggtaggggtattattcggaccagcagtgttaaatttcgtgcatccgacggaaattatttcctttatcgccgaaattggggtgatcatcctgatgtttatggcggggttggaaagcgacctgcagttgctacgccggtatttgacaccgtcgttgagcgttgccgtctgtggggtcgttgttcccatggtggtctttatgctggcaggaaaaattgcgcacttgtcgacagaacatgcggcctttttggcgattacgtttgccgccacgtccgtttccattaccgtggaagttctgcaagaaatgaagcggcttaacggcaaggaagggacaaccattttaggggccgccgtggtggatgacattttagccgtattaattttgagtgtttttgtgaccctcactcatgatggtggtagcgggcatcaattgccgctccaatggagtttactgattcagctgatttactttgtggcggtgtacctgtttgtgaagtggctcgcaccatgggttatgcggcttggcaacctcatgaaggttaactcagcaccgaccgttttatcgatttcaatttgtttagcgatggcttacgtagcagatttggttgggttaagtgcggttgtcggggccttctttgcgggaatcgcgattggccagacgggtgtcagtcgggaaatcgaaaacacggtcacaccgattggttacgcctttttcattccgatcttctttgtaagtatcggattagaaatgacctttgccagcctgaaagatcaatggattttgattgtggttctgacaatcttagcagtggtcacgaagctctatggtggggcaatcggggctaaattaactggcttcagctggcactccgggttagcagtgggggctgggatgatctcacggggcgaaatggctttgatcattgcgcaaattgggttatcagccaagatcttaacgggaaatcaatattccgatatggtgattgtgattgttctgagtaccttgattgcaccactaatgctcaaacactactttaaaaaagttgaataaaaaaatgcgcattcttctcatcaggaaaatgcgcattttttacgttagtctttatgactaagcttactgtgtgaatagccgtagctaaagtagagaataatgccgatcaagaaccagacaccggcgccaatccaagtttctaattgtaattgcgttagcataaccaggcaggcaattcctgaaagaattggtaagacggggtaccagggaactttgaagccgccttcgtttttgatgtccttacgatgacgcaggggaatgacaccaaatgagacgaacgtaaaggcaagcagcgtaccgatgttaaccaagctagtgagctggtctagtggcactaagccgcccatgatagcaatgatgacggtaacggtgatgagcgcgttaactgggatcttgtgcttgtcactgattttatcaaggaagctgggtaacaagccgtcccgaccaattgagtaaactaaacgagaactggagtaaatcattgtgaccatcatggtgaacatcccaatcaaagcaccaatggaaatcaggcccgcggcccaatcttgatgaaccaactgaagggcaaaggagacgggattggccacgtctaacttggtgtatttcacaatcccagttaagacgatggaaaccgccatgtataagacggtggcgacgatcaaggtcccgataatcccgattggcatattcttcttggcgtccttaacttcggcggctgatgaggaaacagcatcaaatccgaggtaggcgaagaagacgagtgcggccccttgcatgactccagaagccttgtaaggtaagaatgggtgccagttacttggtttgacgtaaaaggcgccaacgatgacgaaaataatgataatagcaattttaatgatcacggcccaattattaattcgcatggacgtggtcatgcctcgtgagagcaaaaatgagatcaagaggacgatgataatggcgactaagttgaaataagtgccatgggcgggatcaaagggaccggaaatggcttttggaacgtggagaccaaagccctcgatgaacgaatcgaagtaggctgcccagccggttgaaacggccgctacggcgagcatgtattcaagaattaaggcccagcctaaaatccaaccaataatttcgcccataacgacgttcccgtaagaataggcacttccggcgatgggcatggcggaagcaaattcggcataacacatggctgctaacgcacacacgacggcggaccctaaaaatgataaaataattcctgggccactggttgttgcggcgacggttcctggtaaaataaaaataccggtgccgatgacggccccaattccgagggccatcagatcgaaggccgatagtgttttgacgaagcggttatcccgctcaagataacggtcaagactttcctttcggaataaattagaaaacataaataaaccacctttggtataatgaataatagcattttaaactagggaatatcataccgttggttaagattaaaagtcaattaaaattcgactaatctgtgaaatgtgggaggaattgtgaataaatgaaaattgaagtgacaagtggcgcggttgtttatcgaatcgttgatcaaaaaattgagtatttgttgttgcaaagcatgaacgaaggtaacttttggggctttccgaagggccacgttgaggcgggagaagatttattgcagaccgcacaccgtgaaattagggaagaaacgcagcttgatttaaccattaacgatcagtttcatgtgacgacggaatacgatttgcccaacggcaaccacaagaaaatgacgttgtataccgcaaaactcgagcaagcaacggatttaacgttacaagcgattgaaatcaaaaatgcgggttggtttgactatgagactgctcgaaaccggttaacgtacgacaacttgaagcaattattagatgatgtgaatacatatctaacaaccaagtaatttaattagaataggaagaagtttgatgaagcatgtattagtcattaccggagcggctggttccggcaaaacgacggtcagtaactatttaagtgagcatttccaaattccacgcgtcgtcacccataccacgcgccgcccccgccgcggtgaagttgatggccgggattattattttgagagccggcagtcgatgggtcagctccacctccttgagcgtgttgaatacgatcatcatttatatgggtcttcgtatgaagggttacaaaaggcgtggcaggatcatgatatggcaacgattgtgcttgataccaagggcgcgcagacgtatcatgaacggttgggggaacaagcagtggttatttttctgaccgtcaccaagcagcatgcgttagttaaacggcttgcgaaacgtggcgaccttaaaactgcggttaagcagcgcattgcgagtgcggagtatcatcgtgatctgaccctgccggacgaattgacggcgacggcccaagtcattactaacgacgagtgggaacacacgcagcagcagttagaccagttggttcagacgctccaataaaggaacacactttactttggttctcgtggtgactatggtaatatgacggatagagaagacattcagacaataaatggggcgttgacatggaaacaaagacaactcaggcgctaacaattttacaagataaccactataaagtaacgaagcagcggcggtcactcattgagtttttggcacagcatcgcgatcgctacgttgaaatcaccaagatagatgcttacttgcggcagcttttcccagggatgagccataatacgatttatcgcaacctcaaggaattcgaagagatcggcattgtggagacccacgtggaaaacgatcagatgcaagtcaagtatcagtgtgattatgaaaatcagcatcaccaccactttgtttgtcagaattgtgggcgtgttaccgaaattcaaatgtgtcccatcgatatggccttttttgagagtcaattaccgggggcgcaaattaccggtcatcggtttgaactggtgggcctatgtgcgcagtgtcgtgcagctcaaaatagtgataagtgacaaatcgaattcctggcgtggaaagcgatgcgtcactttttttgtcaccgacgaaagtgactgaaagattgaaaaagcttcgcgaaatcttaacaaactcgaccggtgaaagtagtatactcaagactgataaaaaggtaagcagaaactaaggggagaaatgaattatggcctatcgcacaccaccatttattacaccatttgccattgtttccattgtgttagcgttaggggcaaccaatgttgttgtgaacaaggcaacgaatacgagtgaaggggcaacggtgactaaaacgtcatcgagcacgacttccacgtcggcgtcggatgaaagtaaagctagttccgataccgccagctcggagagcaagccgagcgttgatgacgcgagttctgagtcttctgatgataccaaggctagttccgccaagacgacggagacgagttcgtctgctaaaacggatacgggcacgacgaccggcacagacgcaacgaagtcaacggggacaaccggtaacacggacactggaacgggaacaaccaacaacacaaccgatgatacgaccacaaccggcaatactgataccaccactggtgatacaggaaccactggaaataccacgggcacgacgactaacgcaacgaccaatagttaatcagtaaaggagaaaacgaacatgctcagtattttagacatgattaatcacggtttggggtactttaacctcaacgtgaagttaaaaaatcgcatttacacggcgattgggtttgttggccagtggtatttaatctacgttgccgtccggttgctgcataacggcgtttggctgcgcggagtgctctacctattggtctttgtactccttttgtatttttcagtattgaacgtgttgtattacttcaccgcaaagacgacgaagtttgatatttctccgaagattgaaaaattaatgggaggcccccgcaaggaagatctgaaaaaggatcaagcaacatcggccgcacccattatcccagcaaacgggttgtttaccaacgatcaaatcttgccggctaacgttgcggttaatgaacatgaacgggccaacctgaaacgggttgtgaagcagctcattgacgcacaggtattgctagacgactacggagccttagacgaacgccagattattcggcaaaaccgggaaactggtgagccggtgccagcattacgaccagaccaaccgatcccctatttcgaattggtacccaccggtgcacgactagaaatttacattgggctgaaccagatggaacggttggccgtgggtcatattacgagtgtcggtttgaccgaagtgacgacggcacgaaaaaattatcagttatatttagcgaacgtctttattagtggaggacccgtgaagatcgccggccgctcggacgcaacgctggtttctgaggaaccatatgaactgaatgttaaggtggcctacaagactaaacccacaaactaaaattgattttatgatgagatgttgatatattatagtctaatctaattttaataaaggattgagggattgtatatgagtgataagatacagcgattagtgggccgaatgcgatcgggtttaaaggatgtttcaccttccaaaattcgggcgttcgaccaagaagtttctgaaattcccgggattattaagttaacgttaggcgaaccagattttgatacgcctgagcatattaaggaagccgcaattagaagtatccgagcgaatcactcacactacccgcaatcagccggaacgccgggacttcgtcaggcggccgctaatttcctagataaaaaataccagctgcactatacggcagataacgttgtcgtgaccgtgggcgctactgaggccatttcggtggcgattggcgcggttgttaatcaaggcgacaaggtaattattcccacccccatttggccaatgtacattccaattgcccagatgcaaggggccgatccagtcttcattgatacgtcggcggatgactatgttttaacaccaaaacggctagaagaaacgattcagcagtacggggatcaggtcaaagcagtcgtattgaattttccttctaatccaaccggtatcacctatcggcgcgaggatacgcaggccattgcggccgtgctcaagaagtacgatgtgttcgtcatttcagatgaaatatacagtgaactgacatacggtgccccccatgtttcagtggccgagtacctgccagaacagacgattttaattaatggggtttctaagtcacatgccatgacgggctggcggatcgggattatttgtgcgccagaaccgatcgtgcaacagatcttcaagttgcatcaattttcagtcaccacggccacttacgttgcacaagacgccgcacaggaagcctttgaaaatggatttgacgatggtcaagtgatgcgggcggaatatgaaaagcggggacgctttgtttacgagcaaatgaaggccatgggctttggcgtttcgcagccccagggtgccttctacctgttctgtgagctaccggcgtggctcgatgaggacgaagacagtttctgtcaccatctagcgtacgattatcaagtcgcggtcgctgcgggaacgccgtttggccccggtggtgagaaccacattcgtattagttatgcgtcgtcgatgacgcaattacgtgaagcaatgaaacgccttaaagcgtatatggccacgaaacaacctgaataagatcaaaagatgacgcggtagcgtcatttttttgtgattaagaaaagataatgaacagaacaaatatttaaatgctaattgttacattggtaagaacttacgcgttcagttttaacagtaacttaggtacctaactatctgaatcaaaaaggggttaaatgcttaagattatgaataaattcttgatagtaaccgcttacagaggggcaatgctttgacgggattctaaaattgttctaaaatttaacttaatgtttattaaattagagacgaaatcttaaattaatattcacataatcttgaaaatttggaggatattcgtatgtcaatgatcgaatttcatgatgttcaaaaatactatggcgatttccatgcactcaagaacattaatctaactgttgaagcaggtgaaaccgtcgtattaattggaccatctggttctggtaagagtaccctgattcgtacaattaatgggttggaacccattcaaaaaggtcagctgattgttaacggctatgacttagctgataagaaaactgatcccaacaagatccgtaaaaatgtcggaatggtattccaacactttaatttgtatgccaacaagaccgtgttagaaaacattatgctggcgcccaaaattgttttgaagcgtccagatgatgaaaatcgcgaatttgcgatgaagttattagataaggtgggattagctaataaagctgatagctatccacgtcaattatcaggtggtcagcaacaacggattgcgatcgcgcgtagtttggccatgaagccaaagtgtctgttatttgatgaaccaacatcagcattggatcctgaaatgatcgatgatgtgttgaacgttatgaaagatattgctcgcgattctgatatgacgatgctggtggttacccatgaaatgggctttgctcgtgaagttggcgatcgggtgatcttcatggcggacggtgaaatcttggaagatgatagtaaggaaaccttctttgatggtcaaccaagcaacgagcgtgctcgtcaattcttaagcaagattattgtgcacaaataggggagggaacagccatgaaaaaattaacacgcttcatggggctgttttctgcactcgcactgttgttgatcttgatgacatcttgtggttcgaattcagcactatctaaacgagacgtgttacaggccgataaggaatcgaatacgattacctggggtgtaaaggccgacacgaagctctttggactaatgaatgtgaaaactaaccaggttgaagggtttgaaattgacctggctaaggcgatgacaaaagaaatcctgggtaagaatgggaaggcgatctttgtgccggtaaccagtcaaactcgggtgccgctacttcggaacgggaacattgatgcaatcatggccacaatgaccatcacaccagaccgggctaaacaagtcgacttcacgcgttcgtactttaacgctgggcaagccatcctcgtgaaaaagggcagtcccattaagagcgtgaaggatctggataagtctggttccgtcgtgctcggggttacggggtctaactcggtggaaaatattgccaagtatgcacctaaagcaagagtcttgcagctttccgattacgctcaggcattgacagcgttgaagtcgggacaaggacaagccttaacgactgataacgggattttatatgggatgtccgttgaaaatccgggctacaccgttgtcggtggttccttcacgaaggaaccatacggaattgcggtcaataaaggccaagacaagttccgtcaccggttgaacaaggcgctgacgacactcgaaaagaatgggacttacaaccgcatcttgaagaagtggttcgggaacgttcaaggatttaattatgaggagatgaaacgctaatgattcacatttttgcgacccagtggccgttactgctcgaagggcttggccgaacattattgtgtagtatcatcgcgttattctttagcctgattattggatcgttgtttgcgatctttgaaatcatgccaaacaagatcatgcgcgtgattggtaatatctacgtggaagttttccggaatattccactgctggtaattaccatgttcttcttcgttgtgattcccttgtacgtcacgaaaattaacgggtttacggccgggacgattgggctgacaatctatacgtcagcgtttatcgccgaaacggttcgttcagggattcaatccgtggatcctggtcaaatggaaggcgccatgtccaacggtctgacgttctggcaatcaatgcgttacgtggtattgccacaggcgttcaagattgtcattccaccactgggcaaccaatttattaacctagttaaaaattcatcggtactggccttcgtggctggttttgatctgatgtatcagggaaatatgatcgctaacaatacgttgcaaaccatgccaacgttcttcgtggtggggattttatacctcgtcatcacgatgccgttgagttactacatgcgttatctagaaaagaaattagcctaaaggaggtagtgaaccatgcaaaactttattgacgcgtattcatggatcaacattcgctacctgcttcaaggactatgggtaacggtcgaagtttcagttgcttcaattattttaagttatatttttggaacgatcttaggaattattcggtatgccaacatcaagtacgtttcagcaatcgtcggtttcattatcgatttgattcggaacctgccattgctgttgatcatcttctttacgtactttggattaccgaacttagggtttaagccagccattattgaggctgcaattctcgccatgacggttttcgaatcaatgatgattgccgaaattgtgcgttctgggattgtggcggtagattccggtcagatggaaggggcgctttctaacggtctttcttactggcaaggactgcgaattgtgatcttaccacaggcaatgaagaatatgattccggcattagtgagtcagtttatttcacttgtgaaggatacgtcactggctacgatcatcgtgttaccagaaatgatgtatcatgcgcaaattatttacggacaaaacaccaattacatcattccgatgttcattgcgttagccgtgctctactttgttgtttgttatgccctatcactcttggccaagtacttagacaagagaatgtcatacagataaaaagacaaaattaaaaggaactgtgattgattaaaatcgcagttcctttttttgaacttttaattatttaaaattgaccttcgaacttaatttggtatgactttgtctcaccagcaggaagggtgacatcaccgaagtttggatggtgtggcgtgtctgacagcgtttgggcttccagagcgactgcttcccaaggatgaccaacgccacggttgtaagtcattgaatcgtcaaatgagttagcggtaaagacgaccaatccgttgcgttgtgagtaaaccttcagtgaatgaccactggctgggtcgcgaagggttgcgactggtgtgtcggcacttggcttcacaaccaaaatgtcgtcaaagcccttttcagtggtgttttgcatgccgtcaatggcgtccttgaacaccgttggttggttgaaatcaaatggggtcccagcattgtcgagcaggttacccgttgcaatcttttcgctatcaaattcaagatgtgagtcggcgtttgcttggaatgtgtgggctaagatatccgttgtatccgcgtcgcctaagttccaataagcatggctcgttgggttgaagagggtatcttcatcactagtagcggtaaagtcaattgttaccgagttatcgttggctagtgtgtaggtaaccgtggtgggcattttaccagggaactggtccatggccgttgtgaacgtcttgctaagctttaatgaaacgccgttagcatcttcgctagtttcagcatcccaaacttggttagcaaatccatttgcgccaccatgtaagttattgttgccttcgttttggtcaacttggtaatccttgccgtttaatgagaattgaccatctttaagacgaccgccaatccggccaatgatccgcccagcaaagaaggggttgtttgtgtagttttcgaggtcgtcagcgctcaagagtaggttggttttcccatcagtgtatgaacgccacagaccagcgaaggtcagtactgaaatactgatcccgttgtcgtttgttaatgtgtattcatcaaccgtttgtccttcgtgttcgccaaataccttttttgaaatgttcattaataaatgcctccagaaaagtttattcaaccatatttaaccgttacgacaattctagcacgctttgcccgtaaacaaaacaaagaaagcggttgttaaaaatttattagaaaacgcttgcaaaatggtgtaagcccttttataatgattcttgtaagttggttgagcacacaaacaaactaagcaattatttcaattatctgtcactgtgctgaactaaaaaaacattgcaaagtgaggagttgtatcatgcataaagtatctagaggatttatctacttcttcggtgcgttaggcggaatcttatttggttatgatacaggtgttatctcaggtgcgatcttgtttattcaaaaacaattgcatttggggacatggcaacaaggttggattgtttcaggtgttttgttaggtgccttggttggtgcgattgtgatcggacctctgggtgacaagtttggtcggaaaaagatggtgttgaccgccgccgtgatcttctttattggggcacttggttgtggactagccatgggattctggtcattagttttgttccggtttattttggggatcgccgttggtggtgcttcaacgatggtaccaatgtacctgtcagaagttgcaccagctgaaatgcgtgggaccctttcaagtttgaaccaattgatgatcatgactgggattttcttagcatacgttactaactacgcatggtcaggcctctattcaggctggcggatcatgttagctgctgcgacagtacctgccgcaattctgtttattggtggtttattcttacctgaaagtcctcgtttcttagttcgggttggtaaagtggacgaagctcgtggtgttttaggacaattacggaatgcggatcaagtccaagccgaattgactgacattgaagaaaaagcaaaaattaaaatgggtggctggggagatgtcttctctaaagttgctcgtccagcgttaattattggccttggcttagcggtattccaacaagtcatgggatgtaacacggtgctttactatgcaccaacgatctttactgatattggttttggggtttctgcagcgctgttagcccacattgggatcgggatctttaacgtgatcgtgactgcgattgccgtggttatcatggataaagttaaccgtaagacaatgctgattgtcggtgcgttggggatggcagcttcgctattcacattagggattgcaatgcactactcacacaactcaatgaccgcagcctacatcgctgcgattgccttgacggtttacatcgccttcttctcagcaacatggggccctgtaatgtgggttatgattggtgaagtcttcccattgaacattcgtggacttggtgttggtttaagtgggacgttcaactggggcgctaacatgatcgtttcattgactttcccaacattattggctgcacttggaacagaaaaactctttatcggttatggggtattgtgtgttctggctatttggttcgttcactcaggtgtgttcgaaactcgtggcaagtctttggaacaaatcgaaggctacttggacgaacgtgccggtgttgctgctaaaaactaagcattaaatagcaataaacgaagagactgggaaaaccccagtctctttttgacgtgtttattttagccgctggatcaagacaaacagggaactttcatccttgactgtgaaaccataacgcctgatcttgtattggtggcgttttcacgaaaaaattgatagactggggtcaatcactagatatgaggaggaactgacaatgaaacgatatcaaaagattctagttggcgtggatggctcatcacaggctaaattagccctgtctcgggcaattgacatagctgcggggtgcgatgcagctcttttgattgccgccgtccaaaatgacggtaaatttgcgaatttggcaacggggcgtgcctcattatatcggctgtcaccgcagatggtaaatgaatcgcaacagcaactgcagttatttgttaatcgttgtgtccaacaggctcaagaagccggtgtgcgtgtttcatcgttagtttattacggtagtgccaaagaagaattagcggttaatctccctcgtcgtgagcatgctgatctgatcgttgtcggggcgactggtctgaatcgggtggaacggatgattattggttccaccgcggcgtacatcgtggcgaacgctgatgaagatgtggtcatcgttaaagcgaattaaatgccgactgagaaggcctttacaacgtcgaaatggtatgacatactgacgttacaaaaagtaagtggaggcgtcgcgatgagttatacggttgattttaagactgttgatcaagttggcttgacccagtcaccagttgcacccgcactggccggtttaagggctaatgaggcccggtatttttggaataagtatcagcacacctttgtgacggaaccggcggctgagcaccctgatattgtggcttatgttgctgagattctgaaagaaaaacaaatcagtatttcggcccaaccactggaagtttcacagtttgaagtcgcaggaatcaaaatgacctatattttttatattgatgggttgagtattaatgtgatgtacacgctagctgaaggtggtaaacgggcggtggggttgaaactgtccgatggaatggccatccccgtaccactagtagataagtttaagttcgcccggcaacggtcgaagctggccggcacgattcgcggcagttatttcgtgattaaggggaactacgagtaaatcaaaactacaagatcaccaaagccttgaacgctggtcgttcagggcttttttacgtgttaatcgggaaccatgaagtttggtgagtgatatttaagtgccattaaacaagtttgtaaataaagttaactaactcggtaaatcgtgagactcgtatatgactttgaaggtcaaaaaatactaacaaaagtaaattatagccctgtgaggcattacttatatctaaaagatatttttaatgctgtgggtacaagttgaatgctgatataacaacatttgaggcgattattagaaataatgatgatcaaaggcctcaactaaaagtagcagaaaaagtaaaaaaaatcgctaaaaaacggaaaaatccattgacgaatgaaaccgattacaatataatcgcagttaggaaattgaatttattatggttgtttaatttttttacggagaggtgctagttatggatcaaaagatttcaaattctgagggcgcaccacagaaaccaaaaaatatggttccgtggaatgagcgtttttcatatagtttaagtgattttgcatgtaacctgtccttccaaatggttgggacgtatttaatgattttctacactgatacatttgggatcagtgctgctgctgtcggaacgttattcttcgttgctcggttctttgacgccgttgatggaccaatttgggggatcttaattgaccacacacatactcgttttgggaagagtcgtccttactggttatggttctcaattccatttgcggtcttctgtgtgttagttttcaccacaccaaacttaagtttaaccggtaagttgatctgggcttacattacttacattggtgttgatgttttgtattcagcagttaatattccaattacttcgattttgccatcattaacaagtaatccccaagaacgggttgtgttgtcaactattcgtcaattcatgggaactgccggtgccgcaattattactgggatcaccttaaccatggttgccaaatttggtggtggttcaacaactagtgcgcgtggctggttcatctgggcactcattgtggccatcattgttgtaattatttttggaatcgttttcaaaaatactaaagaacgtgttcaaaccaagagttcccggaagtcaattccgattaagaccgcggttaaggcattacggagtaactggccatgggccatcatcatcttcatcaactttatctactggttggggatgcagacgcgttcacaagttacggtttacttcttcaagtacaatatgcacaacactgctttatcatcattcgtattgagtttacaatttgtgtcactgattgccgttgttttgacgccttggactgctaagatgattgggaaacgtaataccatgcttggtggaatgatcctagcctgcattggtcaattgctattgagtttgggcgctgctcacttgagcgtttccatcatcatcgtggctacgatcattggttacttaggaactggttatgtttccggattgatcgccgttatgcttgcagacgccgttgattacggtgaatggaagaacggggttcgtgccgaagggattgtaacttccttctcaagtttcagtgccaagcttggaatgggctttggtggtgtgatcactggttggattctttcagccactggctacgttgccaaccacgcccaatccgcaactgctttacacgggatcgaattgaactacatctgggtaccactattaggtttcgccctttcaggattagcacttgccttctacaaagttgacggaattgaaaaacaaatgctcggtgacttagccgttaaacatgcacgtgaaaatgcagaggatgacgacgaaaagtaatcagccaaccataatataattcaaaaaaacgatcattcgcaattgacgaatgatcgttttttagtggagtgcattgggataagtcgcgaggaaatcaactgcggccccgcgcaagttagcggcatcggtataagtgcaagtagtgagtgagggaagaatcgtgccgatcttactggcgtcacggcaggccactacttcttggttaagccgcggtaggagctcggggttattggagactgccccaccaatgacaattctttctgggtcaaaactatattgtaagttgaagattgcccgtgccagaactcggtaaaagcgatcaacttcctgctttgcaagtgggtgatcgcttgcggcgagatcgaaaacttctttgccattgtagacgtggccgtcggcttggagcttcgtgaagtggcgggccactttgaccggtgaggcgatgtcgctgagaatatggtggtcatcaacgagcatgtagccgaattcaccgccaaacaggtgcttaccatgccagatatggttatcgataatgacagccccgccgactccagttccaatgatcataaagagcagattggacacgtcttgaccagcaccgtcggttagttctgccagtgcagcacagtttgcatcattttcgagggtgacgggcaggtgtagctgttgtgtcaatgccgactggatgtcaaagccatgaatgtaatcaatggcacttttaccttcaatttggccggtttgcttattaacggaccccggaatgctaatcccgacgccggcgatgggggtacggtgttgcaggaggttaacgtgcatctgcaaaacttgatagaactcagtcagggtcgctggagtggttgattggccagttttggcgagctcgtggccgtcccaggtaccaaacttaatactggttcctccaacatcgatgagtgcaatcttgctcatttgctgtcacccccgaaggtttgagaggagtggaagtaaaggttgagatccgcgttgaaaaacttagtcgtcgaaaggttaaaggcgatattattgccgtagtagttaatttgcgtcagggtcagtaaggcatgatcgtcatgaatgccggtcaactgccgttgttggtcattcagagtggtgacactgatgtagttttcggcattgttgacactaatgtcataatcacgcttaacggcatgaaagattgactgttgcgcatcggccaggcttagttgagcaacttgtgttttgaggtagtagctatcttctatgcagtagcgttggccgtttaactggcgtaaccggagtacgtggatcagtggctcaccaattgtaatgtggaggtggttggcctgaaactgattggcaagaacgtcttccagcgctagcacggtcgaggtgaggtgagaatcgacagcgcgcatggctttcccggcccccaatgagagattaacgacgggggcgtcatgcatagtaatctggttaatgtagtagccgctgcctttaacccggcggagcaacccttgctgacagacttcatcgatcgcctttcggattgtgttgcgactaacctgatagtgatcggtcagttgtgcttcactgggcagtttatcaacgtaagtttgctcattaatttgtttaataatatcgtctgcaatatcgtgatacatttttcatcattcccaactaattgatattcaaaaggccttgctaaacttgtacctacaagttataataacacataatgaaaacggtttaaacgtggaggctataacaaatgaaacaaatgcagggataccaaatgccaaaggattttttatggggtggtgcagtcgccgcccatcagcttgaaggtgcttggcaagccggtgggaagggcatcagtatcgcggacgtcatgaccggtggtgataagaaccaggcccgtgctgtgacggagacggtggaacccggaaaaatatatcctaatcactggggaattgacttttatcatcagtatccacaagatattaagctatttgccgagatggggctcaactgcttccggacgtcgattgcttggacccgtatttttccgaatggggatgaggaggaaccaaacgaagccggattacagttttatgaggatttgtttgcgcaatgcttgcgtaatggcattcagccggttgtgacgctgtcccattttgaaatgccatatcacttggtaaaggcctatgggggctggcagaaccggcagttgattacgttttttgaacgttttgcgcgggtttgtttcgaacggttccatcaccaagtgaagtactggatgacgtttaatgaaattaataatcaaaccaactggcgcgatccgcatcatctgctacaaaactcaggattaatacttgcggatgatgaaaactgggaagaagcaatgtttcaggcagcgcataatgagtttgtcgcaagtgctcgtgcggtgcaagtggcccatgaaattgacgatcaactccaagtgggggcgatggtggcgatgtgtccgatctatccgctaacgtctaagccggctgatgtgttgaaagcacagcgggctatgcagacgcgctactactatggggatgtccaagcgctgggacaatacccgcaatggttgctgaagtattggcaacggcatgattataaaattgagattagcgaggcagatcgacagacactacgcgccggaaccgttgattatatcgggttcagttattatatgtcgtttgccacccaagcacgaggggaacaggaactcttctttgatgaagcacgggatctagtagataatccgcacctcgaaaaaacagattggggctggcaaatcgaccctgtggggctccgctatgggatgaattggatgaacgatcgctggcataaaccgcagtttattgttgaaaacggctttggtgcctatgatcaattgaccgccgatggccaagttcatgatccttaccggattgactattttcatgaccatatcctccaaatggaaaaagccgtcgtggaagacggcgttgaccttatcgggtatacaccctgggggcacattgatctgatctcagctagcaccggtgaaatgaagaaacgttacgggatgatctacgtggatcaagacgatcacggcaacggaagtctcaaacggattagaaaagattcattttattggtatcaaaaggtaattgcgtcgcgtggcgccgatctcgcaactgatactagtgatgaaggataaggcggatatgctccatgttgagcacgttatgaatcacgagtgaacaaccgcccagtagcgcggagaagtggacgtccttggaaaaaacgaggggcggcacaaggggcatgtaggacaagttgagctgaatgacacgcagaaggtccggcaactcattgatgatttcggagttaaagaagatcatttggggatcaaacgagatgatcaaatggttcacgatcaaggataggtggtaacaaaaatcgtcaagaatcttggtgacaccgggatcttgctgagtataggcttgtgccatatctttgagggaaaagtcctttcctaaaacatcctgaagtttttcaagaacgcgttgttcagaccattcagtttcaattggcttgagctgtgacagggggacgttttgacagtcgtctttaaaaatcatgtgaccgacgtccccagcccgcccaaagtagcccttatagagttgccgattaatgaggatccctgcgccaatgtgtttgccgacggttaacgagatgatattgaccagttcttgttgactgaagtcctgttcgaaaacggcagaaaggttagaggcgttttcgatgacgactgggacctcaaacttttcttgtagggcagtttgtaaattgaagttgccaactgttttgaacggagaatcgataatgtttccccggtagacgtacccgggaatggcaatggaaatgccgcagagcccgttttgggtttcaaagtccggtagttcggcaatgctgtcacaaatattttgaaagagttgttggagggtctgggcttttgactgggtaaccgtgtactctaacgttctcccatcaaactgatttgacataatctcaatttgatcgtcagtgacactaaaattaaccacaaagccaaacttggcatttaattgcacgagctctggccgccggccaccactcgtagtgctctgcccctcgccgatactggtaatgaaattagctttcatgagatcgttaataatatttgaaactgtaactttattaagccccaactcttgtgatacttgattacgagagatggggcctttattaatgatggtctgaaaaacggagcggttattggcgtttttcatggtgtcttttttgataaccatttcctaattcccccaaagaattttagttagcaatatcgctcacgataactaacagtacaatgattgatatttgaagttattatatcttaattagggtggggatgaaaggggacacaagattacaaaaaaagaaatgtaagcgttgacatttgaaccgaatgaagctatgataaatgcatagtttgaaaacaaacttttcaaacaaatttgagaggtgaagattaagatgaaatttacagatggttattggctcactcgaccgcaatatcagatcaattcgccacaggaagtttttgattacaaagttgatggcaagcaattgatcgcatatgcgccgtacaacaaaattacaactcgtaatgatgaacttaacttagggatgacgaccgtgaagttgtcatcaccagttgaaggggtgattggcgttaagctcgttcactttgatcagctgactaagggtcctagttacgaattatctgatgaaaacccagatgtggatatcaaaaccagtgatgatgaaatttcactgacttctggcccactaacggcgaagttacccgttcggaaggatttcaagattgaatttgaagccgacggtgaaactgtcacgaagtcagaacctaagtccgaaggtgaaatcaccgatacgggcgacaaaaagcactacatgcgtgagaagttatcgattgacgtcgatgaactcatttatgggatgggcgaacggttcacaccatttgttaagaacggtcaagaagttgacattgttcaaaaagatggtgggactgggagtgaacaagcctacaagaatattccattctacttaagtagcaaaggatacggggtattcgtgaaccaaccagaaactgtttcgtttgaagtggcttctgaagatgttgacaaggtccaattcagcgttgaaggacaatcaatcgaatactttgtgatttatgggccaaccccccaggaagttttgaaccgctatactcgcttgacggggaagatcaccttgccaccagcttggtcatttgggctatggctatcaacgtcattcacgactgactacagcgaaaagaccgttatgggttacattaatggcatgcaagaacaccatattccgttggatgtcttccattttgattgcttctggcaaaagggctttgaatggtgcaactttgaatgggatccagaaatgttcccagatccagaaggattgatcaagaagatccacgataagggcgtcaaggtttgtgtctggattaactcatacattggtcaaaagtcaccattgtttaaggaagcagccgaaaaggggtacttcatcaaacgcaaagatggtaatgtttggcaatgggatctttggcaagctggcatggggatcgtcgacttcaccaaccccgaagctactaaatggtatcaaagcaaattaaaggccttactcgatatgggtgttgattgcttcaagacggactttggtgaacgaattccaaccgaagacgccgtgtactacgatgggtctgatccaaaacggattcacaactactacacctacctttacaatgaagccgttttcgacctattgaaagaagaaaagggtgaagatgaagcagtcttgtttgcccgttccgcaactgtcgggtcacagaagttccctgttcactggggtggtgataacctgtcacgttacaattcaatggccgattcattgcgtggtggcttatcattcttgacgtcaggatttggtttctggagccatgatattggtgggttcgaggaaagtgccacccctgatatctacaaacggtggacccagtttggtttgttatcctcacacagtcggtaccacgggagtattgaagcccgggtgccttggaactacgatgatgaagcggtcgatgtcacccggaagtttgtggacttcaagttgtcgatcatgccatacctttacaccgaagcggttcacacggcagaaaccggaaccccattgatgcggccagtcttcatggaatacttgaaggaccggaatgcgtacacgctggacaaggaatatatgcttggtagcaagctcttggttgcccccatcttcaacgatcaaggcaaagccaactactacctaccagccggcaagtggacgaacgtcttaacggaacagtattacgatgtgaccgatggtggtaactggttctcagaaacgtacgatcacctgaacttaccattgttagctcgtgaaaacagtatcttggttcgtaatgaagcagcacaacacgctgattacgactacaccaaggatgtcactattcacctgtacaacatggttcaaggaacaactgaacaaaaagttgttgatgatcatgggcaagacgcagcgaaggtaacggtcacccgtgatgggaatcactttacggttgttgctgatggtctcaatggcaacgtcacggttaaagttcatgaagcaggtcaagtaactgaagaaaaggtcggcgaattcgacatctagtcggtttcatagctccgtttcttgtgggccagtgacgaactgattgaatgaacaagatatataatgaaatgaagagaagggtgcgtaaccgagtggttatcgcactctttttttattattcaacgattttattaatagtgttctccactgcgctgttcctgaataaaaagtcggaaagcgtttacaatgattttgactgtgatataattaaagccatataatgggtaaatttttttgaaatgaggatacaggaaaatggcactaaataagcagagcattagaaacttgaacgaaaaatcggttttgcgccaaatttttgttgaaggaccgatttcacgcattcaaatttcacggaacttaaaattaaacaagtccactgtttcagccatttttaacgacctaaatgatcgacaattagtcatggaaatgggacagggtgaaagtacacaggttggtggccgtaagccagtgatgattaaagtcaatcagcaatacggatatacgattaactttgatattggctaccatcatctagatatgatggcgaactacctcgatggcacggcgttcaagtacgcccggtttgaaactgagggcgctgatattcaccaaatattagcattgatcatcaagtcagtgcgggcgtttgaagatcctggtacggtgaagggtctgctcggcatctccgtggcggttcatgggattgtttatcaacaccaagtgacctactcaccatttatcgatatggaagatgtttccatttacgaacagcttactcagacattcaccgtgccgatcgttgtcgataacgaagctaacttggtagcggtctttcaacgtgatttttcagatgacgatgaacataacatgaataacattgtggtcattagtattcacaaggggattggtgctggaatcatcattaaccatcaaatttatcgtggtgagcaaggggaagccggcgaaattggccgggcggtttatccaacggtttttgccgatcccggtaaggtcgaaaaaattgaaaattacgcgtcccaagatgcaatcattgacctgctgaagaaacaaaaggggttgacgcacctcgacttcgatgaagtcgccgagctatacgcgcaagatgatgcaatcgtggtgaaggccatcgatgattttcgggattacatcaccatgatcgtctataatgccgccgtcagctacaatccggatacgatctacctgagctccaacttaatcgaaaccattgaccaactgctcccgatgattgtggataagtataaccggctccctgaaaatgggaatacggatattcgcatgctgaagggggctaagtatgcgtcgttgcttggcggttgttcagctgtcacccatctggcgctcaagatgtcgaatcaacggttgaagtttaattttgatttaagcaatgcatttgatgattagctcgtgacataaggctgtcactttctgcgctacgtgagtagtgggaaaggacgcctttttttgatgaaattttaggcagtgtccagaagacgatggcgtggtctgaatttcacaaaaactaagcagaaaaagtcgtaaataacctgatgaaaaggcttgcaaaacaaatatgatgcactataataggacatgtaagttggttgacacaacaaactaaacaatgggaggctattttcaatatggcttattggaatgttgataaagtaccctatgttggtaccggagatttaaaatcaggactcggttttcattactacaacgctgatgaagtaattggtggtaagaagatgcgcgattggctacgcttctccgttgcctattggcacacatttgaccaacgtttagtggacccatttggtgatggtacggcaattcgtccatacgacaagtacacggatccaatggatcaagccttggctaaagttgactatgcatttgaattctatgacaaattaggggttgactacctttgcttccacgatcgtgacttggctccagaaggcgacacattacgtgaaaccaaccagaacttggataagattgtggacaagatcgtggattaccaaaagacatctgggatgaaagttctttggaacacatcgaacttatttactaatccacggtttgtggcgggcgccgcaacctcaccatacgcagatatctttgcctactcagcagctcaattgaagcacagcttggagattgggaagcgcgttggttctgagaactatgtcttctggggtggtcgtgaaggttacgaatcactttggaatacggacatgaagaaggaacaagaacacgcagctaagatgttccatatggcgaaggactatgcgaatgaaattggatttgacgcacaaatgttattggaacccaagccaaaggaaccaacgacgcatcaatatgattttgacgctgcaacaaccattgccttcatgaaggaatacgggttggataaggacttcaagctgaacttggaaggaaaccatgctaacttagctggtcacacttatcaacacgaaattcggacagctcgtgaagccggcttgctcggttcattggatgcgaacgaaggcgacaagttgattggatgggatattgatgaatacccttcaaacctttatgaaacaactgccgcaatgtacgaagtggttgagagtggaagcattggccctcgcggtgggttgaactttgatgctaaaccacgtcgttcttcatttgcaccggaagatctcttctatggtcacatcgtcgggatggatagctttgctgccggcctacgggttgccatgaagatgaaggaagacaaagtacttgagaacttggttgctgatcggtacagctcatataagagcggtattggtgcagacatcgaaagcggtaaagcaacctttgccgacctcgaaaagtactcactcgataagacccaaaaggatctacgtgacgcaactagttcagatcatcttgaacaagttaaagacaccattaaccactacattgtcagtgtattgggtaaataatcagtgccttcagcaaggtggaggatgggcaaaacccaccctccattttgttagttaagatcaaaataatggaaatagaactgtgaaacaagctggagctctcgtagtaatctggtttgcacaactcaactcaggaggaatttaatatgagctacgtactaggtgtggatttaggaactagcgcggttaaggtatccgccgttgaccggaacgggaatatcgtcgcccaacaaagtttcgattatgaattaagtaaccccaaaccaggttacagtgaacagaacccagaagattgggtttctgggactacggtggccatcgtgcgcttgattttgaaggatggaatcaaaccggaagaaattgaaggaattagttactctggtcaaatgcatgggcttgtcttactggacgaaaataaccaagtattgcgtcctgccattttgtggaatgatacccggacgaccaagcaacgggaagaaattttagagactatgggtgacgagtacatcaacattacccggaaccagcccctcgaaggattcacattgcctaaaattttatgggtgaaggaaaacgaacctaatatttttgctaaggcgaaaacgttcttgctccccaaggactacctgcgttaccggatgaccggaaaaattcaaatggaatactcggatgctgccggaacagtcttgctggatgttgcgaagaagcagtggagcgaaaccatctgcaacaagttcggtatcccagtttcaatgtgcccaccactgatcgaatcaatcgggtatgcgggcaatatttcagaaagctattcactgttttctggcatgtcaaccagcacaaaagtcttcggtggcgcggccgacaacgctgccggtgccgtgggttcaggaatcttagcacccaacatggtcatggctagtatcgggacctccggcgtggtcctcaagtacgaggataactcggacgttgactatcaaggtaaactgcatttcttcaaccatgccattccagataagttctacacgatgggcgtgacattagctgccgggtacagtttaagctggctcaagaagacctttggcccgaacgaagacttcactagttttgtatcaacggcgggtgactcaacggtcggtgccaatggattaattttcacaccatatatcgtgggtgaacggacaccacatgccgacgccgacatccgtggaagctttattggggttgatggcacggataagcggtcggactttgtacgggccgtcttggaaggaatcatttactcattcgctgacattatggatatcttcgaagaaaagggccaagactttgacaccgtcgtttcaattggtggtggcgccaagagtccgctctggcttcaaattcaagccgatatcttcaatcgtaaagtagttagcttgaagaacgaacagggaccaggaatgggggctgcaatgttagcagctgtcggcctcggctggtttgataccgtgcaagattgtgccaaggaatttgttcacttcggcaaggtttacgaaccagatgctgaaaacgtgaagaagtaccgtgaaatgcaccaaatctataagcaagtttatgaggccaccaaagacgtcagtcaccaacttttggattaccgacgtaaatattagtcgttcaagataattttcacttaaatgcgtgataatatacaaaaaaacgttaaatacatcataatgatgaatatttaacgttttttattgcataaatatcattattgaactaaagtatacgtaagataatagttgatgataataaaggagtggcattatggatagttcaattttaaccaaccggtatcagcatccggcgccaaatctgttagcgcaaattgggacgcttgcagcaaccacacaagatgcaattgatttgtcgattggggatccagatttcaaaacccccgatgcagtgatcgacgcagctttcgccaagacgaaggcggggatgacccattacaccgaagcaagcgggttgccagaattacgggcagctatccagacgtactatcaaagtaagtatcagttgtcgtttaccatcccccagattcgggtgacggtgggcgcgtcacacgcgctgtttattgcccttgccgcactgattaatcccggtgacgaggtcattgtgccggaaccaagcttttcaccctatcccgaagaggtaaaggtagttggtggggtccctgtgatgcttgatacccggccagaggagggatttgcgattaaacccgctgatgttgctaaactgattaccgataagaccaaggcaatcatcattaacacaccgaataaccccaccggcaatgtgatggaccctgctgatgcccagcagttagcgcagcttgctcaagaacgtggcatttttattatggccgatgaggtctattccgatttcttattaggagatcatcattttacaccaatggcgacttacgcacccgataacgtcattacattggggagcttttcgaagagttttgcgatgacgggctggcgaattggctatttgatcggacccgaatatctcacggaagccgcccggttagtcaatgaagggatcacgtattctgcccccgcaccgtcgcaaaatgcggcactgtacgcgcttcaacatgcggatgagattattccagaatttgcggcgacctttgccaaacgcctgacctttatcaaggaacaagtggcccagattgagtggctcgatgtatcgccgattcaggggagcatttatgcgtttgtggatattcgtcagacgggccttgattcggtaacctttgctgaacagctactgaaaaaggcaggaattattgtgattccgggattagcatttggacaggccggtgaaggctttgtcagaattgccgccacgcagccgctagaggtcattaaaacagcgttcgataaaataaaacagttaagcccagctgattttaaagcgtaataggaggagttaaaggttatgaaaattattatgtacagtgtgctcgccgaagaaaagccctatatcgaggcgtgggaaaagaaaacggggaatcaggtgacccagatcgaagaccgcttaacccccgaaacagtcgaactggctaaaggttacgacggaatcgatatgcaacaaacaagtgatgtgaaagacccaatcgtatacgaaaagctcgcttcgtacggaatgaaacaactgacgggaagaatggttggatatgaaatttttgatctggatttagccacccaaaacggattaacggtcaccaacattcccgcttattcaccacgggcaatcgccgagatgggcgtcacgcaggccatgtatttgatccgtaatattggttacttccagcaacggatgagtaatggtgatttccggtggaacgggatgattagtcaggaaatccatgatttgaccgtcggcatcatcggtgcggggcacattggtggggcctcagcacaattgtatacggctttgggggccaaggttttagcaaccgatcccgtttataacgtggaacttgaaccctacttggaatatacggatttggataccgttttgacccagtctgatatcgtgacgattcacacaccattgaaagaggatacgcgtgaattgatcaacaaagatactttgggcaagatgaagaagagtgcgtactttatcaatatggcccgcggggggctcgtgaacacccaagatttgattacagccctgcaaaaccatgaaatcgctggcgcggcgcttgacacaattgcggatgaaacggaattctttgagacacagatggatccgacgaaaaccccgcaagattatcaaacattgcaggcaatgcctaacgtgctgatgacgcctcactcagcttattttacgaacaaagcggttaaaaacattgtggaaattgggttgaacgatgtggtgatgattgtgaacggtcaaaagagtccccacgcgttgaactagattaatggtctggtaattttcccgcaagttttctatactaaaacaatatcgaaaaacgggagaattgaaaatgatcaaacttattgtggccttactgctaatttttgcgctggggttattgggcctaattatctggcaagttatcaagcaacgtccgaagatgacctggcgtgatcagttactggggttcggcatcggtggcctgacagatttcctagataccttagggattggaagcttcgttacgacaacgaccctgtttgggtggacacactacctcgatgatgagcgacagttaccgggaacgatgaatatggcccacgcgatctcaacggtggccgaagccctattctttgtgacggcggtgaaggtggacatcctcacgatgggcgccatggtgattgcagcaattatcgggtcgttagttggcagcgaggtggtcgtcagaatgaacgccgccgtgattcaaaaaacgatggcgctagcattaattgcgacctcgattttgatggccattaataagatgggctggatttcgatcattgccgttcacaatgaagccctcgggctaaccggttggccgctggtgatcggggtggcggggaactttgtgctgggaatgttaatgtcggccggtgtcggtctgtacgccccttgcatggtgctcgtttacttcctaggattgaagcccatcgcggcctttccgattatgatgctatcgtgtgcgatgctaatgccaagtgttagcgtcaacttcattcgcaatggccggttttcacttcgtggcatctttgggttcattgtgggcggcatcgtcggggttgtgattgcggccacggttgtcaagagcatgtcgctggaagtcctgggctggttgatcgtagtggtgagtttctggaccgcttaccagctctggcgcagtggaattgcgtctagtcgccagataaaagcatcaaagtaaataaaaacgcgcttggaaattgtctaaattttccaagcgcgttttctaatcactatgattattgttgttgatatttggcaaatcgttgttggtcggtagcagagagttctactttgagctgcgtaccggttgcgaggtagtcggtgctgataatatgagcatggtcgttgaggtacgacacgacttcaccatcggcaaatggaattaataactctactgtgacgtagttggtgaagagatgactcttaattacgccaactagcataccaagggactgttcatcgcgagctgataaaacaacctgatcgtcgccgtccatgacggggaactgaacttccatcttatccgccttattaaagacgaggatcatcgggatatcttcaatgccaatttctttcagggttgcggcagtggttgccatcatttcttgatagtgtggatctgagtagtcgatgacttggatcaataaatcggcgtttgcggcctcggccagtgtggacttaaaggcttggacgaggtgggtcggtagcttgctgacaaatccaaccgtgtcactcagcaaaaactgtttttgatcgggaagggttaactgccggacgctagtatccaacgtggcgaataacatatttttttcgaaaacttgtttgtcatcatcgataccaaacatccggacgagaccattcatgatggttgatttgccggcgttagtgtagccgacaagtgcggctgttggaatgccacttttagcccgttgttggcgttgcgtagtagccgatttattaagttcggcgagttcgccccgcaaatgggtaatcgcattttgaatagtccgacggttcatttcgagctttgtttcaccagccccacggttggtaaagctcccaccaccggcaccagtttgttgatccaaccgttgattagcgctggtttttaggcgtggtaggcggtattgtaactgggcaatttctacttggagtttggcttcccgagacttagcacgtttggcaaagatttcaagaatcaaagcggtccgatctaaaatgcgggccgtcgtgttttcctcgaggttacgaatttggctgggtgacagctcatcgttggtgaccacggtctgaacaccagttgcggtgatcagttcggcgagttcttcgacctttcctttaccaaagtaggttgcggcgttgggacggtcgagcgattgcacgaggcgatcagcgacggtcatttcgttggcttcgattagattggcaagctcttccattgagtagtcaaaatcgacttgttggttagctaaattaagtccggcaatgatcaccggttcggttgttggttgtgtatccataagtacctcctaaaatgtgaaagatggcaacgaggtgcattggattttaaattggcatcatcgcaagctcctttatgagttatggcagggttaattgattataaaagtcaacgtcagtggtggtagcggttagggtaaccttggtgatactgccgttagcgggcgcgacagggggaatctgtttggcgtacttactgatgatggaacgaatagcggtgccgtgggacaccaccaaaatcgtactgccatcgggaaactgccgcagtttatcgattccgtggccgtaacgcgtccagaaggcgtgatcatcttccgcatcgtgaaacggatcgtttttagcgattaagtcgcgcgtcccttcgagggtgtagcggtcgacgaactgttcgaagcgcgtgagcccatcggccttaccgatttgtttccaggtgtccggcccgatagcaccttcgaagaagccgaaaaattcttctcgaaaggccggttcttgaatgggatcggtaaggtcactgacgttagccgccagaattgttcgggccgtgatgacggttcgactcaggtcactgctataagcagcatcgaagtggacattcttgagttggtcagccacccgttgggcatcagcgcgtcccttggcagtcagtggtgcatcggaccacccctgaattcgatcgtacaagttcagataagtttgtccgtgacggacaaaataaacgttaattgacatagtactggtctcctttaaatgggatttaacggacgttcattgcactaatagtttaccatacttactgattcgaatggctggagaagtgttcatgatgctagatcgtgttaagccgtccgagtgcttgccggatgaggggcgcatgttccttactaccagtgaagataagacgatcgtttaattcaattgcggtgtcgcccgaaggcttaataaagtgtccatgacggtagatttgactgatggtaatttcactcacaaacgggagatttcgaatttcggtccccgtgtagcggaggttccgaacggttacttcgtaaatgccagattcggtactttgaagcattcggagtgtcgatgggacttcaatcagactccggagaatactgatgttcgcctctggcgtgctgtaaacttccacaccggcgtcaatcaattcatcctcggcattgttaagaatattacgatcttcgaaccgcgcaattacccgggtgacgcccattttcttggcggctaaggcaagacggtaatttttcatggcatcaaagtgtccgagaacgaggatatcggttgcgaaaacgtcttgagcaacaacatcttgtgtttccaggctgggtaagagggccacgttaacctgactattgtaggcatggtaatttttttccttatcggtgtacatcttgatatcgtagttgcccttcgcgagctgttgcgccacgggaatcgttgcgaggttagtaccaatgaagtgcacaattgtgggcttgagcgtttctttttcaggttgaaagtagtggttgaaaagcagtggtgcgaggatgcaggtgatgatggcggctagcgtaaaggccccggactgttgactggtcaccgcgtgcatgcttttcgcgactttcaggaccgctaataccagtgtaatcgtggccgtattcagggccgttccggcaaatgcgttggccgtggaaaagcggcgtttcagaattgcatagaccagcaccttagctgccaagtatgcgataaagaagagtggaattaagatgagggttttgggatcttggacgagttgggggatgttcagggtcgccccactcataatgaagaagatcggaattaacagcccgtagccaaatgaatccaatttatcacgggtgtcttcatgtggttggagcagtttaagcacaataccagccaaaaaggcgccaaagatactttcggcccccactgattcggcaattgcgaccaaggtgacgatcaagaaaaaggccagccggatgtcgagttgcgtggtggatttattgattcgttcgaaaaagctaaagaaccgccgaaaccgtttgaacaaaatgacggctgctaaaaatagcagacaaatgagccaaagcgagtggctagaagaaccaaaggcggccgcgtaaatggtcagggccagcattgggacgacttcacccaggacggcaatcaaaaggacggtttgaccaaatggtttgctgaggagctcgcgttccttgagcgtggcgataacgactccgaggctgaccgtggcaaaaaggatggccgccaaccaaagatcgctgaagaggccggtcaccttgaacacgatcgcaatcagcaatgaaagaatcacaattgagagatacgaaaagctggccagctttaagggtgaagtggcctgttgagcttgcttagtgcgatggggttgccgttgaaaaagggaaaagtcaatttccatcccacttaaaaatagcagcacgatcacgccaatatccgagagggtgttgagtgatgaagtggcactgacaatgttgagggcgctttttcccagcagaataccgacgataatttcgacgactgcggtgggaagcgctgagattttgaacttcgccatgatgagcggggtgattaaggccgcaaacaagacgataacgagcgaaagttgatccaatgttattgctccttgagttgaattaattgattgtaaaataaaacgccactagtataacaaaactagtgacgacttgatacagattagcgggtgaaattacgagaaataatgtggcgccgaatgtgacggacaatccaaaagagggtggccggcgtaatggcgatgagcgcaatgcacatgataatgagggccaaatgggcctgcacgaaaggaatcgtcccgaaaaagtagccgagggcgctccccacacatacccaaaggcccacacccaagaaattggcaattgtaaagcgggtcagtttgaaccgggaagttccagcaatgagggggacgaaggtccgaatgagcggaacaaagcgcccgaaaacgacggcgagaataccgtatttttggaaaaaacgttcggttcgccgcagggtatgacttttaacgtgccggcgaaagaacgaccattttaggagacgattgccgatgtgaaagttgaccgtatcgccgatgacggccgcggagaagaaaacaaaaataagcacaaagatgttcagttctgatccggcaacggccgcgagggcactcgttaggaaaatcagggattcgccaggtagccacgggaaaacgaccaacccggtttccatgaagatcagcatgaataaaatcagatagctccacggtcctagccagttgaccattggtaaaatgacgtcatttagatgtgacaaaatatacatcacctgatccattagacgggcctccactcgcttaatttaatattgatgaaaagcgttttcaattgtgattactcctattttaaggagttttgtgcaaaaaaactaccaatttgctgaacatttaacaattatttgagaaactaaccggggaaactaagtgatcgtatcgcttgatgatattagtgaacatgatataattatttaattacttttttacgggggcgtcgatttggcagattcaattcaagattacgaacaagaacatttaaatgaagtaattgataaaattcaattagctgaagatgcggcaaagaagaatattggcacggctaaaaaggatgtcgacgatattaattctcaatttgacgatattcatgtcaataccacatcctattccgggatgatggacacagcgatgtcggtccgccaacaacagcaaatgctggcagagcgggaaggtagttggcaacatgccaaccagaaactacaaacattacagaaactggcacaaacgccatattttgcccggattgatttccaagaaacgggcgaagaacacccagaaaccatttatatcgggttggcaaccttcaccgaccgaccggatcattttttggtgtatgattggcgcgcacccatttcaagcgtctactatgatggtggactcggagagattagttatcagactcccgatggcacgcaaacggtcaatgtgagtttgaagcggcagtttcaaattaaagacggggccattgtcaccatctttgacactgatgaaacggtcggcgaccagatgttgctggaagcgttgggaacccattccaacacgaaaatgaagagcatcgtcacgacaattcaaaaggcacaaaaccaaattattcggaataccgatgcccagttactctttgttcaaggggctgctggttccggtaaaacggccgcggtcctccaacgggtcgcttggttactataccggtatcgagggaacctcaattcgggacaggtggtcttattttcaccaaaccaattattcaatgactacatcaatcaagtcttgccagaattgggcgaacagaacatggtacaaatgacctacttccagtttgctaaccgccggctacccaatatgacggtacaaacgctgcaacaacggtttgaggccgatcaaagtgcggctgcgcaaaagattaccgccttgaagacgagcttagccttctttaaggccacgaaccggtacgcacaccacctggaaaaagatgatatgcgattccggaacctcatgtttgacgggaaggtcttcatcagtcgtgaaaagattcgcgacatctactattcattcaaccttaactatcacttgggcaaccgattagacgcgacgaaacaggaactggtcaagatgctcaatcaccgaatcagctcggagatgcgttctaagtgggttgaacagaccgtgcaatcgctcagtaagcaggaaatggacgcgttgtttggcgaccagccgcgtgaattcgaatccggcgataaggaattcaagttcttggcccgccaaattgtgattaaggcgttccggcccatcaaaaaagcgatcgaccataaccggtggatcagtattaactctcaatttatgcacttcatgcgcgtggcacctaaattagtgaacctcgaaaagtatggtattaccgctgccgagtgggatgcgcacgttgatgcgacatacgagaagctgaaaacacggcatttagatgccagcgatgtgacgatctatctgtacctttacgacctgattactgggaagcgtggcgaacgcgatatccggtatgtctttgtcgatgaggtgcaagattacgatgcctaccagttggcctacttgcagtttagttttccaaaggccaaatttaccctcctcggcgacttgaaccaggccatctttaccaaggaaaatagccgctcattgctaggtcaacttgggaccatgtttgatcccgataagaccaaggtggtgcaattgacgaaatcctaccggtcaacgaagcagattaccgaatttacccgagccattttgaaaaatggggaagccgttgaaccgtttgaacgacaaggcgagttgccaaaggtcatcgtgagcccgacattagaacaggctacggatcaagtcatggcgacgttgaagcaggaacgtgccgaacaggatacgacggccatcattgggaagactttacaggacagtgaagaaatttgcacacaactacagaagcgtggtgtgcaagtgacactgatcaaaaccgagaaccaacggctagtgcaaggcaccatcgttgtaccatcctacctagccaaggggttggaatttgacgcggtcatcgtgtggaatgccaatgctcagcagtacgtcggggatgatgaacggcaattgctatacacgatctgttcacgggccatgcatgaactgacgatgatcggcatcgggtccatgaccagcttgattgatcaggttccgacagatcagtacgatttaattcaataactaatgcagactggaaatgttaaaatttctggtcttttttgatgatccggtaaaaagccagaccaaattcggtacaatagggcatgtgaaagtttgactaaattctaaacatttaggaaatattgtgatattaaattgcctttaacgtgaaatacggtatgataggacgtggcgatatttttagatggaggaaagattatgaaaactgtgttgcagaaggtaaggtccggtttgaattccaagcttggattcttcattctcacggttattttgtttgcgattaaggatggctgggcgtacgagaacaagttcgcactaggagccgttggtaatgttcaacagtttctgttgtggtttaacgcatttccaggagcgatcattttaattgggatcgcgctatatttccggggccgattgtcctattggttgatgattttgattgatgcaatcttgtcaacgtggttatttgctaatattctgtactatcgtgaattctcggattttattacctttaacttgatttctggctcaggctcggtatcgaataacctcggtaagagtcttgccggcatttttagaatgtcagacctgtttgtgtataccgacgtggtcattttgattctggtactcgcatttaagctgattcgaatcgatggtcgctactttaagcttcgatatgcaggtgtgattaccatgcttggggtgctcctgtttggcgccaacctggggatggcggaaggtaaccgttctggtctgttaactcggacctttgataacaactacattgtgaagtacttaggacttcagttctacacggtgtacgatgcggtcaagacgacgcataacaacgaggtgaaatcaaaggcgagttcttcggatctcaaaccagttcttaatttcctcaagaaaaataaaacgaatgctgatatccaatatcaaggggtggctaagggcaagaacgtctttatcattcacctagaaagtctgcagcagttcgtgatcgactataaggtcgatggcaaagaagtgacaccgaacctcaataaaatttaccatgctagcgatacaatctcatttgacaacttctttaaccaagttgggcaagggaagacgtcagatgctgaattgatgcttgaaaactcgctgtttgggctttctgaaggatccgcaatgacgattgacgggacgacgaacacgttccaagcagcgcccgcgatcctaagtcaacagcaaggctacacgaccgcttcgttccatggggatgtgccaagtttctggaatcgggataacgcctataagtcatggggatacgactacttctttagtaaatcattctatccaaacgtgaagaacgatgaagaaggttacgggattaaagacaagatcttcttgaagggcgcggcaaactacatccagcagttaccacaaccgttctatgcgaagttaatcacggttacgaaccactatccatacccactggataaggaaaacatttcgattgatcaattaaagacgggcgataatacggttgatccatacgttcaaacggcgcactacttggaccaatcaattggtgagtttatgaactaccttgataaatctggcctacggaagaatagtatgattgttctttacggggatcactatggtatttcgaacaaccataagtctgcgattgctgacatcctcggtaagaagaaggttacgaattacgatctagcgatgttccaaaaggtaccgtttatgattcaaatgccaggtctcaaggggggcattaatcatacttacggtggtgaaatcgatgtgttaccaacgattgaaaacttgttgggcatcgactccagcaactacgttcagttcggtcaagatttgcttgcgacgaacagaaagcagattgtgtcgttccgaaacggggactttgtcagtgctaagtacaccaagtacggcggtgacgtctatgatacgaagacgggtaagaaactgacccatatgactaaggcacaaaaagcggcggtcgaaaaggatcagaagtatgtcaccaccgaactgaatctctcagataaggttgttaatggggatcttctccgtttctaccatccaaagggcttcactaaggtgaataagaaggactacagttacaacttgaataagagtttgaagaagctcaaagaagctcaggaaaagaagaagacgagtgttgaaagcgaaaacggcggtaagtcgacgcttgacgaatacacaacggatgcgcctgaactccaaaatgttgacgcgaaggattacaccttcccaacggcaaaataggtttctacaaaagggtcggaagaagataatttcttaccggcccttttgacttacacataaacgtgtttgtcggcggtgggtatgttagaatacttgtaatttatgaataaaatgaggttgcgatgatgcaggatcgagtcaattattttcagtttgatcgtggtgactggggtaattttagtgctgacgaccacgttgaactaactcaggataatttaaatcagattaaggcgttaaacgatcggatctcactcaatgatgtgagtgaagtttatctcccactagtgaaactaattaagttgcagtatcaacagtatcttaagtggcaggaccaaaaggcggcgtttctcaaaatgccggcccgccgagttccctttattatcggcattgcgggttctgtagcggttggtaaaagtaccacggcccggctattatcactcttattgaaccggctgatgccccagcgcaacgtggaattaattaccacggacggcttcttgtacccgacggcggaattgaagcggcggggaattttgaaccgaaaggggtttccggaatcctacgacatggaagccctgctcacgtttttaaacgatgtgaaagctggtgtggatgttgtcgaatcacccgtctactcacatgcgacatacgatattgtgccggaccaaaagcaaaagattgtgcagccggatgttttaatcgtggaggggattaataccctgcaacttccgtcaaatcagctcctgtacattagtgattttttcgatttttcggtctatgtggatgccaatccggaactgatcgagaagtggtttatcgaacggttcgaactattactagattcggcttttcgggatcccacgaactattattattcctacgcgatcggtgatcgacaccaagcattcaagcgggcgcataaaatttggcaagatattgacctcgttaatttgaaccggtacatcttgccgacgcgcaaccgggcggatgttatcttgcataaaacgaagcaccatttgatcgataaaatctatttaagaaagtaaacggttttaatcatgagaccgtcctaataatcattgacccgaacgaaattaacccgtaaaatggatttcgttaggaaaatttatcaaaggggtggcaaacattggctaacgttaaccttgatgcgttcgacaagattattgtcttggactttggtagtcagtacaaccaactgattacgagacgtatccgtgactttggtatctattcagagttaatgtcacataagacaactgctgaacagatcaaagcgattaacccaaagggtatcatcttctctggcggacccaacagtgtgtacgcggatgatgcattttcagttgatccagcaatttttgaactaggcattccaattcttggaatttgctacggtatgcaattgatggcatacaagttacaaggaggcgcggttgaaaacgccgacaactctgagtatggacacgcagatattgaagttaccgataaagacgcagtgatgtttaaaggcctgcctgaaaaacaatatgtttggatgagccatggtgacttggtaaccaaagtaccagatggttttaaagccgttgccaccagcaaaaactgcccaatcgcctcaatggcggatgatgatcgtaagttctacggtcttcagttccatacggaagtccaaaataccgaatacggtagtgaaatcttgaagcactttgctttcgacgtttgtgaagccgaagcaaactggacgatggatgacttcattgaccttcaagttgaccacatccgtaaagaagtgggcgatcgtaaagtcttactcggcctttctggcggggtggactcaagcgtcgtgggaaccttattgcataaagccattggcgaccaattgacttgtatcttcgtcgatcacggtctgctgcggaagaacgaagctgacgaagtgatgaacggcttagctggtaagcttggtttgaacatcatcaaggtggacgctcaggaacgcttcttgagtaagttggccggcgtgagtgatcctgagaagaaacgcaagatcattgggaacgaatttatccaggtcttcaatgatgaagctcagaagcttgatggtattgatttcttggcgcaaggcacgttgtatactgacgtgatcgaaagtgggacggatactgcccaaacgatcaagtcccaccacaacgtgggtggtcttccagaagacatgcactttgaattgatcgaaccattgcggagcttgttcaaggatgaagcccgtgaattgggtgaaaaacttggtatgccatacgaacttgtttggcgtcaaccattcccaggtcctggtcttgggattcgggtcattggtgaaatcaccgatgaaaaattaacgattgtgcgtgacagtgatttgatcctgcgggaagaaattgctaaagccgggcttgataaggatatctggcaatactttaccgttttgccaggcatcaagagtgtcggtgtcatgggtgacggtcggacatacgattacactgtcggcattcgtgccgtaacttctattgacgggatgacggcggacttcgcgcggatcccatgggatgtcttgcaaaagatctccgtgcggatcgtcaatgaagtggagcatgttaaccggattgtgtacgattgtaccagcaagccaccttcgacaattgaatgggaataagacactaaatgaatttggtgtccgaataccagtaattgacgatttggaaactgtatctgattcaaaaataatttaaattaatatggtagtctgctaacctagtaaaagccagtccaaagaaatttggactggcttttactctgtaaacgaaaaaattatgaatccacaataacaatgaatgagtcatctgaacgcttaaacttttacgtgttattttgataaatatattggcatagtagagaattatttaattaattttagagaagtgcttgcctttgagtcgactccaaggtttatgatatggacaataaaaatttaggaggattcaatcatgaccattcaaaataaagtagtcgcaattacgggagcatcatcaggaattggttcagctactgcccagttgttggcttcgaaaggcgccaaagttgttcttggtgcacgtcgagagagtaaacttaaagagttaacaaaccaaattatcgcagcgggtggtgaggcagtttatcaagtgactgacgtgaccaatccggcagacaatgaagcgctagttcagttggctaaggataagtttggtaagttggatgtaattttcttaaatgctggattaatgccgaactcaccgctttctgaacttaaagttgatgagtggaatcaaatggtggatgtcaacattaagggcgttatgaacggaatagcagctgtgttaccaacttttaaagcgcaaaaatctggtcacgttattacaacatcatctgtggcagggctaaaggcctatcctggcggtgcaatttatggtgctactaaatgggcggttcgggatatgatggaagttctgcgtatggaatcagctcaggaagggtcacacattcgtacagccaccatttatcctgcggcaattcacactgaactgttaaagactatcacagataccactacagccagtggcgcgaaagatgtgtatgatacctatcaaattgggcctgatcgagtagctaatgttattgcgtttgccattgatcaaccggaggatactaacgtcaatgagtttacggttggaccgactgatcaaccatagtaggagtagttaaatgaaaataaaagaggtctcacaaaaatataatataccagcagataccttaagatattgggaacggcaaggcgcaataccaccagtaaatcgggatgaagctgggtatcgagattatgaccaagaagatatggattgggttagctttgctcaatgtatgcgtgaagctggtgttagtattgaatatttgatcgaatatatagaattattcagaggtgggaagaaaaccttagaagctcggaaagaccttcttagagaacaacttaaagtgattaaaaaacacttggatgaggttcaaaatacgtatgacctaataagtaaaaaggttcaaaattatgagactcatgtcgagggttatcacggtaaacttataaaatagatgtcacaagaataattactgatagtggtaagttagaattcgtagattgtatcctcatgaccgcattgtatcatccagctaaaggtttaaattttcagttataaagaatttaaaataaaaagtactaaagccaactcagactttagtactttttattttctaattaagtttaacaaacgtgtttagcatcctctaaatcagagaagccggccctagtgacacccggccctaagccgagtcctgaaagaagcactattcgccgtcattgaagctactttcaggttttacttcgttagcatactgttgaacttcagccttctgatctttcgtactatagtagtcgctttcgaggctggctagtgtggtcgtggtggacttgaagtagccatccgcaactgaatcgcgcgcggtccacactttgtacgtgacactatctccactgactttgtagtaaatataactggttgggtcaccgttggcggtcatgtagctgtaccccacgacttcgtcaccaaaatcattaccggcattaccataccacattccattattattggcgccttccttaaaccaatcggcatttgcccgcagagaaacgaggacgccagccgttttatcgtcaagcgtagttgtttgactcgtgatgctagtggccgattttgttgaggtggtagtcgaagtgtttttagcgattttactgaaagcgttggaaatatcttgattggctgagtctctaacatggagtccgccaccaccgttagtttgatcagaaacgagagtgtagggctgcccgttcttgaacgcaaacaagtaaagatagccaccaggccgattatcgatagattcgacatctgaatatacggcgacaacatggaaggtatcagtccccgttccagtaccgtcctgagaaagttgagcggaatagttgtgtccgttatagacaagcttcgtgctggcaaagtcactaggaaagtggtaaccgtaaaaattgacatcgttaccagtggtatattcctgatacgattggttcatcgttggtccccatgtcttgatgtaacttcgtaattgggacgccttggccgtgttccacagtgtggccgttgctttttgactagtggcatgcttgctggaagctgatgttgccttagtagaactgacagcagattgtgatgttgacttttgcgaaccgttgctcgtgccacatccagtaagtaagatggtggtcgccgcgaccgtcgttgcgatgagtttaaattttcccataaaaagtaaccctccccaagatttcattaatgttagtataacgcaaacctgaaaattatcgattgcttgagaccagattaagtcacttaatcgattaactgatttctattcaatatcgagcgcaatcctcagacttaaaccgcgcgttggcgtataatggacgtattctaaattaactgggggatcaaatatggctgaaatgacacatttttatgaaactttccaaccaacacattacaatgtgtacttggaaattaaccgccaaaataaacaaatcagtggtctaacgactgttactggggatgcaaagcaggaaacaatcagcattcatcaaaaagatttgctcgtggattatgtgcaactcaacggaaaacgcattcggtttgtcagcgataatcaggctgatgcaattcgaattaaccttggtcaaacggggaacgtgacgttaacgattagctatcgggcgaagttgaccgattccatgatggggatttatccgtcatactacgaagtcgatggcgttcaaaaacaggttattgggactcaatttgaaacgaactttgcccgccaagcattcccctgcgttgatgaaccagaggcgaaagcaacgtttgatttagccattaaatttgatgagcatcccggtgagaccatcttgagcaatatgcctgaggtgcggaccgaaaacggggttcattactttgataccacggttaaaatgtcgacgtacttgattgcatttgcctttggcgacttgcaaagtaagttgacgacgactaagagtggcgtccaagtaggagtgtttgctaccaaggcacacaaggcgaatgaacttgattttgcactcgacattgccaaacgttcgattgaattttatgaagacttttatcaaacaccgtatccactaccacactcctggcagatggcgttacccgatttctcagcgggcgcgatggaaaactgggggttagtgacctatcgtgaagcatacctattactggatccagataacacggcctttgatacgaagcaattggtggcaaccgtgatcgcccacgagttagcacatcagtggttcggtgatctggtcacgatgaagtggtgggacgatctgtggttaaacgaaagctttgccaacatgatggagtacgtggcgatcgatgcaatcgaacccgactggcatatttgggaacttttccagacgtcagatgtaccagccgccctgcagcgtgacgcaaccgatggggtccaatccgtgcacgtgcaggtcgaaaacccagccgaaattgatgcgctgttcgacggggcgatcgtgtatgctaagggcgcacggatgctggtcatggtgcgagctctaatcggggatcaagcactacgcaccgggttgaagaactactttgaactgcataagtatggcaacgccacgggtcccgatttatggaattcactggccatggcgtcgggaattgatgtgggcacaatcatgcaatcatggttggaacaacctggctatccggttgtcactgccgcggtcgaggatggtcagttgacgctgtcacaacaacagttcttcattggcgccggtaaggatactggtcggcagtggcagattccattgaaggctaactatcaagacgtgcccggcattatgaccggaaagcacattgtgattggcgactaccagcagttgcgagcgcgtgaagggcagccgttccggttgaacctgggcaatgagtcacactttatcgtgaagtatgatgaaacgctgatggccgatctattagaacatgtgactgaactggacgctatttcgcagttacagctacttcaggaccagcggttattggcacaggggcgtcaaatttcatacgccaccattgtgccactattgacgaagtttgcggcgcgtcacgagactattgtgaacgacgctctatatcgggtagctggcgatttgaagcagtttgttgcacctgattcggcgcaaaaagaccagttacagacgttgtttgatcagctcagtgcccaacaagtggctcgcctcgggtggacgactaagacgggagaatcgcatgacgatcaattaacgcggccgtttgtattacgagcatcgttgtacgccgaaaatgcggcgacaattgcggcagctcacgatatctttgtggctaaccgtgaccagctggcgacgttagcagccgatacccggacgctaattttagccaacgaggttaaacactttggaaccgcggccttgtttgatcgattactcgatgagtatcggcaaaccagtgatgcaagctataagtctagcatttgcgcagccttgactggcacaacggacccccaactgattacgaaactaattcagcagtttgaggatccgaatacgattaaaccccaagatttacgggcttggttccgggggactttggcgaaccctgctggtgaacaggctgcctgggactggattcgtaaggattggggctggcttgaaaagacggtgggtggtgacatggaattcaccacttacattacggtcatcgccggaattttcaagacggcagcacggcttgccgaatttaaggcgttcttcgagccgaagattgcaacaccgggactcacgcgtgaaattacgatggatatcaccgtgattgaaagccgcgtacaacttattacagatgaacaggcggcagttaatgcggccgtagcagcaaccattaagtaacaaaaaagaattcgatgaaacaaatcgaattctttttttgttacgcctatttacatctagtttgtaaaactatataatatcgtcaataacattatatagaattggagcgcactcatgacggaaaaaattgcgattctcgttgattcaggatcagatgtcccacaagcagttgttgatgccaatgataatatccgcattgtcccattaactgtaacgatcgaaggccaagactatcaagatcgggtgaacttaacgcccgatgagttttatacccggctacagacggtttcgacactgccgctaacggcgagtccagctcctgaacaagttacgactgccgttcaaggtttattggatgaagggttcaccaaaattttaggaatcaccatttcgagtggtctatcggcgactcatcagacctttcgactcgcggcggagcagtttgattcagatcaggttgtgatgctggatacaaagagcgtggggattggcagtggcttgcaggccgtttatgcgagtgagctgattaatcagggctactcatttgaaacggttgtggctaaggtgacggcatcgattgccaagagtcacgtttatttctacatccccacattgaagtatttacgagcgggaggccggattggccgagtatctggtctcgtcggcagtgccttgaaaatcaaaccagtgatttcgtgtgatccggaaggaatttactatccgatcaccaagtcacgctcagaaaataaagctgttgctaaaatggtggccctagtggccggtgattttgcgggacagcgggggcggatcgccgtagctcatggtcagaatccagcgttgttggcgcaagtatcggcagcgttgcaggaacaaacggggcatgcagtggattatcaaggtgatatttcaccgtcgttaggcgtgcacaccgggcccggcctcattggtgtgggggttcaaatcgaagcctaaaaaacttgctttgggggtcaaatcaggactaaactaatgactatcatgcgtacactatcaataggcttgaacgataccgacgatttttgatcgatgtcagctgacagtgtgtccgttttgaagacggtagttggcgtagtgatcaaactctgttaaaggatgggattacaatgtcaacgaaacaacgtttatttttaacggctgaaatgtgcctcggaatggggtccatcatgagcctaatcggtaatttgtttgcgatggggtggaccacgagcgccttccacgcgtttttcgtgtggtgggttcagacgatcgtcgtggcctttatctataatttgatggtggctagtaacataacgaactggctgattagccgtgctaccgtgggactcacaggtcaggcacttcttaaaaagagtagtcaaattcgaggctggacgatgattgtgatcatgtgtttcagcatgtgtacttggggccaactgacagccggtcagttgccagcaattggcgtgacggggttactgataacctgggcgcgttcgtttattttagcctacatcgtgcgtggaattttggtaaagcccttggctatgcgcatcatgttaaaagtggtgcccgcttaaaaataaattaatagtgtcaatgactaattgtccgccgattctggcggattttttgcgtatttaagtggtaggtgattcgcaatttagttgtagatcatctaatatagaggacggactatcaaataaaggaatgagaaaatgacgcctcaaacaatcttgaaaagtaaatttggttacgatacctttcgtgccgggcaagaagatattattaatacgattttagaacggcaaaatgtgttggcgattatgccaactggtggtggtaaatcaatttgctatcaagtaccggcactgcttgaagacgggattacgttagtcatttccccgttgatttcattaatgaaggatcaagtcgacgcactcaatgaaaatgatattccggcgacgtttattaacagtacactggattatccggagattgcggcacgtctggcgcaagttgaacgacaggaagttaaattactgtacgtgtctcccgaacggttggactccggctactttgagcgacttgcccagttaccggtctcgctggtggcgattgacgaagcgcactgtatctcacaatggggccatgattttcggccgagctatttacggctaacggagattatcaagcagttgccgtcacaccccacgattgtggcgttgaccgcaaccgcaacccctaaagtggcggctgatattatgcagcgcttggatctgcaacgagaggttaagacggggtttgcccgggaaaatctgtcttttaaagtggtgaaggatcaggatagcgatcgattcttgctggactacctcaagatgaatacggaacagtcggggattatctacgctagtacccgcaaagaggtggagcgcctgacactgatgctggataagcagggcgttccagtcaccatgtatcatggcgggttgtcaaagcaggaacgtcaaaagaatcaggatgattttttgtttgatcggctacccgtgatggtggcaaccaacgcgtttggcatgggaatcgataagagtaatgtccggtttgtcattcacgaccaaattcctggtagcttggaggcgtattatcaagaggccgggcgggctggtcgtgatgggttaccgagcgaagcaatcctgctatttaagctcaacgatgtgcaaattcagcggttctttattgaccaatccgagatggatgatgcgaccaaggctcgtgagtacgataaacttcaattaatggcgcagtacgccaatacaccgcagtgtttgcagcagtatattcttaattatttcggggagcaggcaccggcttgtggtcagtgtagtaactgtttggatgagcgtgagtcacaagatattaccgttgcggcgcagcaggtgctatcgtgtgtcaaacgaatgggtgagcgtttcggtaagactttgattgcccaagttttgacaggctcacgcgtggaacgggtcaagcagtttcagtttgatcggttatcaacatatggtttgatgaaaagcgactcacaaaaaaaggtatcagaactgattgattttttaacggcttccaattatttagtggccgatggtggtcaatacccggtcctcaaagtatcggccgcgggaattgatgttttacgggggcaacagcaggttttccggaaggcggccgtgcaggccaaacaatctttgccggttaatgatgaacttttcgaacagctccggcaggtgcgacgtgagttggccgaatcacagggcgtgccaccatttgtgattttttctgaccgaacgctccgtgaactttgtacaacgatgccgacaacgcttgatgagatgttgtcagtccacgggatcggtgaaagtaaaattgaaaagtatggcgaacagtttcttagtattttgattgaacacgaagatgaagtttaatcaaaataggcgatcttaaatcgagatcgcctatttttgtccaaaaaaagacgccccatcagcaggagggcgtcaacacagaagtgataaaacattatcacgattagtaattatacgctactatttcgtattgttaactattatttcccaaggcgtcagaatttaacatgtttgtcataaaacctacgcgagcagggcagactcatgatgcagaagccagattttgcggtcaatcccaccggcatacccagttaaattaccgtcgctgccgacgacccgatgacacggaataatgatcgagattgggttgtggccgaccgcaccgccgacggttcggggggccgtgtgatggtcagtggcactgatgtgatcggcaatttgttggtaggtgtaggtttgaccataggggatggtttgtaaaatggtaaagacctgctgctgaaagggcgtccccgccggtgcaagtggcaggtcgcgaggatctgggtgttgtccggcaaagtaccgatcaagccaggcagtagcctgagtgtggagcggtgtcgctgcagttggaatctggtcaagcccatacttagcgccgaagtgcttttgattttcaaaccagagaccaagaattgcctggtcatcggtcaggatggtgatgattccgagtggtgatacatattgtgtttgatagttcatgagcggcctccaattgacaaaacaagttaacgatccataaacgcatgcgaagcgaggtaacctttccccgctgttaagtcatattgtactagtcgatagtcgtgaagcaactgtttttgatgtttagtgaggtgtgaaacgagttgaccgttgtcgtcgaccatctctgaactcccattggcggtattattcgcggccccatcaaacgagtttaaagccattgctggcaggccttcgtagactttggtgaggagggcgtaatagggcgagaccttcacgttcatttgcgccagcagcatggcggcgaagtcgttaggtgtcaccacacgatgcttactcagttggacatgatgggcgggactgtagcggttaccgtaaatcaaatagtcggtagcatggagcgcaatcccatactgctgcatactatcaccattgtaaattcccggtagatgatcgccataccaaacgacggtcaccggtttatggatctggtccagttcatgattgaactgttttagtgccgtgtcggtatagtggataccctgaatatagttttcaatgttacgtttatgctgggcatccagataggccgtaccggaaacgggatagtcatcgtgatcgtagtagttgtcaaacggcatatgattttgcatggtgacgaggttaatgaactggccacctgtatgacttttcagttgtttgatggtctgcgaataggccgaagcatctgagatgtaggggctatgctgaatcttggccatgtagctcagctgattgcccccttctaaatggtaaaactggttgaacccgagtttttgatacacttgtttgcggttgtagaggttcgccgtaaaggggtgaatggcgacgcggtagttaaagagatccgaaatcgcgaaggtctgtttttgataggggacgagttgtgaatagggggttggtagtgtgggcgagaagttagtcagcgataggcccgtcaacgcctgatattccatgttagccgtgcccccaccataccctgaactaatcattttgccggaggtcgtcgttttctcaagttggtgcagatacggtaacggatcaccctgaacgtggaggttagggacgtctttcggatcagcaaagctttcactcagtacgaaaataacgctttggtgagccatgctcgcatagcgacggtgtgcgtttacttgagcggctgtgtgttgataccgtttttctaatcggcgcatggtggtcttagagtatccctgcggttgatgcatgatggtcacatcaatgttgttagcgaactgtaagagggtgccgttaagcttggcggctcggagctgagaataaaaatagggtcggtcgccagcgtcactcaaacttttagcggtaatggagtcgggatggttggcaaagcgaaatgaggagagtaatagcacggcgagtagcatcatgatgacccgttggggtgttcgccaacggatttttggatcacgacgttgcagccaccaagcgagtaaattggtggcgattatgaggatcaagacgccggcaatcacggccggtgagacaagctttaatagatcttgaatcgaagaaagcgaagtcaccatcgacgtatcggccggcaacacgggttcactgcggtccgaaattttgatcacgttgactaccagccatacggtgtagcaggtgagtgtgatgatcgccgaccaccaaaaacgattaaaaatagccattaagatggcaaacagggcgtacaccatcaggacgttgataaagatgataagttcacgatgtaaaatgacccattgaatcatattaagacgccaatcccagaggtgccaaatggagatcacggtaatgagccacgtcacaccgaccaaaagccaagtgcgccaagcatgaacggttaggcgcagcaaaagagcgtgccagttaatggcggtcttgggactttgctgaatgaggattaggatgccgccaatgataccagctaacatgccggtcaggaaaatggcgattaataatagtaaactcagctgaccgaggactggcaattgacgagaccagcgaaagaccgcaatgagtcccacctggcagagttgcggggttatcagccacagaatgctggtgccaaggaggctctgagcaatgactgacaattgacggggtaaccgatgtgcctgtctgaaaatgattaaaacaccaacgagccccatgatcatcacgggctgattccaactgatggcgtcaaggtagtgttgtgaagtggtgagaccgtggtggggatcgtaggcaacccggttggtcatgaaccacgagattaaaagggcaataccgaggctgaagatagttccgagcaccagcaaaagccgatgaagacgtaataacagcgggtcacgtaatagccagtgtcccagtaaaaataggtaaccaaacatgacgatcgtttgaccggtaccaatgccgagccagtcagtcccggtggtgaggctggcaagaaggtagatgccagtgaacccaccagtcagacgccgcagttgagaaagagagaggcggtgcaagcgttggctgagttggggaccgaagaagaggagcccgaggtaacaaagcagcatcggaccacattttttaatcaggtagctgctggcagcaccatttggcacggcgggcattatcgtttttactaggataactagaatccagaatcctaggagaatgccgattgctttggtaggtcgtcgttgtgcgttggaggatgttattcccaagaccactggaatactgagactgtcgatgagcgccatgtttttcagtatccagacgccccaaaaagcgccactggtcatgtaggggagctggctgaatgtaccagaggccacaattaagaccccgaacaggatcaggacactgatggtaccggcccaaataagtccccggttcgggtggagcagatgtttcaaaaagatcaccttaattcgattagttttaatttattatagtgtatctggaaacaattgcctgtgtcaattaatttaaacgacaacgattccaaatatgtcacggataatcgcgtattgcgatcagtttagcaccagtatacgcgaaatcaggtatcaggggtatagacaaacaggggcaatgtgtttcttttaagggatgaaaacaagcggatcgggataagttagttgttaattgcggcgattgattgatataatagcaactatgagataaataaaacgcaaggagataacgactatggcatttccacaacttgatttagcaagtgttactgggcctaaggccacgattaagaccaaccatggggatattacgatccaattgttcccagaacaagcaccgaaaacggtagaaaactttgttgcattagccaaagatggctactacgatggcattattttccatcgggtgattcctgatttcatgattcaagggggcgacccaacgggaaccggtaccggtggtgaaagtagctttggcggttcatttgaagatgaattttcaccagaggtattcaacctaaacggggcgctatcaatggctaatgctggtcctaatacgaacggtagccagttctttatcgtttctaatgaaaatgtgccggcccaaatggttggccaaatgcaagacgctggttatccagccgaagtcgtggaagcctacaaaaatgggggcactccttggcttgacttccgtcacactgtctttggtcaagtactcgatggcatggacgtggtgaaggaaattggcagcgttgatcgtgatgcgtctgaccgtccgacagaagatgttgtgatggaaaccgtgacgattgaagattaataggtaggatgaaagtctgttgttcaagaaccagtgactggtcgttgagcaacagacttttcacttacttaaagttattagttgcgctaaaataagtcaaagggggactgatgatgacgatttatgattatcgggtaacacgcgaaactggtgaagaagaaacgatggcacagtatgcgggtcatccgctcgtaattgtcaataccgcgacgaagtgtggttttgcaccacaatttgcccagttagaacagctctacgaaacgtatcgagagcagggccttgtcgtgttgggatttccatccaaccaatttcaccaggaactggcggacggagccgaggcggcgcaggcttgtcggatgacgtacggggtgagttttccaatgcacgccttgcatgacgtgaacggaaaggatgccctaccattattcgagtttttgaaacaacaggcccctgggacccttggatcggcgattaagtggaatttcactaagtttttagtggatcgtgagggccgggtggtcaaacgctttgcgcccaagaccaatccgttgaagatggcggatgatattgaacgtttactatagtaaaaaagtcttcgcaaacagcaatgttgcggagactttttggttagtgggctttgacttcttctgattcaaattgggtcttcatcaaaattgcggctaaaataccaccggcaatgacaatccctgctgaggttaagacggtcccggacatgccgtgatcgtaggccatgaccaccatatgacgaaactggctggtaaatgggagaccattcagacggtcgttgtaggcgatggcgtgacccgaaaagggaccggcatcgacgagggccgcatgtaatttacttgccatggcggtgggcatgccgacttggctcatatgatcgttaaggtaagtttcgtagcgactggtttggacaagccccaagacaacgacgccgagggtggttcctaattgccggaaaacattcagtaagccagaagccattcccatttcgtgcattttaacgccttccatcccagcgctgttaatgagggggttaaccatcccgttcatgaccccaagtagcaccatgccaggccacatgtcaacgaatgaaatggtcgggctaagggcccggtcaatcaagatgaagccgagacctccgattaccatgctaatactgattaaccattttttagagaaccgattgcctaaaataccagtcacgggacctaaaatgagggaccacatactgatagtgagttgtcgaatccctgtttgcagggacgtataaccgatgtaattttgcatcagggcagtgagaaaggcgtagaaggcatagatccccattcccagtgcgagggccaccagggcggcaccaacaaagtgacgttgcttaaacatatcgaggttcatcattggtgaggtgattcgtttttcgaccaaaataaaaatgactagtaagacaacggcggcaactaaccagccgtaaatgcggatgtcatcccacccccattgggcgtgattttctttttgaatcaggccaaaaattaatgaaaatagggtggcagcggatagaagcattcccgcaatatcgatgcgttggtgttcaccgtagcttggcgtttctttaatgtaaacggcggaaagaataaacgcaatgattcccactggaatgttgacgaagaaaattgatgaccaaccaaattgttcgaccaagtagccaccgacaagtggaccggacgcggttgaaagcccgattacagatcccaaaataccaagggcggtaccacgagacttgccttggaagttagaagcggtcaacgccattgagagtgaactgaggccagcccccccaattgcttgaacaccccgactgatattgaggacggtcaatgatccggcaaagccgttaacggccgaggcaataacgaaaatggccatggaaatcataaagatttttttacggccgtacatgtcacctaacttggacatgattaatagggtgacggcgatcatcagggtgtaaatgttaagcacccattgtaaattcgtaaaggtggtgtcgagatcctttgccatagtaggtaaggcaacgttaacgacggtgacgtctaaaagactcatgaaaacgccgagtgacatcgcgattaaggcaatccatttattttgtttcatagcagactcttttctttttagtgtgtttgaagttcggtgagttcgttctgaacccagtcgagcttggtttggcaaatcatgatattcagctcaagatttttgatgccccactgcaggtagtcgttgtgaggccgtttgagatggtcaatcaggtgctgcttaacggattcgtagcagctaagatcttctttaaccagagcggcatagtcgcttaaaatttcggtttgcttaaccacgttaacggccggaagcgcacgaaacttgcaacgataaacggcttcaagcttagaattaatgggaattggttcggccatcaattcgaccagccgagcctgcccctttgctgtcaggtgcgccattttttcatcccgagcgctattggtaagatcatacagttcgatttctcccgattcattgagctttttcaagacgggatagatggcactgttagaaaccttatgccgtggaatcatcatattttgtaagataatacggagtttgtagcccgacatgtcatgagatgccaaggatcctaaaataagtaattcgtacattgtaacctccatatgtttttttgacctattgaataataggtcaaaatgacctacttgtcaatcttaattgcaaaaaaaatcacgtagacgatgatctacgtgattcaatggtaatgaagaaataaaattagtgttcttgtttgattctaaatgataggcaaaatgcaatcactgcgagaaccagtgtaaagatcagacctaagtgaaccccattagtgaaggcgactcgagttgttgcggcagcggatgaagcgtgctgaccaacggcaagcaggctggtggcaactgcagtggccacggcgccaatgatttgttggaaggtattcataatggtgctgccgtcactggacgtttcctgatcaagggcgttcaaaccgaatgtttgagttggtgacatggccagtggtgcgccgatcattagaataatatgggctaacatcacgtaccacattggggatgtggatgaggctaatagcaacatgatcacggcaatgatcacaattccaaaaccgaggacagcgagcatccgagtactatgttgttctgtcattcgtcctgaaatggcagagaagatggcgttcacgaccccaccgggaagcatgacgatcccagtcaaggcaacgggaatagccaatccattttgccaaaacattggaagtaggtacattgatgaaaggataataccgaagtcgatcatgacgagaacggccccaatccggaagttccgtcgtttgaaaaccttaaagtttaaaatggcgttggatgatgtgagttgccgacgaacgtagactgccaagatgagtagtgcaacgattagtaggcctaaaacgattggagatgaccagccgtagtcgctagccatgctgacggcagttactaggccaccgaatccaagcgtcgagagaagaattgagaaaccatcgatcttaggtttcgtgatttgggcaacgtttggcagatacttcagtgcaaatgcgaggccaatgagtaagaatgggacaaatgcccagaaaatccagtgccagtttaatttacctaaaataatccctgatagtgttgggccgatggctggggcaaacatgataactagcccgatcattcccatggccgcacctaatttgtaagggggataaatcaaagttgcgacggtaaacatgagtggcagaattaatccagtagcgattccttggatcattcgaccaatcaatagaattgcaaaacttggtgccagtgccgaaataatcgcgcccactgtgaaatcaagaagggcaaaaataattaattgacgggttgtaaaccaccgagtgagcaaactcgaaaggggtaatacgatcccgatgatgagcatgtagcccgtgacgagccattgagcagttcccacggcaatgtggagttgtgccatcaggcttggtagtgcgatgttcagtgaagtttcactgagcatgccgacaaagccaccaatgagcatcccaaacattgctaagaatggatgggcgactggcacagcggctgaggcgacttgttcttgttttgtacttgttgtatccataaaaatataaagctcctttatttgacttatgttctttcccagacaagtgattacattagcacaaaaaattttttctcgtaagttttttcttgccaaaacatgaaaatatgtatgaaaacgattccgtaatctactatataacggaattgttgtgtaatgagtggtgtcaagacatgacaaatgagcatgaagatggtaagctttagccaattaaaataatggagttgatgaaattgagtcgtcaagatgccttactaatgattgattatacgaatgattttgttgccgatcagggggcgctaacctgtggtcaaccggggcaggcaattgccaaccggatgattacgttagccgaccaaacgttggcagcgggtggttgggtgattttaccgaccgacgtgcacacccttaatgatccgtaccatccagaaacaaagttgttcccgagtcataatgtccgtggaacctgggggcgtgagttttatggcccccttgctgattggtatacgcaacatcaacatgatgaccgggtttggatgatggataagacgcggtatagtgcgtttgctgggactagtttagacattgatctacggtcacggcagatcaatcatgtaattttaacaggcgtttgtaccgatatttgtgtgctccatacggccgtggacgcgtataatttaaactatcgaattacggttccacaaactgcggttgcagcgctcaacgaggcggggcagcaatggggaatcggacattttaagagcgtgctaggcgctgagattactgattaatggaggcatgaatttgtgacacagttagagggtcagttagttttaatttttggtggtgcgtcaggatttggatttcaggcggcccagatgagtttgcgccaaggcgcgacggtgaggattgtcgggcgccatcagcaacgcgtggctgaagcggtgacaacgttgaaacgtgtgagtgatcgcgtggaaggggctgtattggatgcaagtgacccagatcagttagctccctatttaaaacagttagggcaggttgaccacgtgatttccatgctcggcggtgcaatgggtggcgggttcctgacggcatcttacgaggaaatttaccacgctgttgaacaaaagttttttgtgaatttgaagttaagtcagctggtggtgccctacattcgggatcatggtagcttaacgttaacgagtggcaccggcggtcacccgtatgatgcttcgggcgccatcattggcaaccaagcaattaatacgatggtcgcggggatggccgttgaagccgcaccacaaattcgggtcaatgcggtggcaccaacttggacaccgaccggactatggcgtgatttggatgcggaacagttaacgcagagccaggctaacatgacggcccagattccacttcaacgcgtggcacaagttgatgaagtggcgagtgcatacttatttgtgatgacaaaccaatttgtgacgggacaggtaatcaacgtagacggtggtatttcggccgtatagataaaaatcggcgcttactaacttattttcttcaacttttcgttgacgccatggacaaattccagtatagtagtttttgtgcttgaattggtccgttggtctagctggttaggacgcctgcctgtcacgcaggagatcacgagttcgagtctcgtacggaccgtatatagatgaagcgatcaagtttaccaattatggtgaatttggtcgctttttgtcatgccaatggttcaattggcatcagaaactatggtattataatccatgttgttgataagcggagggtgatcatattttagagttatttgaaaaggcaccaatacataaagcgtacttcaagttggcgctaccagtggttctaggaaccgtggtatccatgatttataatttgacggacacattctttgttgcgcagacgcaaaatgccaacctagtggcggggattacactatgtacgcccctattttcaatgatgatcgcccttggtgatatgtttggattaggtgggagctctgccatttcgcggctccttggtcagaaaaagtacgatctcgccggccgggtgaatagtttttgtttttacgcagctgttgtgttggccgtaatcgtgacggcgggcctgtttattttcaagacgcaggttcttggctggttaggggtgacggcggcgacctatcagtatgctgctgtttattacgagattatggctgcagccggtattttgattattgtttcgttggtccccattaacacgctccggacggaaggattggcaacggaatccatgattggaacggctacggggacggtgttaaagatttttcttgatcccctgtttatcttcggctttcatttgggggcggcgggggctgccttagcaaccgtggtggggtacttggtcaccgactcgattttgattgggtatatgattcgacggacgcgctatatccatattcatgtgcaccggatgaagattccgacaattgaaattaaagatgttttgatgatcggtattccggcctccgtgacaaactttatgatgatgctgggaacggcgttgatgaataatttcttaattggttatggggccagcaaggtcgccggttttggaattgcaaccaaggtagaaaccattgtgacaatggtgctagttggcttttgttttggatcacaggcgttgattgggtataattacggcgccaaaaataaagaacgcctcaaaaagattattcgctttgatattttggttaatgccggttttgcgtttgcaatcgcactggttttaattgccgtggcgccattgctatgtgggctattcatgaaggatcaagacgtggtgcggtcggctagctacatgctgcgttggttcctcctgacgacaccgtttatcggtatttcgatggtgttcaccacgatgtttcagtcggtcaaccaacccttggatgcctttgtgatgtcgatttcgcggcagggtgttgtttttgtgatcgtgatcttcattgtggccaatcttttcggttatcagggggtcatcgtatcacagcccattgccgatgtgattaccgctggtattggcctgtggttgtactataaagattttggccctaacggacgggctattcgaaactggtaattcaatgaatagataaaagcatctggcttagctgagatgctttttttagtccggtgatttgggtgtataatgtaatcgttttagatgaaggagggactcgcttggatgcagatttaacttggctagacgatccggaaacttttcgggttaatcaggtacccgctcatagtgatcatcgggggtatgcgaccgttgcggaagccgatcagcagcacagtagcttggttcagagcttggatggttcttggcagtttgcctttgccaaagatccgatgcaccggccacgggacttttatcaaccagatactgatcggagtatatttcatgatattgaggtgccgggacacattgaattagccggatacgggcaaattcactacattaataccgcctatccatgggaaggcaaacattaccgacggccggcatacgccatgggtgccgaaaaacgtgaacgagggatgtttagcaccgatccggagaatacagttggggcctatgtgaagcacttcgagcttaatcaaacactggtcaatcatcgaattgccattgaatttgatggcgttgaacaggcgatgtttgtttggctaaatgggcagtttgttggctatgccgaagacagttttagccggtcggagttcgacttgacgccctatattcaccccggagataatctactggccgtggaagtcttcaagcatagtacggctgctttcctggaagatcaggatatgtttcggttctctggcatttttcgcagtgttcggctagttgcaaagccggcattgcacgtcgaggatttaaccattcgagcgacggtagatgacacacttaagcacggtcatcttcaagctgagaccacgctgtcggcgttgcaccacgtgacggggcacatgcggttacaattgttaaatgctgaaaatgagtcaatttggtcgcaggaccaagcactagctcggacagtgacggtacagaccaccgtcgccgcaccacgtctttggtctcaccaggacccctatttgtatcgcctccagatcgaactgttcgatgatcacgaccagttagttgaggtcgttccctacgtggtgggatttcgtcggttggtgttacagaatcgggtgatgaccctcaacgggcagcgccttattatcaacggagttaaccggcatgagtgggatgctcaccggggacgggcggtcacgctggccgatatgcatagtgatatgcaggtgtttcacaagtatcacattaatgccgtccggacttgtcactacccagatcaggttgcgtggtacacgctctgcgatcgaaatgggatttatatgatggcggaaaataatttggagacgcacggaacctggcaaaagatgggagtagtagagccgtcttacaatgtaccgggaagtttgcctcagtggcagactgcagtgcttgatcgggcccggagcaactatcaaatgttcaaaaaccatcctgcaattttattttggtcactgggaaatgaatcttacgcaggtgatgatattgccgcgatggatcggtattatcatgacgttgatccgacccggctcacgcattacgagggcgtttgtcgtaatcgagcgtatgaagatcgtatttcggatatggaaagcatgatgtacgatcccccgacggcaattgcggcctaccttgaaaatgacccgcaaaaacccttcattaattgtgaatacatgcatgacatgggaaactcactaggtggaatggccagttatgatgcattgattgatcggtatccgatgtatcagggcgggttcatctgggactttatcgatcaggcactttggtgtcaagatgaggtaacggggaatcaagtcttaagatatggtggcgattttgatgatcgccattcggattacgaattttcgggggatggccttttatttgccgatcgaacccccaagccagcactgcaggaggtgagctactattatggacgccgggactaaattaaagcttgtttatggggatgtgacgttaggcgtaagtggatcgaattttcggtatctgtttgcctacgatcatggtggtctggaatcgttggttcaaaatggtaaggagtggctttaccgggtccctcaaccagcgttttggcgagcaacgactgataatgatcgtggtaatgggttttcactaaagagcgcgcagtggcttggcgccgatctcttcagtgcctgtaccgcgatcgctgttaaagttgacggtcacgcaattgaattgccgattgcaccggtcaataatcagtattcggcgatagaaacggcacagtccgtcgatgtccaatttacgtacacgacaccgacagttcccaataccacggttacgatcagctaccatgtcagtgcggacggacaattagttgttcggagtcgatatcagggagttgctggattacctgaattgccggcgtttggcattcgattgtgtaccccgacattggcaactgaatttgattatcagggattgtcgggtgaaacttatccagaccgcatggcgggcggtgtcgctggcacgcatcatgttgccggtttaccagttacgccatatatggttcctcaggaatgtggaatgcatatggcaacgcagtggttgcgggtaacacgagagaccacgctgaataatgcagataccgacacctccccctttgaactcacgattcggcaggaccaatcgccatttgcgtttagttgtctgccgtacacgcccagtgaactagaaaatgcgacgcatattgaagaactgccggttgctcggcgcacagtgttgaccatttttggtgctgttcgcggtgtgggtggtatcgatagctggggggctgatgtggaagcaccctaccatattgccagcgatgaggatcatgaagtcagtgtcatcatcgaaggaccagtggcctcgccacgggggtaatgctcagcgattaaaatttagagaaataaatagtgacggggtaaaaacgtgagtttcgcctcgccactatttatttggttattgtaagttaagagtgacagtcttaccagtatcagcaccggctggcgttacggtgacggtaacgggggtgctggtgttggtgaggtggtaacttaagtcgatatcgttggtgcgagaatgggctaagacgtcattagtatcgtcggtatcggtcggactgagaatctgatcattttgtttaacggtgactttgaccaggtcattaaacgaagctgactgagcacttgcgttttgccaatgaatttcgagttctagctcaccatcgtctttttcagctgctatttttgtaatggtaaacgcgtcaaactgccagttagtcgcgacggtggtgctatcgtcggttaaactagtagcttgtgattgggccgattgactggttgatgtgaccgatgagtcggactgactgctggaagatggttctgatgagcgtgagttctgctgcccacaagcgatcagtgtcagggtgacgataaagctaatcagtagcagtgttaaaattcttttcatcatgagcagatcctttctgattgctataaataggtagtgacgagattacctctatcataacgaaaagagttgattatattcaacgaatatcattcataatattagattaatgtataaaaaaacacgatcatcatgatgatgatcgtgcgctaatggaattagtaccaagctggttttggtccgtcagtgtttggtttgttaactccaagtgatcctcgaacggcttcatccggatgggtcaccaggtggctaacgagggcgccaatacttttacgagagacctcggttcccttgaaggcttcacctttttgagtggtttcataatcgacttcgtcatgattggttaaccaggcgggacgaatgatggtataatcaaggtctgaattctcgatcacggttgcagcagcaccatacgtttctaggtagccaccgtcgagcatttgatgattccactgaccataggccccaggtacttcatcataaatgccaagtgtggaaatccaaatcaggcgtttgacttggttgtgatccattgcggtgaccacatcttgagccagttgttcaatattacggccacttagattggcatagacgatgtcaatcccggccatggccgcactgagtgcattcgcatcggtgacgtcaccttctatgcgcgtctcccgactggcatccgtgatcgtcagccgatcggcatttctcaaaaagtaggtgagatgggcctgtgagtttttcaagagatcagcctctgcatggcgggcaatatgcccagcagcaccaagaattaatacgtttgtcataatattccatccctttcgttatctttcaattgtaactttaatactgacaattaaaaaaagcaactaattcttctcgcaaatgagtcaattaaggagcgtatcatgcgatatacgtggacaaatcaaggaagtcaacccgaaaaaataaaaccatttttacaggcgctcggaatgggacaccgcctgattagtgatattaagcatggacagggccagtttttaattaatggtcaaacggtagccccgacagcgctagtgccgagtggggcgcaattaacgattattgtgaatcctgagccggtcgatccagcagttcaggtgaaccatcaacccattacggtggtgtacgaggacgagcattggctggtggtcgataagccggccggtttatcatcgattcccggaccaacgaatcaaacggatacgctgttgaaccggataaagggttacctgatggagcagggcgccgatgacttacgaccccatctggtgtcacgcttggatcgatttacatctgggctagtgctaattgccaaacaccgggtggcgcatagcatgattgcgagtcaggtacaaaatcatgagattgataagcgctacctcgcgattgtcagtgggcagctaacccccgatcacgacatcattgatcggcccattgggcgagtcgccgattcaccaaagcgaatggtaacgaccgacgggcaagcggcgcaaactgaatattggtgtgagcaaaccactgcacagtggacgcttatcagagtccggctccatactggacgaacccatcaaattagagtccacctagcggccttgggccatcccttactaggggatgaactctatggtggaccacaagacttaatcgcccgtcaggcccttcacgcgacctcgctcacgtttaaggatccgtttagtcggcggacgttgcattttgaaagcccgttgcctgcagatatgcagcaagttcttaaacactaaaagtgatgaatttggtgaattaatatgataaagtattactagagtaattggatggggcgttcattcaatgaagtgtgacggtaacgccaatggttgaagggtggatttgaatgaagaaacgctatcgacatagtaagctcaattgcttgcttagaaagttttttcagttagattaagttgcactaatcggtaactaatagaaacagcctaaaaagggcctcggatcacatgcttcgttaagaagtactgcgatcgcgaggcccttttttgctgatgatcgtcgctaaattaggcgccaaacaaaaaacatgccccatccggctgcgcaaccaagcggctagatggggcatgttttgataataattaattaggtaaaactagttaagctgtgcaacagcctttttaagggcttgtgcttggaactcagcctgtgcccgttgggttactttagcccgttgaacttcggtcatttgcgggttcttcatcatcgctgcttgaactttggcggtgatgtaagctttagcctgcgtagccatttgtgccttagcagtgctgctacccatcaatttttgaagttttgcggcttgtgtcgtgctgagtttaacccaggtctttggtaggttgaaagtgtaaacccgtttgaccatggtaccgtccatgtcagaccacttgaagagtaatgagtaaaagtcgctcttgtattcccaacgggtgaccttagtggtcaatgttgcgttggctttattagtccagttcacgtggtttgttgtatattcgtcagccttagtatggctaggcgtcttttggttttctttgacgtcgtaaatatagacgttgtttttaccagaagtcccaacttgcttgtatagggccatgttcattgaagatgatcctgaagcggagtagatcttttgggtggtcgttgtagtgacctttttcataccgtagtgttcatggtagttagcaaccatcagcacaattgaaccgattaatacgacaccggaaactaggagtgcaagagcccgggtggcagcccggttcgtaaacatgaacgctaagaagaagcagagggctccgataacaagtaagattaaaatcattattcagcgcctccttcattagtcgtaatatcttgagtggctggctttttgtgagtcagcaggaaagtacaaatgaagccaagaacgctaaagccgactgcaatccagaatgctgattgatagccatccattgttgcgttgagtgccttaaccttgtattcaaatggtgttgcgtgaagtagactcttacctggcatgttgttcttagtaacgtttgtgagcactgataccaagagggcagtcccaacggaagtagccacttgacgaatggtattgttagcagccgttccgtgagaaatcatactaattggtagagcgttcatcccagaagtggtaacgggcatcataaccatggaaatcccaaacatccgtacggcgtacaagaagacgatataaatggttggtgtgttccgtgacaggaagacgaatggcaaagtagcgactgtcagaagaaacatcccgcacattgctaaacgacgagcgccgtacttatcgaataacgtcccagtaacaggactcatcacacccatcatcaaggccccagcaagtagtgttagtccagaattgaaggcggacatgccgtgaatgatttgtaagtacagtggaacaaccatttcaacaccgaccatggccatcataacaatcgagctcaggactgcggagatagtaaattcaaatgacttgaaaacgcgaacttccaagaatggatgttcgacacgtagttgacgccaaacgaacaaaataataacgacaatcccgattaaaatcgtggaaataacgactggatctgtccagcccttgtcaccaacggatgagaatccgtaaagtaagccaccaaaaccgacagttgaaagaataattgatagaatatccagttttggatttgaagtttcgataacgttcttcataaagaagaagctaccaataatcacgacggccataattggcacgatcattccgaacaggtcacgccaggtaaagttatcaataacccacccagacagcgtcgggccaagggcaggtgcaagaccgatgacaattccggccatccccatggcagaaccacgcttttcagcagggaaaattgtcagcatgattgtttgaagcagtggcattgaaataccaacaccaacggcttgaacaagtcgaccggctaacaaaacaccaaagttaggtgcggtccacgctaaaacagttccgacttcaaaaattgccattgcaataatgtagagccatttcgttggaaacttactacttaagaaagcactgattggaatcatgatcccgttgaccatcaggaagccagttgtaagccactgaacagtagaagtagaaatatcaaaggccttcattaaagcagggaaggcggttgttaaaatagtttgatttaagacggtacagaaaaccccaactaataataagacaatgagcattgtccggttgtagggtttgccgttgacgtcgacagcttggttagctttgttcaacaaaaaaacctcttttcttatatttcgaattaatttcgcatgcgttcaaatataatcctttgttttcgttttgtcaaataacttgacaaagaaattaaaaaatatatactttatcgagagaatacgggaacattctatattttttgacaacgttttcatggaaaatagtgtcatatataatgaaaggagtgactagcatgagtagtctaccagaagaattgcgcggcttgtttggcaagcacaaactccaactcgggattggcgatctcgcaaaggtgacgggcgtttcccaaagtaaaattcggtactgggaacaaaagggatatattcagtctacgcaaaatgatgaaggtcaaaaccacaagtattcattaatgatgcttggcaaggtacatttgattcgtcattacctagatgaaggatttaccctgacaatggccgtaaaaaaagcagaccgacataaggaaattatggatttagtcagcaaagtagcggttgaccgattccgggaactcgaagaatatgaggggaatccagccattaatttgggatcagtatgtgaagcaccacatcagtcagtaattgctgtgattgaagagggtgaaactaagctgcaccttgtggattcccgtgattgacagacaatcacaaaatatacgctttctaattgaaaacttcaagggctttaactaattcggggagctaaagccttttttacatattatggacaatctgtggtacaatgattgaaaggtttaatcgtgtacggataaatagagagtatgatcgagtatcacaacttaatagcaccaataagtttgaagccaatgggtgaatgctaggcattttttgaatgtcatgttttctatttataaagcaagcaactggtagcgcaacttacatagaaattagaaaaggaaataggagaactatgcgaaagttaaaagttaataataatgaagtggcattttacgcaatgggtggccttggtgaaatcggaaagaacatgtactgtgtccaattccaagatgaaatcattgtcatcgattgtggggtgcttttcccagaagatgagctgttaggggtcgattacgtgatccaagacttctcatatctcgttgaaaatcaggataaaatcaaagccattgtgatcacccatggacatgaagatcatattggtggcctgccattcttcctccaacaagtaaaggcgccaatctattcgggtccctttgcattgtcgttaattaaaggtaaattggaagaaaagcacctattacggtctgctgaactacatgaagtgagcgaagacacggtgttgaagtttaagaagttgtcagttagtttcttccggacgacgcactccatcccggatacgttgggtgttgcgattcacacaccacaagggacgattattcaaaccggggacttcaagtttgatttgacaccagttggcgggttaccgtcccctaatctacaaaagatggcaaaactgggggatgacggagttctattgctgacttctgatagtacgaacgccgaacggccagagtttacgaagtcggaacagtgggttgatttacacattcgtcgcatttttgaaaaaattaagggtcgaattatttttgcttcctttgcgtctaacgtgtatcggttgcgtgaagcgtcggatgcagctattaagcagggacgtaagattgccgtctttgggcgaagcatggaaaatgcgatcggtgccgggcaagaattgggatacttaaatattcccgaagattacctaatcgatcctaatgaaattaattcatatcccccagaaaaagttttgatcatgtgtacagggtctcagggggaaccaatggcggcgctaagtcgaattgccaacggaactcaccggcagattacgattcaaccagatgatacggtggtcttctcaagtaatccaattccggggaacacgattagtgtgaaccagttaatcaataagttggatgaagcgggcgccaatgttattcatggctacgtcaataatatccatacgtctggtcacggtggtcaaattgatgaagagttcatgctacgcttgatgaagccgaagtattttgccccagttcacggggagtaccggatgcagaaaattcatacgcatcttgccgaaatgacaggtgtgccactagaaaacagctttattctggctaacggtgacgtgctggcattgactaaggattcagcgcgggtagcggatcatatcgatgctggggatgtgtacattgatggtcgcgacgttggtgacagtgttggaaatcctgaaattcgggaacgtcgtctgctttctgaagaaggggttgtaacagctattgcggttattgatctgaagaaccatcagattgtggccggaccagatattgtttcgcggggctttgtttacatgcacgagtcacaagatctgattaaggcagctaatcatgaagtcttctgggccatcttgaatacgttcaagaaccgaaagaagattgacgaacgagtcttgaaccggactatcgttagtcggttacaaaaattactctacgctaaaaccggtcggcggccagtcattattccaatggtcacgatcgtaaacgataaggactaaataaaaaagcagtttgtgtcaatattagttgacgcaaactgctttttattttgctttgatgcgaagcttggcttggcaggctggacagatgccataaacttcaaagtgattaccggtcatcaagtagccagcttgctcggctgctttggtttcgagttcatgttcgatgcggttaaattcgggaaaattgatgtcggcaattttgccacagtgggtacaaattgcatgatagtgatgattttcaaagtagtcgtagtgggtgctaccgtcaccattttttagttcaatgacaatgccatgatcaacgaacgtattcaaagtattgtagatagtggccggccccagtttaacattctttttgatcaatccttcgcggatcatttcaacagacggatgattatgatgacttgcgaggtatgaaataataatttgccgctgttcagtcacccgcaggtgatattttttgagaaccgctttagtttgttcattaatatcagtagagcccataattgaattcctttcattattaaccaaatgactacccacattaaagcacgtttgaacatcaattactagtagttcaattatttgtaacaattctaaataagattatgattacttgattagaaattgatgaaatcgtcgagacccctttacatttagtgcttagattattatactcaatatgaaagttaattgagaatgattctaaataagggagaaaaatgatggaacaggcaaagcaaaaaatgagtttagccgccaaaattaacgtgatgcgtgcgagcgtcatgggagccaatgacggtattttatccgtcgctgggattgttattggggttgcgggcgccaatgcgagttcctacgcgatttttctggccggcattgcgggcatgttggcggggacgatttcaatggccatgggcgaatgggtttcggttagcacacaacgtgatactgagaaacgcgcaattgcgaaagaagcgcaggcgctggatgatgattatcagggtgaattcgagtttatcaaaaataagtacatggctaccggtatttcagaggccctatcacggcaagcaacgaaagaaatgctgtctaaggattcactggatattgcgacccgggaacggtatgggttcgatcctaaggtaaaaaccagcgcgttttcagctgccattgcgtcaatgatttcatttccgattggatcactattaccgctactagcaattacattatttgatcctcaaattcgggttatggcaacgttcgcagcggtcgtgatcgcgttagcaattacgggaagtacagcagcagcgcttggaaatgcgaataaaacgaaggccgtgatgagaaatgtgatttccggattgttaacaatggcgattacgtttttaattggatcattatttgcatagcatgtaagagaaagtcaggcataaaagatggaagttaaaaacatggatagtttaaaagggttaacaagaaaaccgaaaaagaacaaaatgacaatggctgaacgttccaatacgttacgcgctggtgttctaggtgcgaatgatggcattttaaccgttgttggggtgttgttttccgttgctgtggccaccaccaatcaatttacgatcatgattgcaggtctttcagatctgttagcctgcgcgttttcaatggcgtccggtgaatatgcgtcggttagttcacaaaaagatactgaaaaagcggccgttgaaagtgaaaagcaattattaaaaactaattttgaagatgagttgcggacggttgcgacttactatgtcatgcgaggcgtttcggaaaaaacctctcttgaaatcgcacaagagttgatgaagaaaaatgctttggaaaccatcgtccggatcaagtatgggctagaattgggacactatatgaacccatggaatgccgccttttcgtcacttgtatcggcatcttcaggtgggatttttccactggtggcaatgactatgctccccgtttcaattcagtggccggggacgattattgccgtgattttatcggtggcattgaccggttttctgagtgctaaactaggcgatggactgacaaaaacggcaattattcggaacgtgattgtcggaattgtgacaatgtgcattcactactacgttgggacgatgttgtaaaagaaatactaaaagaggccttttcaaactaccagctggttgatagattagctgaaaggttgaaaaggtgtttttttcgttaaaattcgtaatttatcaataggcagatgcataaaagttaggaaggccaaataaaaatattttataaattaattttttattcaaatggtgttaatttaatattgcatatatttaaaaataatgtcacaatataggtgcacttatgaaactgagtgcatctatgtctgaaagccttcgggtgattacgcatatccaaaaccaggtttcaatagaaggcgaacctaattttgcgggttggccttttattttcttaatgagtaaacgcaaaaaaataaggtgaatttcggggtgtgaacatgttaaaaccgtgcattgataatgagattgtgcccagtcaaaatgaattgattgagcatatcgagcaactcatattttatttagaccgaagtaacgtccatcatgaactattttcgcaaggagatattgtcaaactaacccgtgaggtgattatcacgtatcaatgtgatcgagatgtttttgataccgccttagattatgcgattgatggactgaatcggcataaggaaagtcgacgctatcagtttgtggttaatttgatgactagtattagtgaaggaattgaaatcagtgccgcagaaaataaacataaatagcatgtgataataatggaacgcatgttttaaccaaaattagcggggagaataacagtgaaaagtcattattttggaacaatgatggtatccgttcagggaattgatttattaatcatcgatttaaaaaagtttgagactattgaacgtgttcataaaagtattgcaatcggggatgatatctaccacgatacacctgtcgatttggaggatgtcgatcaaattacgcaaacaatccaaggctatttgcaactattaaacgattaccaaattattaactatcagttatggggtagtgaagcactcgcacacgcagttaacgcagattttatctcagaccagatttttttgcgaacgggtattaaaattcagtggttgtctgtcaatgaagaaacttactatcaaaaccaggcaattttagttaatttaaaaaaacggcatgtcaaattaaagtacccgctaatccacttcattaacgttaattctggcaacacgacgattacacagtttaatcaagacagatttgtattttcaacgtactttccacttgggcctgtacgaattgcagaggatctggaaaaccttcgtcaaaatgttccaaattcagtcgaagtattgaatgactatattgatagtaagtttgcggactttaaacgggcactgccaacacagacaatttcggatgccagtgacgctattttattaggcacaatgccgttgagccatattaaaattagtaaaaaaacgttgttgtctgataaagaatttgaggtcctttttgataagatcattgatgcctcagatcagtacatcaatgagaaatttggaattccagaatctgaaattccgttgctcttacccgaattattgctgtcccgacgaattttacagcttacgaatgcaaaacgagttcttttttccgatacgaatgtcttggatggattagcaattaatgaggccgataagttgggattacataagcatcagtttacggagcaaattgtgattatgtcggaaaacattgcaaatcactaccgtgttgaaccagtccatcgtaagttagtaactaagtttgcattacatctctttgatcaattgaaatcaatgcatggacttgacggacatgaacgtctactgcttcaagttgcagcgattttacacgatgttggggcatatattgatacacatgagcattatttacattcggattatattattcgacattctgatatcattggcctctcagataatgattgcgaaattattgctgccgtaacacggtatcatagtacacaaacaccaggtgcagatttaagtcgttttcaaaaactaccaaccgagcagcgattactaattgctaaactggccgctattttacggttggcagatgcgctagatgatgatcggcaacaaaaaattaaacaaatttcagtttcacttaaaccgaacagcgttgttgtcacagcatttagtaatagtgatttagcattggaaaattggatttttacctttaagagtcgattttttgaggaaacatttgggttaaaagtacgattgaagcaaaggagtctatcagtaaaatgagtgaaaaatttgattttaaacaacatgatttttacaccaaccgagaacttagctggttagactttaactaccgagttttagaggaagcaaaggacaaaaccaacccgctactggagcggttgaaatttttgagcattacgcaaagtaatctggatgagttcttcatggttcgtgttgcctcactagccaagcttgcggcggttaactacgctaaaccagatgcatctggcttaacagcgggcgcacagttaaaggcggttaatttgaaggcgcataagatgcttgtcaaacagtacaacacgcttaatcggtcgttaattccggcagtcgggcaattaggtgttcgtctaaaaaatagtgatgaattggataaaatgcaatcccaatttgttaaaaactattttcatgacgaactgtatccagtgttgacccccatggcggatgatagttcacgaccttttccgtttattgccaacaataccatgaatattgcgttgcggttgaacgatggtgaacgagataaggagttatacgcgacaattccagtacccaacagttttccacgagtcattgaactaccaggacaggccaatgagtttattttgctggaagacattattaaaatgtttgcttcaagattatttattaattatcaaatcaaagaacaagctgtttttcgggtgattcgtgatatggatctagatgttgctgaggaggatacttctaatttgttaaaggaagttcaacagcagttaaaaaagcgagaacatggtaacgtgattcgacttgaagttgaaaataatagtagtcaaaaacttttgaatcggttagttaaggagcttggggtaaaacgatttgcagtatatgagattaatggcccagtgaatctaaccttcttaagtgaactcgttaaaaaaataaagggtttagatgatcaaaaatattcggcattcacggcccatcaagcgttgcccttgtcatcagatggtgatatctttgccgcgattcggcaacaagattgggtgatgcaacacccatatgataagtttgattcagttgttaattttattggtcaggcagcaactgatccagctgttttggcgattaaaatgacactgtatcgagtatcagggaattcaccaattattaagtatttagggatggcggctcaaaatggtaaacaagtaaccgtgctggtcgaggtaaaagcacgatttgatgaacaaaataatgttcattgggcacagcaattggaaaagatgggatgtcatgtcatttatggcctgttgggattgaaaacgcattgtaagctatcactcgttgttcggcgtgaacagggagggattcgtcgttacatgcatatgggaacggggaattataacgatgctactgcccatttttatacggatatggggctgtttactgccaatagtgacatgggaattgatgctacaaacatttttaatatgttatcaggttattctaagcctccatattttcatcagctgcatatttcacctcaaggaattcgggactttattaatgatagattggaccaagcaattgcaattgccaagcaggataaaccagcgttagtacgaatgaaaatgaattcgctatctgatcaacagattattgcacacctgtatgaagcatctcgtgcgggggtcaagattgaactgattgttcgtggaatttgttgtttaaaggttggaattgagggtgtcagtgacaatatcacagttcattcaattgttggtcgttttttggaacacagtcgaatatttatttttaatcttgatcatgaagttttaacatacttagctagtgcagatatgatgacacgaaacttgaatcggcgtgttgaattgctttttccaatcaatgcgattccaacgaaaaacaaagtaaatcaaatttttgatacgatgtggaacgataatgtcaagtccagaattttacagtctgatgatagttatcaacgaatagatcgtcgtggtattgcgaaaatgagctctcaagatgtatttatcaagaatgcggagcaacaaatgaaggcggaaaaagaggatgagagccccacgacgtcggaaagttttaaaccgatgcttagccctaagaatcaacccaatttattgtcagatgaaggaagcgatgagtaaggatggaacattttacggtaatcgatctgggatcgaatgcggttcggatgacaattacacgaattaatgatgatggctcataccagacggttaagcaaatcaagagatatattcgattgtctgaaggaatggatgctaatcaagaattgcaaccagaagcaatcgatcgaacgctggcagctttagcagattttaaagacatttatgagacatacaaaaacgttcacgttaaggctgttgccactgcagcaaccaggaaagccactaaccggagtggatttttagcctgtattcgggagaatcttggcattcggttagatgttatttcaggtctaatggaagctaaatatgattatttagccgttgctaacacattaccagttaagaattatttgatgttagatactggcggtggcagcacggaaatcgtgctatgtcaaaatggagttgtcagccaccgtgctagcctgcctatcgatagtgttggaattagtcatcagtttcatcttgaagatggggttagcccaacggatatatttgatgcaatgtcctatgtaaatgatgcgttgggtggtgtttggtggctgaaagaaggcctaaatttacccattattgctgttggtggtagcaaccgaactttggcgaaaatctataaacgaagtgcgcaaattgaggggttgaatgacattcatggttatcgaatgagtcgatcgatggttaaccatattttttctcagattattggtaagaatcaggaacagcgtaaagaaataccaggattgagtaaggtacgggcagatattatcgtcggtggtttggttcctatagttttagttttgcggtttttggattcggatagagttgtcttttctgcgaatgggttacgtgacggggtgctcaaagaacatttgaatgcgatcgttgagcaagatcaaatgaaggaatagaaaaagctttccaagcaaagggattacgcacaatacgtatgaggtttgcttggaaagctttttaatattgtcaaaattataggtccgttaccggaataacggggacaacatatgaaataatgtggcggttgtaacggcgattaagccacgaacgcaggcggtgatgattggagaaggaaagtttttgccgttcgatgtccttaatgacccgttgcagatcacgtaattcctctgaatataattgacgcgtattgaaagataattgccgaatctgttggtacagggctgacaaggcgtaatgatgatggaaccagataaggtcggtcagctcggggtggaatgtttggacggcgtggtggagctgtcccagatattgtaatgtttcccgatagggtggaatagtcgtctctgatgattgtcgagtgacgataaaggcgttattagtggcgacaaaggctgcccgagccgtgagattaaagagatcgtataaaaatagccgaggcgccagattccctaatgtagggtcaaaccgtcgctgcccaattagctggcggtcgatgaggagtccaatcacggtttcgggtgtttgctgactgagtagtccggcgagaagttcatgccgatgatgataagttaacgtttcagtatagacgccagtaacgggagtatcctgagcgatgagtgtttcaagataggttgaacttaagcggcaatccggtaggagaaacatgacgtgctgaccatgggcatccggaagtgcgagattaaaactttcccaaacactggtccggtgtcgactttcgataatttgacacggaataccgcttaaccgttgaaaagcgcgaatttgttgtggggtttgatcacaagaatgatgatcaacgaatagaacttcaaagttacgaaatgattggcgtttgagatcggatagaatacctgacagcgtactagcacagttactaacgggaataataatactaatttctttcatatcgattcgcctcacttatctttgatcgagaaactatcttatagattatattaatttaatctataagataatacaaatgataactattcctaatatcaaaaaaacactcgcgattttaaatcgcgagtgtttttgtcaaggatgaaaaggagtgaaaatagaaaggtgtttaattagttgcgaacgatagtgactgagataccagcgtttttagccatgtaagccgcttgagaaccaaagatcttacggctatcagatttaccaattgaaccaataacaagtagatcagcatcaaattgaggtaaaacgtggttgacaatccgttcagcaggtttagaaccttcatcgacgatggcagtgatttttttaggatctacaccgtaatcgatagctgcttggacgtattcgttgatccgcttgtttagctgatcatgggtactgtggatgtagtccttatcaagggcttgatagacgttgatatcattactctcaaggattgaaacgataccgatttcggagccgtcacgttttgccttatcgacagcatagtcgaaagcagcgcgtgcgtcaggggcatcatcgacaccgacgagaatcttgttaaatttttttggtgtaatttgaattgccatgttagtctattcctcccaattaaaacttctgttcaacttcgccgttagcttgtgcagcagcgaaacgtttattaccacgataaagttcaacagttgtccagataagcaaagcgagcacaccagcaatcaaaacgtaggcgatgccgttagcaagtgctaattgtgaaccagttgggttatcaccgaagaaaccttgaacagaaccaggcagcccgatcatgttgaggtagatgaggccaagaacagagacccaacctaaaactttaagccacattgcattcttgaaactacccatttcgaccttactatcggtcatcatgagtaatggcaacattgaaaatggtaatgcaaaggctaagaaaacttgagagttgttcatcagattgttgatggcaacgtgttctgcaacttcactcttaccagcattcattgtgacacagactaaaactggaatgacggaaatgatccgagtaactaagcgacgcgcccaaagtggcatccgcatgtgaacgaagccttccatgataacttggccggttagtgtaccagtaatagttgaattttgaccagatgcaagtaaagcaacggcaaacaagatcgaaagaattccagtgtgcgcaacgttaactaatgcaccgttggcgagaactgatgagtttgataaagcgtggtacaaaccgaagaatgaaggatccttaacggcgcctgacttgaagacggcaacccccatgattaacagaagtgagttaacgacgaaagctaaactcaattggatgttagaatcccaggctgagaaccgaactgcttgggcgacttcatcttttttgtcgtgatcgattttacgcgattgagaaatagcagagtgtaaatagaggttatgtggcataacagtggcaccaatgatcccaagggcaccagacaatggtgtgtcaccaccaactttatgcgatgttgaaaaagtttcagcactcggaacgaatccacgaaggacgtcaccccaagctggtgatgataaaataacttcatataagaaaacaattaagatcactaagatcaaacaaacgacaatggcttcaattttacggaaaccaattttagttaataatagcaatatcagaacatcgaaaacggtaatgaaaacagcaattactagcgggatattgaataatagatatagcgcgatcgccgccccaataacttcggcaatatcagttgccatgatggctaattcagttaggatccaaaggactaccccaagggttttactggttctagcacggatcgcctgtgctaaatccatttgtccgacaataccaagtttagcagccatgtattgtaatagcatcgcaatcaaacttgacatgaggatcacagagattaataggtattgaaagttttgaccaccggtgattgaagttgaccagttacctggatccatgtaaccaaccgcaattaaggcaccaggaccggaataagcaagcaaggttcgggcgaagctctttccttttggtacaacgacagtcccgttgatttcttcaagtgaacggccgttggcatattcaattaacttatgcttctttttgacattttgagtctcatccattatttgattctccttgtttatattttttgttcctaggtaataatactacatattttacgcgtgtaaacaaaaagtttggagctcctaaacttttaactaacgcggtttatcaaatgtaatcggttcctttactggtatgatagtaaaggataatctttacgattttttaaaatttttttgatagctggaaaataaaaagcaaaggtgattagcagtggggaggctaatcacctttgttagcgtatgacctttcaagtgggactgaaagggatgaattgtttctttagagagtgtgagaatttagagttgaaaaactgaagatcttatattttagggcttatatcgttgtcgtaaacgataaaatataaaattatcagtcacaaagtaacttatagcaagtaaggccatcaacggaattgacgttaattgtcattccgtctgttggctgctcattgagccaaaaattatgatcaaagtgatcgacaaagtggaagacataacgattttgattaagatgccgttgacgatcaaggtatccagaggacccgtctgataacgtcacagattgtggataaatgccggattttaaatatacttctatcatagtgtcaaaacctcctttcatggttattttaattgatcaatggattgaaatcaatattaatagtaaaaaaattaggtatgcctaaaattataagaaggaatcaatcttgccattcacagttattacgtttatgatcaatattatagtaagcgctttatttattaataagagggagtcgatcaatatggcaattgagattacggtaccacattttaataagattttggtgggggtagatgacgctcctgatgcgcgaatggcttttgattatgccgttgataaagctaaacgcgatggatcagagctcggcattgtttcgattcttgaaacgagtgatattaatgtttatcaggcactgagtaaggattttgtgcatggctcgcgtgatgaactagatgaacgtttgaatgaatacattcaagctgccgttgattatggtgtggatcccaaaaaaattactaaaattattgatgaaggctccaaaccagcagaacgaattattaatcatgttttacccgcatttcacgcggatctactggttattggttctgttagtaaggaaaatagtcgtaaattagttggttcgcaagcggcttatatggctaagaatgctcgtatttcagtgacgattgttagaaaatagaccactcactaaaattgtttcctctatttgacatataacatattcgacatataatatgtattgaaatgggaggaacgagtaaatgaattattggatattagcattaacctttctaagtgttaacctggatttcttttttatgttgatttttttattgaaaaaatattcgttagtaaaagtcatgattgggtatcttttgggtaatttaattttactgacactaagttttttcattggcaaagcactgttagtttttttacctgagtggattttgggaatactagggttcttgccaatctatttagcgtttcatgacgatgatgatgacgatgatggtaaggaaagtcattctcaaatatggagtgttttagtaacctatttgtcagtatgcgctggatgtaatttatcgatctttttaccagtactagtaggcgaatcaatgacgcattttttaatgacattagtgtttattggaattttgacattaatcgtagtcattttgattaaattaatagcggatgttccaatggtctcgtctgtcatggaagcacatggcgaaaaattaatgaaaatttgttatattgcaatcggattatatgtattctgggacagcgggctgattagtcatctaatagggctattttaatatatagttgtgaggggtaaaaatatgaaaatcagtgatgcgacattaagtgaagttgctgaaatttataaagtgctcagcaatataaatcgaattaaaattctatattttctggaaaataacgaggcggatgtttccagtattgttcagcatctaaagctggaacaaccactcgtttcacatcaacttgcaattttgtatcgttaccaattagttactaaaaagaaagaaggtaagcatgtatactattgtttagatgatccgcatatactagaaatggtagatgcgatgcttggacatgtagcccatgaaattaaaggggaagcacatcattatccccaagtggactgagttgaaaaaaaggtcaatagtcattatctgatacgagggctcgatttattaaatgttatggtttgatctttataggatagagactaaaaaagcttagtagttgaaagatttcactgctaagctttttcctatcaatattcaatttctactcaacttcatcagaggttgccgctttatcaactggtgtgttgaataaaggttcttcaatgccacgttcaacttctgcttgaatggtgatatgacagacgtgatacttttcttttaaaagtgtttcgacttgccgatagatcggttcaacggaactgaggggtctatcagatagattgatatgcgcagaaaaaatgatccgatgttcatcgatcatccacgcatgaacgtgatggacgccaataacaccttcaatttgagtaatatcggttttgatttgatcaaaatcaagatggggagatgattgcatcagaatgctcagtgtttgatgaatcactggacaaacttcgtagcagatatagatggcgacaagaatcgtcaataccggatcaagccagtagatattccaaaatgtaattactagtgcaccgataatgaccccgatggatgagagtgcgtcactaagaatgtggagataagttgccttgatgttcaaactatctttacttccctgttgtaggagtaaagctgatgctaagtttgcgataaatccgataaccgccacgatgagcattaactgaccatcgacaggttggggatgaaagagccgacgaactgcttcaaccattaaaaagattgagacaatgattagaaataaagaattcaagaaggccgacagaatttcagctcgtctgtagccgtaagtacgacgttcggtctcaggccgactgccgattacttgagcgaagtagcccatcaagatggaagcagagtctcccagattatgaaaagcatctgaaagaagcgctaaactgcctgaaaaaacgcctccaagaatttcggcaatcgtaatcagaatatttaacatggtcacccaaaagaatcgaatgccattgacacggtgtgaatgcatgatatcacttctttaaacaatatttttaggcaatcctaactattaaggcaatgatagactattattacttttcaatcaatgtttctgagaaaatttaagataaatcactatcgttttattttaaaatgttctattattgaggtcagtaacataaatttattatatagaagaaataagtcagttgaggtgacggtattgaccccgatgaaagaggactatatcaagataatttttgaactcggtggtagaaataaaaaaatatcaaataaagaaattgcacttggtctggacgttgcagccggatcagtgacggaaatgatttctaaattggtggaagaaaagttggttgttcacgagccctacgcgggaatttcactaaccaaaaaagggttgcactttgcaactgaactggtacgtaaacatcgactgtgggaaacgtttcttgttgataagttgcagtacaatattgctgatgttcacccagaggctgaagttttggagcatcagaccagtgatcgtttggctaactcgctagataatttcttagggcaccccaagcattgtccacatggtggcgtcattcccgatgaagcgggtaattttgtggatatcagtcatgccatgttagcagacgctgaggacggacagactgtcgaaattgaacgcttcctagataaccacgaattattaatctatattaatagtttaaatcttaaaattgatgatgttgtccaagttgtgagtcatgacccatttgaaggcccaattcacgttattcgggtaacggatcaagctgaaattgcgatttcctataaggcctcgcataacattttcgttagaaataccaacgaatagcgtgaatgtgttgctttgttgattattagtatctttttttgaaatcgtgtgctatactcattcatgtagtttaggtaaggtaattttggttcgatcgtttcattgtttggaatatccccaatttgcaccggaacatgaattacaaaataaatatgtgcaaattagcacaggaggattttcaacatggaacaaggaacagttaaatggtttaacgcagacaaaggttttggatttatcactcgtgaagatggcaacgatgtattcgttcacttctcagctatccaaggcgacggcttcaagactcttgaagaaggccaagcagttagcttcgacgttgaagaaagcgaccgtggaccacaagccgttaacgttaacaagcaataagattaattattgaaaatatggttcccaaatcatttcgatttgggaacctttttttgtattgctaatcggccaatgatggctcataataatctggttgaaatgcaattagtaaatggatgccaataatattgagttaaataaaaaggggtgataccagtggttaatagtgatcaggagcaggcagaagtgatttcagcgtgtttgttagcaggccgaatattggttgaaaatggatctgaaatttcgcgagccgtcgataccatggagcgcattgccaaaaatgccgggatggattcggttcaactatttgtgacggtcactggtattatgctgtcggttgataatcagccgaatgcgcaggtcgcgggaattagtcatcggacaattgatctagacaaggtggctcgggtaaatgagctttcccgtgaatttgcggtacataagattaaactttctcaaatggtttcacgactcgatgaaatcgacaataatacaccaacgtttccgttttggcagaaactcttggcgtcgggattactgagtgcggtgctattgattgtttttaccaaggaatttattgatgcgcccgccggatttgtgattggggcgatcggctatgccgtcttttacttctttaaccgccagtttaaggttcagtttattagtgagttctttgcatcattggtaattggaattttggcggctttggcggttaaattaggtctgggggtctatctcgataacatcatcattggtggcgttatgccactggttcccggggtaccaattacgaacgcggtgcgcgatacggtagcaggtaatttaattagtggcccggctcgggcggtcgaagcactattgtcatcgattgcgattgggtgtgggatagtctgtgtgttgcacttcttataggagaacgaaatggatattttaacggttgtttttgaaatgttaatggcctatgttgcgacaatttgcttcggggtgattatgaacattccgcaccaagcattcaatagtgctggcctaatcggtggaatttcttggggcttttactgggtgatttcacatctgggagtggggattgcttttggtaatctgttggcagccatgctgattagtattttgagtatgtatgcagcgcggtacaaaagaatgccggttattatttttaatattccaagcttggtttcattcgtgcctggtggtcaggcctatcagacaatccgcaatttcgcgattggtcatacggccacggcctgggggtttttaatgcaggtagtcgtcattgctggcgccctcgcgatggggtttgcgctgggtgaattgtatcaccaaattggattgcatcactggcattgcttattgaagcggcaatcaaaatagtagagtcttaataattaaagtattcgttatatggtatactttgactgactaatattttcgggggaactcatttatgtatatggaacgtgattcagaacgactgaaacgctttttaatttgcggtgttatttttgttatcattgccgccatggtctattcgaattcagtcgtttttcaactattcgactcaatgttacaggctttctttaccggcacaacaacggactttcggacaatgctaatgaagttagtttcatttattggtagtcctaaaatgtcgattatttatgtggttatcattgcctttttcctgtggggctttaagtataagattcccgcactttgggcacttggcaccattgcgggtggagacgtggtcgcctacgtagtgaaagatattgtgaagcgggctcgtccagctcaacacatggctactgatgatgggtacagttttcctagtggtcatgtatttggtttcttcttggttgcagccatcctgtttatggttgttatcccgaacttgaagaagagctggctacgtttgctatgtcaaattttgctcgtgctctttattattatccttgcgatttcacgagtttatctgtacgcacactatccaagcgatgtcattggggcaatgctattagcttacacctggttacaggttgcacaatggttatatgtttggttggcaccaattttgcaacgatggtcgtttttagccaattctgaaatttaattaattgcaaaagatagtgaaaattggtaactttaagaagtaaagtagtgtggttacttttggtttgacggaggtggagctaatgaaactacatcgttctcagaataaagtattttctggtgtattagcgggatttgcagattatttcggctgggatgtctcgttgacccggattgcttacgttgtgttggctgtatttacaggattcttcccatgcctgttaatctacattgcagccgcaattgtgatgccggaagactaattaaaaagacgactgaactgtatcaatcggttcagtcgtctttctttcagctacttacaaagtttcttttaaccactcgtctgcgagcgtgagccagtgagcaacgtgtggttgatcggcatctggtttccacgcggtggcagcggtggcaagcgccattccgtgaggaccatgacgaaaaacatgaagttcttgcgcgatgttatgagctgccaatgccgtgctgtacgccaacgaattagcaacggggacaaacggatcgtcactggtgacccatgtaaatgtcggggcgttgtaatcgttgacgtgtttttgagcagcaaaccggtcgagatcatctcccgcccattgatgagcacggtgctgatcgtcgggaaagcccatttgaaggtcaatgaccgggtatcctaagatggccgcgttgggtttaagttgatcagcggtagcttgcgtttggtttgcaacccagtctgaacgccaataatcattgtataggctgacgacgtgaccaccaacggaaaagcccattgggatgatttggctagggtctacctgccattgggcggcattttcacggatcaaagcgatactcttacccagctcgatcagtggtgcgggtaataatggggtctgttcatcttcgaaactatatcgcaatacaaagcactggtagtgacgtgcggcaaaagctaaacaaatattttcagcctgctcggtttggatatgcgtatatgatcccccggggacgtagatgacagcgggaagttgttggtgatcattacggggatccaaatctttgaggtagcaagtgagggtcgcctgagtttgatactcaggactggataaagactgtttgaagatacgcaaaattgttcctcctatgcaaaattattttctggagactattataatgcaaaaaacatataaaacgaatcgattaatcattagtcaggttcagctcactgatacagaggcattaatggcggtgttcgaagaccgtcaaattgaacttttgagtgggttgttattgccatcgaacccgattcaacggtatatggcatttcaaatgatgtgcagtaaaccgtatatttatgtcatgcgtcagttggcaagcaatgaattggtgggcgttgttggattttatccctgttatttacgcgatgagatgccagccattgatgatcgtgaaattggctatgcgctaaaaaaggaccaatggaaccaagggctaatgacggaggcgtgtgggccacttgtacaggatttcattgcggacgatccgcaacatacggtccacgcgaatgttttaccgcggaattttcgttcgattcgtgtgctgcaaaagaatggatttgatgtgacccccgcgccaaattacttgacggttgatgacgacgaagagaaaatccatctacaacggggggcacaaaaataaaaatacacttgtagtttgggtgatgtggtgtataatactctcatatcggaagaagaggttgcatgactcatcagtagtcgttgttaggtgattaagaaccggagcaatgatgaaagggtgccatgccgaaatggaacgctgcttattcagcgaactgttgggccctgattgaataaatcagggactgtcgcaatgtgataattgcggggcgctatcgacgatttgaccaagattacatagatattgggtctttttgtttggtgttctcaagcaaagaggcctttttttattgaattggcaagcgaggctcttttgataactaaataggtaagggagatcaatatgggaacacaagattcaaaacagcaacatcatggtgtgcgacggtcgctgaagacgcgtcacttatcaatgattgccttgggcggttcaattggaacaggattattaattgcgagtgggtcaacgattgcacaggcgggaccgggtggctcaatcgtcgcctatgccgtcatgggattaatggtctattttctgatgacaagtttaggtgaaatggccacgtatatgccgctaacgggatcgtttgccgcttactcgacaaaatttgtggatccggcactgggatttgcaatgggctggaattactggtttaattgggcgattaccattgccgttgaaattacaacggccggtgtggtcgtgaatttctggttaccaaatgttccaagctggatttttagtgcaattacaatggcgtttattttcattattaacgtattgtctgttagctcttttggtgaggcagagtactggatggcaattatcaaggtgattacgattatcatcttcttgattgctggtgtctgcattattgttgggattttaggtggaacttctgttggatttcacaacttaacttacaagaaggccccatttgttggcggcttctcctcgattattggggtattcttagttgcgggcttctcattccaaggtaccgaattaatcggggtgacagctggtgaatctgaaactcctgaaaaaagtattccccgggcaatacattcaacgttttggcggattctcttgttctatatcctcgcaattttcgtgattgcatgtattttaccgtacacaagcaagaacttgctcggatcatctgtatctgacgttgcgatgagtccctttacgttggttttccggcgcgctggtttggctgccgctgcaagcgtcatgaatgcggtaattttaaccgcggtgatttcgtctgctaactctggtatgtatgcctcaacccggatgctgtattcgctatcccttgaaggctatgcaccgaagatttttggaattaccaatcttcgtggcattccagtatatgcgcttttagggactacggtagtcggggccttcacttttttaacaggaatttttggtccacagatttatgaatttttgattgatgcgagtgggatgactggatttattgcctgggtcggcattgcaatttcacatttgcgattccggcgcgcctacattgctcaggggcacaaggtttccgaactaaagtaccatgcaacattattcccattcggcccaattctggccttagtactgtgtttggtggtcatcattggacaaaatccaagctcgttcattcacttgaattggcaacaaattaccattacctatgtcggagtaccattgtttattattctatggttgtactacaagattcgctacaagacacatgtcattccgctgcaagaggttgacttgaacccgcggacaaagagtgaatcatacgaaggatagcatttagttttgtgactggttcttaatccaatgggttaagaaccagttttatataaaattgtaatttcactgttttgtaattaattattaattttagttttcgtcatatgatgatacaatagacctcgtgtctttaaagacgataaaattcatttggaggaaattttcatgatcgtattatctggaacaattggagccggcaagaccagcctcacgcaaatgctcgctgaccacttaggaagtaaggcattttatgagtcggtcgatgacaacgaaattctgccactgttctataaaaatccgaagaagtatgcgttcttactccagatttattttttaaataagcgacttgatgaaatcaagggcgcctttgcaaacgatactgatgttttagatcggtcgatttttgaagattccctgttatttgggctcaatgccgaccttggtcgggcaacccagacagaggttgaaatttacgattcattactcaaaaatatgatggaagagttacctgacgaaccacataagaaggcgccagacttgatgattcatattcatgtttcgtttgaaacaatgttggatcgcattaaaaagcgtggacggaactacgaacaaattgaaacggatccgagtttattcgactactacaagacgctcaatgaacggtacgttaagtggtatgacagctatgaccaaagccctaaaattagcattgacggggatcagtttaatttcgtagaagatcctgcggcggcacagaaagtcttgacgatgattgacgataaactcgatcagctatcattgaaatagcaccaattgagcctctcagttattgagaggctttttttctgatcaaaatatgggctaaagggtgacttatttgagaaaatcatctatgatataaaacagtcgtatgtacacgcttgcattaattatcaataaattaaggctcagggaagtgattgtcacgcttaatcaaaagaaacatcgattatcattaccacaattgttaacgtttggttttctcggtattatcttaatcggaagcgtgttgctttcactcccgattgcgaccgatactgttacgggaacggattacgtggacgcactgtttaccgcgacatctgcgacctgtattactgggttgacgaccattagtactgcagcccactggtctgtttttgggcaaattgtcattatgatcttggttgaaattggtggccttggatacatgacgtttacggtgttgctattttcgatgatccgaaagcgaccgacattgacgactcggatgatggtgaaggagtcgctgagcctggaaacgttggctgatgttaagacggtaactaaatatgtcattgggttgtcgattgtgatccagaccgccggcgtttttttgctgatggttgatctggtaccccgttttgggttactgaagggagcctactttagcctttttcactcggtaatgggtttttgtaatgctgggtttgatctgtttggcgacagtttggccagttttgcgaatgacccctacgtcattttggtgatctcgatgttaatcgttgctgggggtgtggggttcctagtgtggcgagatctgttattatggcgccgccggcatcgtgtctcactgcataccaagatttctctaaccacgtcgacagtattaacagtgagcgcgacgctgattttatggttttcagagcatgggtttcgggcgttaggaagccacgtgaatttgtggtcgcgaatggtggatacgtttctactagcggtttcaccgcgaacggcaggacttcaggtgttgtcatactcgcatatttcgatggctggcattattttgacgatggtgctgatgtttattgggggcactcccggatcaaccgcgggggggatcaaaacaaccacgctggggatcttatggatgcagagttgggcggcgctgagaggtcaagaagacgttgaatttgggcaccgacgatttagtcaggaaaatatttatcgggcttcaatgctggtcttcattagtgccatgatcgtaattattgcagtaatgctgctctcgatttcggaaccgattcctaaaggacagggcctggaatatattttattcgaggttctctcagcgtttagtaccaccggtctatcaatgggattgacgccccacttaacgctttttggtaaaagcattattatggtgctgatgttcattggtcgggtgggactttttacggtgatgtacacgattctcaatgccaatcggcggcaacggcattatcggtacgttgaagaaggcgtgatgatcggataacgtgataaaacggaggaattcaaatgaagcaatcatttgcggtaatcggactaggtcgttttggactaagcttgtgtcaatcattgactgcgtctgggcaagatgtcctcgcggttgataacaatgaagagttagttgaaagttataaggaaattgtcactcaggctgtcattgcggatgcccaagatgaagaggcaatgcgtgatctcgacattggaagcttcgatcatgtcattgtggccgtgggacaaaatattcaggcgagcatgttagcgactttgattgtgaaagaattgggtgctaagcatatcattgcgaaggcggaaacagcgatgcatggcaaagcactcagtaaaatcggtgctgatgaagtggtcttccctgaacgagatatgggacaacggttggcaagacggctgttaagtcataatattttgaattttttgtcgattagtgatgagtacaccctggcagaagtacaggtacaaaatccaaagtttagtggcaaaacgttagcggaacttgattttcgccggcattatcggttaacgattgttgcgattaagcatggtaaaaaggtcatcatttcacccggtgcccacacggtcatagatcttggtgatacattgtcggtagttggtgaaacgatggatgttgaacatcttgataaaaaactatcggaagattgagatttttattgaatggggtcaaattgtgattgacaattaattttttagatgataaagttaaatagttgttttgatcaacgatttgatttatggaggattagctcagttgggagagcgtctgccttacaagcagagggtcacaggttcgagccctgtatcctccattgccgtttagaacggcggttaattattattaaatatgcggatgtggcggaactggcagacgcgctagatttaggttctagtatctttgtgatgtgggggttcgagtcccttcatccgcactatttttttgccgacttagctcagctggcagagcatctgtcttgtaaacagggggtcggaggttcgaatcctctagtcggcatcatacgacattttacaagtcaatcaagctaggaagaacgttaacacaacgttgttcctagtcttttttcatttacccacaaaaaagaactatgataatcatcatagttccgtgactgctagttttctgatggctggggtgtttgcgtttccgagtcaccaatggttgaaattgatgatgtttcggtcatccgccagtagactaccagtgaaatgagactggcaaaagcaacgtagtagaagaacagcgattcaaaatgaacggaacgtagccaaagggcaacgtattccactgttccaccgaaaattgccactgtgagtccataagggaggccgactccgagtgcccgaatttccgttggaaagagttcagctttaacgatggcattgattgaggtgtacccggagacgatgaccacaccgaacagcatcagtaagaacgcgtgccatggagagttcgttttagcgagcagcgtgaagatggggacggtaaaaatggtgccaccaattccgaaccagaggaggagtggtttacgtccaattttatcagataacatgccaaagagcggttgaaggattagcataatgagcagggccgcaaagttgatgatggcgacgacttctttgttgaggcctgtcgtattgatcatgaatttctgcaggtaggtggtgaaagcatagaagccaatcgtaccaccaaacgttaaccccacgacggtgaaaaattgtttggggtatctcattaatagtgtcaatgtgccggcacggcgatttctttgtcgtttgacggtgttaaattgatcagactcttccatggaaagtcgcagccaaaggacgattaaggcgccaaatccgccaatgacaaatgggatccgccaaccaaaggcgaatagttgggcgttagtgaggacgttttggaggacgatttgaacgagtagcgccagcaactgaccggaaatcagggttacgtactggaaggatgaatagaatccacggcgactgggagaggccatttcggagagataagtggccgaggtaccgtattcaccgcccaatgataggccttggaataggcgggtgaccaccaaaatgaggggtgaccagatcccaattgtgacaaatccgggagtcagggcaatcacgaacgacccggtggccataataattacggaaagtgtcagggcacttcgccgaccgtgacgatcagcgtaacgacccataataaaggagccaaggggccgcatgaaaaagccaacggcgaaaacagcggctgttgaaaggagttcagcagttttattttctgccggaaagaaagcggcggagaagtagattgcaaaggacgcataaacgtaccaatcgaaccattcgatcatgtttcctaaagagcctttaaagatatttgccgcaatttgtttttcactgcggatagcgtgtaatgccatcgaaccactccaatctgaattaaaatactgttagaaaaattaaaattgcattagaatcaattttacacgaggatgtcaggagaaacaattttagaaaacgagttaatttttgactgaaactattaataatttgttcccagtagtaaataacttaagataacaatgtgaaacggttacattgttttttcgtcaactgttagttggttgctttgaaaaaagactcgattttgagaataaatacgtactttctctaaaaaagtattgacgatacataggaagtaatgtaatattatacaagtcggatggttattgtttgacaaatggttaatttcatgcggaagtagttcagtggtagaacatcaccttgccatggtgggggtcgcgggttcgaatcccgtcttccgcttttttattttcttatgcacccatagcgcaattggatagagtgtctgactacgaatcagaaggttgtaggttcgactcctactgggtgcatcatcgggaattagctcagcttggtagagcgcagcgttcgggacgctgaggtcgcacgttcgaatcgtgtattcccgatacgctaattcctaagccgtcattcaacgttacaaacgttggaatggcggcttttttgtgtttttgtgaagcacgtgaattgattattgaattggcgctatgaatgcgggtatcaattattgctaagagcggcaactaaatactaagcaaacttcggtacgtactgagataaacaactgccaataccaataccaatttgaatatgttgattgaatgatttcggtttggctttctttttgcgtcccacgtgtataatgctcgcttgaatgtggattttgtgactgcgtgaaccaagcgagagttcacggaataaattcttatagtattgtcaaaaaaggtttttaacaccactgtcatgaagaatgcatattttgccaaatttgcataatttaaaacgataaactaagtaacagcttcattaaatttactaaaattaaatttttttacgatactagaccaattaatttaactaatataaaacgtgaattaccctgataaatcaggataattgatcaggtaaattaaaaaataaataatttatcagatcaattatttttactagtaaagggatttaaaaagcgtgtgtcctctcaagtggagttattcacgaaaatggcatttgcaaacaattgaaataatggtaaaaagaatatgcaaataatgaaaaagcagtgttcaatcaattatttgaattccgaaattgtccgtaactataccaactgatgtgaaaatcaggatggcatgggcttaaatatgaaaccggttgcacaaacgtgaaaagtgattataataatgcttcgttagtaagttgtagcggaactaacgtgaggagagattttatgcaaacacgacacttgagtattttctttatttttgtttttggtgcgttaggtggattattatttggatttgatactggtattatttccggtgcatcatcgttgatcgaaaacgattttagtctgaacgtagaacaaaccggtttcattacgtcgtcggtgctgattggctcgtcaatcggtgcactatcaattggttcgttatcagataagttcggtcgtaagcgtcttttattatttgcttcaattttgtttttgatgggttctggattgtcaatgacggcagccggttttgtatcaatggtcgtggcacgaattattcttgggtttgccgtaggatctgcatcagccttaacgccggcatacctggctgagttggccgatgccccgcaccgtggttcattagggaccatgtttcaattaatgataacgcttgggattctgctggcgtatgtctctaatctgggatttttgcatcataacctactcgggatgcgtgactggcgctggatgcttggttcggcactgattcctgccgctattttgtttgttggatcattaattttacccgagtcaccacggtttttggtggagaaaggcaaggtcagtgaggcccatgatgttctaagagggctacgtgccaacacggaccaggatccagaccaagaattggctggtattcagcaggttgccaaccaaccgaagggcgggctaaaagaactgttcacatttgcgcggcccgcggttatcgtagcaattggtttgatgtttttgcagcaattagtgggaattaattctgtaatctattttttgccacaggtgtttattaagggatttggatttgttgaaagcaatgctatttggatttcagtaggtattgggattgttaactttgtctgcacgattttagcctaccagatcatggatcggttcaatcggcgtacgattcttctattcggttcgatcgtgatggcactggcgattgggacactgtccgttcttaattttacgttgagtgtccaatctgctgctatacccacgatgattctaattgctgtgtacattttcgggtttgctgtatcatggggccccatttgctggttaatgatcggcgaaattttcccactgaacgtccgaggtgtcggtaattcaattgggtcggcggctaactggattggtaatttcattgtgtcacagttctttttggttctgttgagtatttttcacaataacgttggtggcccgtttgccgtctttaccttctttgcgattgtttcgattttctttgttatttacatggttcctgagacacggggaaaaaccctcgagcaaattgaaatggaaatgcgtaacaaggaagacgcaaagcagtaatacgtgaaccgagagaaacgcgctatgtagctcctttcgtgttctgtgctaattgactttaaataggatgtacggtaacgacgtattatgtttcgctaaaaagaacttttcctctattgataagtctagagcgaaaggacttttctatctgctgttttcttgatatcaaggatttagcacattattgttcagaacattgcttaccaactaacttttgtaggactcgcattgcgggtcttttttgcttctaaaatggaaccaaacaaatacgcctgttcttctgtgacgaagaacaggcgtattatttttttgccgcgcagcgaagttaatttttaaatgaatggatgggagctggaattcgaccaccacgagcgacgaatgcggttggctgactttcgctaactgccattaccggtgcgtgaccaaataggccaccaaagttaatatcatcaccgacttttttaccagttgcggggatgattcgaatagcggtggttttattgttaatcatcccaatggccgcttcatcagctaagataccgctgatggtctgcgcggtagtatcaccgggaactgcgatcatatcgagaccaacggaacaaacggctgtcatggcttccagtttttcgatgctaaggcggccagcttggacggccttgatcataccagcatcttcagaaacggggatgaaagcaccggagagaccaccgacatggctacaggccataatgccaccctttttgaccgcatcattaagcatggctagtgcggccgttgtaccgggggcaccaacgctatccaacccaatttcttcgagaatttcggctactgagtcaccacgagcaggagttggcgcgagggagagatcgacgataccaaaggggacatctaaccgttgggaagcaatttgaccaacgaattggccaactcgggtaactttaaatgcggttttcttgatggtttcagcaacgacatcaaaggaagcccctttaacttgttcaagggcccgtttaacaacgccggggccactaatgcccatgttaatcacgcaatcggcttcgccaacaccgtgaaaggcgccagccataaatgggttgtcttctacggcattacaaaaggccaccagattcatgcacttttggggatcgattgctgcaatttgtttgacgatttggccgacttcggccacggcatccatgttaataccggaacgcgtcgagccaacgttaatggagctgcaaactcgacttgtcgcgtctaacgcttctggaatagagctgattaggctgcgatcgccagactgataccccttttgaaccagtgcggaaaagccaccaataatatcgatgcctaaatcggtggccgctttatcaagtgtccgtgcatacttaacgtagctggtagtttcactagccgccgcaatgagggcaattggagtgaccgaaattcgcttattgacgatcggaacgccatattccttttgaatatcttcagcgacttgtaccagattttgagccttagctgtgattttatcgtagattctctgacaagcacgatcgctattgctatcgatgcagtcgagaagtgaaattcccatggtgattgtccgaatatcgaggtgttcttcttcaatcatctggatggtatcttgaatttgtctcgtttccatgcgttaaccccttagattttttgaatggcgtcgaataattcttgacgttgaagatggatggaaacaccgatttggtctcctaattgattgagtgctttttggagactgtcgaatgaagttgtgtccgctgcgaattcacccatcagcatcattgtgaaactaccatgcatgagggtctgggacatatcgatgatattaacgtgcaattgagcaagttcttgactaacggctgcaacaatgccgactttatcgttgccgacgacggtgataataactttcatgatgtaggctcccttatgtgaattagtaccattataaagaaaaaatgacgaagataaaccataaaatgagaaaatgattaaattatcttgaaatcgttctaaagcgaacgactttcccagaaatttgaattttttttgaataaatttacaattttttattgtgacttagtaaaattttaatgcactgatataacttagataaataattattgatacacgaaactattaaaaatatgtgactaaatcccgttaaatcaagtattgacattcacggggtgaaccgataatgtaataaacggttcacggcattaatcgaaatgtcaaacgaagattttgaactgagagaacggaggacaaagaatgctaagtaattttgggactccacgtatgcgtcggattgcgtatattgtactagctgtgctggtacccgcagtattgttaatagcaatttttaactttattcaatacgaacaacatgctgcgacaaagaacattccggttgctgtggtgaacaaagatcaacccgcagaaagtaatggtcaactgattgatgttggtcaacaagtggtgaataccttaaagaaggatcaccaagttaaatgggaatttgtgagtgaaaaaacggctaagaagcaacttgcagacggggatgcttacttagaaatcgaactaccgaagaacttttcagagaatgcaacgacattaatggcaaagaatccgaaggttagtttgattaagcttcatgaatcaaaacggaataactttttatcttcaatggtgaccacaacggtggcagacaccgttcaatcacaagtgaagaccaaagtacaaaaggtttatagtcagaccctgttgagtagtttgaagaagcttggcaatgggactaagcaagctgccagtgggacacaacagcttgatgacgggatgacgcagttgaaagacggtcaaaccgaaattacccggaacttagatttactttcgactaagatggttacgtttgaatctggtgctaagacgctcaaagatggtgttgatacgtataccactggggtagatacattaacagcagcggataagcaactggctgctggtctgcatactttgcaggaaagcgcggaaccattggttagtggtactgcacagctggcaactggatcgaagacattatccagtggggttaagcagtatactgatggggttttacagttgacttctggtaatcaacagatcaatgcgggcttgagccagttgaacagtaaaacgggagccttgaagtctggaacagatcaattagcgactggatctaatagtttagcacttggacttcaccaattacggtatggggttgaaggaagtagtgatccagacaaagctggaattgacagtggcttggaacaaattcaggctggtatttcagcaaacgattcaatcattgcaagcgtttcggacatgacaaagcaaatgaagcaggcccaaacggacacagcagctgtaaaatcagatatggcacaactacaaagtggattagataccctgaatagtttagttcctgttttacagaatgttcagtctgcgaagacgatgctaaacatgctcagttcaacgtttccagattctggaactgttggtaaagaagcaacggatgccaataataaagcgcaagctgtattagatgcggtcaacgctttacctgcagatacacctaatttagatgacttaaagagtaaagctacgcaaagtgtggctgcaacaaagacaattggatctgatggaacaaaggcggcaaacgatcttaagcttgtacaatcacaggcaagtggtctttttaacagtttgacgttgtcaccaactgatgcaaaaactatgattaatcagcttcaagatttaaaagatgaatcaagcaacttactggatgaaaccagtccactgctgtcggacacgacgattaatgaattgaattctgttgcaagtagtacacagactttgaaaactggtcttagtcatttccagagtgtcgttgattcaaatctggatcaattaagtactggtgcaacgcaattagctgatggcaaccaacaattgtctgaccaggcacccgcattagttagtggtgtccaacaattgttagatggtagcaatcaagtagttgccggtggtaatcagttgaatgcaaatacgagtgcactagttagtggtgcggcacaacttgcaactgggaacgcaacacttgctgcttctgctcctgctctgatctctggggtggcccaacttgtttctggtggcgaccagattgtttctggtggtaaccaattgacgggtgctagttcacaacttcgtagtggaacgagtcaaatttatgacgccacggtcactgcgaaatctggtgctgatcaattagcaagtggttctcatcaattacttgatggaacggatacagcggcagatggtgttagcaccttgaataaggccttacaagatggtgccgatcaaatcggaacaatccatgctggttcaagcaatgttaaccatctcgcaacgccaatcagcaataaggaagagggggccacaagcgaaagcttgaagaatacatttgcaccattgatgttggccctagttctcttcttaggggctgtggtgacccaactgggactcttcactccagagagacggaaacgtcacacactatttgaagaaccactgctggcaattggcttaacggccgttgcgcaagcggtgattgcggatgtcttgttggccgttctcggtgtgagcgttgctagctggtttgggttaacgttcttctcgttgatcgtttcggttctctttaccgcgatctgcatgacgctttatcacatgtttggccgtgttggtgtcttgtttgctgtcttgctggcacttcttcagatcattattacgggacaggtattccctaacgcaatgctctcgagcttctaccaaggtatcgcaagcatcttaccgatgacgcatgcaatccacggtttcgatgcattgattaatggaacaaactacaatgtcttacttgccattgtcttcctgttactctttaccgtagtgctcgccggaatcgcgtacctgattgatttccttgttgcaaaacgattaaccgataatgaaaaacctgaagaaaaataaagtaaacgttctttgaaaaacaatagccgtactcgctaaattggggagtacggctattattttccgggattgagacaaatctatttgcatttagtgttagactttgtataatattagtcaacattagtcaaagaatggggaatcaataatggaaggtcaaaatatttctgatgtcattgaacgttacttaaagactattttggccgattcagaacatgttgaaatcaggcgctcagagattgctaacttattcgacgttgtcccgtcacaaatcaactacgtgataaagactcgttttacgatccaaaatggatacatggttgagagtaaacgcggcggtggcggctatattcgcattgagaaagtcaatttacttgatgatgtgagtgtgttaaattcattaattaaagtaatcggcaattcaattagtgaacgagatgccgtctcaattattcaaacgttgtatgatgagggggtcgtgagtcgtcgtgaagctgatttgatggtggtggcgattgaaaagtccacctattcaattagtgatcggcaactcgagaatgcgttacgagccaacattttgatttcgttgttgaatcgactgcgttacgaaagttagagaaagaggggaattgcgatggataacctatttacaccaagtgctaaaaacgttttggtactggcacaggaacaggcaaagtattttaagcaccaagctgtgggaactgaacatctgttactagcattgagtattgaacaaaacgggattgctaataaggtgttacaacagttttcgattactgaagatgatatccgcgaagaaattgagcgattcaccggttacggtaccttaacaaatattgataaggatacctatctcccatactcaccaaaggcaaaggaaattttggctgcggcgggggatgaagccaagcgtttaggggctgttaaaattggcaccgagcacttgctccttgcattgttaaccgacgatagcattctatcttcacgcatcctattaaacttaaatgtcgatttaaatcaaacacgtaaaaacgtgctacgacggttaggggttgctgatacgacgaaacgtcatcagaataatcgggctaagaaccctcaaccacagggcacaccaaccttggattcacttgcgcgtgatttaacacagagtgctcgggaagacaagatggatccggtcgttggtcgtgaacaagaagttcgacgggtgatccaaattttgagtcgccggacgaaaaacaaccctgtcctaattggggaacccggagtcgggaaaacagctattgctgaaggactagcacaacggatcgtggctggtaatgtgccagatgatttagcatcgaagcgcattatgatgcttgatatgggatccctagtggctggaactaagtatcgtggtgagtttgaggatcgtttgaaaaaagtgatcgatgaaatttatcatgatgggcacgttatcttattcatcgatgaattgcataccctcattggtgctggtggtgctgagggggcgatcgatgcttccaacattttgaagccggcattggcacggggtgagctccaaacaatcggggccacaacccttgatgagtatcaaaaatatattgaatccgatgctgcattggagcgtcgttttgcaaccgttcaggtcgatgaacccacagaagatgaagccgtcgcaattttaaaggggcttcgtggccgctatgaggatcaccacaaggccgaaattacggacgaagcaattattcaggccgtcaaactatcatcacgttatattagtgatcgattcttgcctgacaaggcgatcgatttgatggacgaggccgcagcaaaggttcggatcgatgctgaggacaaaccaagcaagaagacgaagcaagttgataagctggagcaattgcgtcaggataaggaaaaggccattgaagaacagaacttcgatttggccgctgaaatccgacagcaagaattgaaacttaaagaaaaagtcgatcaacaggctgaaaaagataaaactaatcgtcaatacgacttacaggtgagcgaggaagatgtcgcccaagttgtcgcagagtggacgggtattccgttgacacaactgcgtaagactgaaagtgaacgactggttaacctagaaaaaattctgcatgaacgcgttattggtcaggaagaagcagtttctgctgtggcacgggccattcgacgggcacgcagcggcttgaaagatcctaatcgcccaattgggtcattcatgttccttggaccaactggggtcggaaagacggagctggcaaaggcattagcagaagccatgtttggttccgaggacaacatgattcgggtggatatgtccgaatacatggaaaaatatagtacgagtcgattgattggtgcggccccaggctatgtgggctacgatgaaggtggccaactgaccgaaaaagtacggcaacatccgtactccgtggtacttcttgatgaagctgaaaaagcccatccagacgtcttcaacctactattgcaagtactagatgatggttatttgacggatgctaagggccgcaaggtggactttaggaatacgatcttaattatgacatctaacttgggtgcaactgcactacgggatgaaaaggaagtcggattcggcgccaaggatgtgcaaagtgattatcgggcaatggccggcgcgatcacagaacagttgaagatgcatttccggccagagttcttgaaccggatcgatgaaacgatcatcttccattcccttaagaaggatgaactccaccagattgtcaaattgatgtcgcatgacctagtcaagcgggtggctgaacaagcgattacccttaaatttacctcggcggcgattgacgtggttgcgaaggcgggctttgaccctgaatatggtgcacggccaatccgccgggccctacaaacagaagttgaagaccggttgagtgaagcaatgcttggcggtcagatcaagattggtgatacggtcgtggtcggatctacacgcggaaagatcaaagtgagcgtgcaagatgatcaacacaactcacggttaataacaactaactagttaactagaaaagctcattttgaaccagctaaggttcaaaatgagcttttttgaaaaaatgggggacgattgctaatttctagttgtaaaatataggctttcagcagataattgtacttgaagctcaacaaattaagatttttagctaggattgagaggaatggcaatgagacgctccgagcagttggaacaaacaagaacggcgattttaacgaccgcacgaaaattatttttaaagaatggttatcaaaatacctcaacacgtgatattgcgggcgaaatcggaattacccaaccggctttgtatcaccactttaacgataaagaggtgattttcttagaagtcatttctgaaattggtaaggaagttcgtaataatgtcaataagacgcttcggaagcagaatttagatccagaggaacgcttattcgaaattaccaaggtgctcaccaaaattcaccataacagcattacgacactaatttacgagagttacaaagaactgtcgtcaagtggaaaacggaagttggaaatgttgtttaagatgaattatttggcaccaattgcagaatattttaagttgccagaagtaccattacgcgcggagattctaccggatgaggcagcggagttctttttagcggacattaacacgttatttggcacgtttaataagcttggaggacaccaattgtccaatgatgaccgggttaagttgaccctgcagttcttcctatatggaattgcgaccaagtaaaaaattaattaagaacgaacaagcacagctattgacttataggagctgtgagcatataatgacgtctgtatgtagttgcgagttcatttgagtcgtgtgatctattgtccatacgattcttcataaaaaccaaagatagcagaggctatttttggattttttttgctcaaaattgggttaaattacaatttgtaatcaaactgtaacattcgatttgagatgaacttgtggaataaattagagaggtgaacagcttggccggacatttagttaaatacggtaaacaccgtacccgtcgtagttattcgcgaatcaaggaagttctcgatttgcctaacttgattgaaatccaatcaaactcatatcaatggttcttggacgaaggtctgcgggaaatgtttgatgacattatgccgattgatgactttcaaggaaagctatcattggagttcgtcgattatcagttattagaaccgaaatatacagtagatgaggcacgtgaacacgatgccaattattctgcacctttgcatgttacgttacgtttgacgaaccacgaaactggcgaaattaagtctcaagacgtcttctttggggacttcccactgatgactgagcaaggaacgtttatcattaacggggcagaacgggttattgtttcacaattagttcgttcaccaggaatctactttaatgaagaactcgataagaatggacgcccaagttacggtgcaacgttcattccaaaccgtggtgcatggttggaatatgaaacggatgctaaaaacattgcttatgttcggattgatcggactcgtaagattccgttgactgaattggtacgtgctttaggatttggttcagacgacgaaatcatcgatatgtttggcggtagcgaatcactatcattaaccttggacaaggatgttcataaaaacaatgaagattcacgtgttgaagaatcattgaaagacatttacgaacgacttcgtccaggcgaaccaaagacggccgactcatcaagaagtttattgacggcgcgtttctttgatcctaagcgttatgacatggctcctgttggtcgttataagacaaataagaagctaaacctcaagacccgtttgttaaaccaaacgttggctgaaacattggctgatccagaaactggggaagttgttgcagctaagggtaccttgattactaaagaagttatgcgcgacttggaaacttaccttgatcgtgatgacttcaagatgatcacatatacaccatctgacgaggctgttgtgacagctcccgttgaattacaaaagatcatggtttactcaaaggtagatccagaacgtgaagtaccaatgatcggtaacggtcacattgacttgaagttgaaacatattcaaccagctgatattttggcttcgatgaactacttcttcaacctgcaagaaggaattggtaacacggatgatatcgatcacttgggtaaccgtcggattcgttcagttggtgaattattacaaaaccaattccgaattggactttcacggatggaacgtgtggttcgtgaacggatgtcaatccaagatagtgctacggtgacaccacaacagttgatcaacatccggccggttgttgcttcaattaaggaattctttgggtcatcacaactatcacaattcatggatcaaacgaacccactgggtgaattgacccacaaacgtcgtttatcagcccttggacctggtggtttgactcgtgatcgtgccggatatgaagttcgagacgttcactatacccactatggtcggatgtgcccaattgaaacgccggaaggtcctaacattggtttgattaacagtttgtcaagctatgcacgggttaaccggtatggctttatcgaaacaccataccgtcgtgtttcatgggagacacataaagttactgataagatcgattacctaactgctgacgaagaagataactatgttattgcacaagctaactcaccactaaatgatgatggctcattcgttgacgaatcagttatggcacggtcacaatcagaaaacattgaaactagcattcaaaacgttgactacatggatgtttcgcctaagcaagtagttgctgtcgctactgcatgtattcctttcttggaaaacgatgattctaaccgtgccttgatgggtgccaacatgcagcgtcaagccgttcctttgcttcggcctcactcaccattagttggtactggtatcgaatatacggctgcccatgactctggtgttgctttgatctgtaagcatgacggaactgttgaatacgtcgatgcacgtgaagttcgtgttcgtcgtgacaacggaacgatcgatacttacaaattaatgaaattccgtcggtcaaacggtggtaagaactataaccaaaccccaatcgttaaacttggcgatcatgttgatgcaaacgaagtcttggctgacggtcctgcaatggaaaatggagaattggcacttggtcaaaacccattggttgccttcatgacatggcaaggatataacttcgaagatgccatcggaatcaacgaacggttagttcgtgatgacgtttatacttcaatccatattgaatcatacgaatcagaagcgcgtgatacaaaactgggacctgaagaaatgactcgcgaaattcctaacgttggtgaagatgccttaaaagacttggacgaagacggtattatccgtgttggtgccgaagttgaagatggcgacatcttagttggtaaggtaacgcctaaaggagttactgaattgtcagctgaagaacgactcttgcatgcaatctttggtgaaaaatcacgtgaagttcgtgatacatcacttcgtgttcctcatggtggtggcggaattatccaaaacgtccaaattttcacgcgtgaaaatggcgacgaattgtcacctggtgttaacatgatggttcgtgtcttcatcgctcagaagcggaagctccaagttggtgataagatggccggacgtcatggtaacaaggggactgtttccgttgttatccctgaagaagatatgccttacatgccagatggtacgccaatcgatatcatgctgagccccatgggtgtgccttcacggatgaacatcggacaagttattgaattgcatttggggatggccgctcgtgaacttggtattcacgttgcaacacctgtcttcgatggtgcaactgatgatgacgtttgggatacagtgcgtgaagctggtcttccttcagatggtaagactgtcttatatgacggccggactggtgaagcctttgataaccgaattgccgttggggtgatgcactacatgaagttggcccacatggttgacgataagatccatgcccgttcaattggaccatactcattagttacccaacaaccacttggtgggaaagctcaatttgggggccaacggtttggtgaaatggaagtttgggctttggaagcctacggtgctgcttacacattgcaagaaatcttgacttacaagtcagatgacgttgtgggtcgtgttaagacttacgaagcaattgtgaagggtgaaccaattccaaagccaggagttcctgaatcattccgcgtgctggtaaaagaattacaagcacttggtctcgacatgaaagtgttggatggtcagaaacaagaaatcgaactccgtgatatggatgacgatggcgacgaagttgtgaatgttgatgccttgagtaagtacgctcaagaacaacaagcaaagcaagaagctgagcaaaaacaacaagaagccccacaagaagaacctcaacaagattaattcgttagatgagaaacactaagttaaggaggatcatcctttgattgatgtcaataattttgaaagcatgcaaatcggtctggcatctccagataagatccgcagctggtcatacggtgaagtaaagaagccggaaacgatcaactaccggacgcttaagccagaacgtgacggcttgtttgatgaacggatttttggaccaacgaaagattgggaatgtgcttgtggtaagtacaagcggatccgttataagggtgttgtttgtgatcgttgtggtgtcgaagtaactcgttctaaagttcgtcgtgaacggatgggtcacatcgaattagccgcaccagttacccacatctggtactttaagggtattccaagccggatgggcttggttcttgatatgagccctcgggcgttggaagaagttatttactttgcttcttacgttgttttggatgcgggtgacacaccgcttgaaaagaaacaacttctgtcagaacgtgaataccgtgataagaaacttgaatttggtagccgctttacggctgaaatgggggcagaagcaattcaaaaattgcttgccgaagttgatttagctaaggaagctgctgaattgaaggaagaattgaaggatgcttctggccaaaagcggacccgtgcggtacgtcgtttggacatcttggaagccttccttaagtcaggaaacaagccagaatggatggttatggacgttgtgccagttatgccaccagatctgcgtccaatggttcaacttgaaggtggccgtttcgccacttcagatttgaatgatttgtatcgtcgggtaatcaaccgtaacaaccgtttgaaacgattattagatttgaatgcaccgggaatcatcgttcaaaacgaaaaacggatgttacaagaagccgtagatgccttgatcgataatggccgtcgtggccgtccggttgctggtcctggtaaccgtccattgaagtcactgtctcacttgttaaagggtaagcaaggacgtttccgtcaaaacttacttggtaagcgtgttgactactctggccgttcagttatcgatgtggggccatcattacggatgaaccaaatgggattgccagtaccaatggcaatggagcttttcaagccatttatcatgaaggaattggttaagcgggacttagcttctaacattaagaacgctaagcgcaagattgaccgtaaagatgatgatgtgtacgacgtattggaagacgttattaaggaacacccagtgttacttaaccgggcccctacgttgcaccgtttaggaatccaagcgtttgaacccgtgctagtttctggtaaagccatgcgtgtgcatccactagtgtgtgaagcctataacgccgatttcgatggtgaccaaatggccattcacgtgccgttatcagacgaagcacaagctgaagcacggatcttgatgttggctgctggtcacatcttgtcacctcgtgatggtcaaccagtggttaccccatcacaagatatggttatcgggaactactacctgaccattgaagaaagtggtcgtgaaggcgaaggcatgatcttcaaggatattgatgaagcacggacagcttaccaaaataagtatgttcatttacacacgcgtgtgggtgtgttgacctcatcattatctaagaaaccatttactcctgctcaacaggggaaggttttgatcacgaccgttggtaagttaatctttaatgacattttgcctgaagattttaattacctcaatgaaccaactaaagctaacttaacaactggtgttgacgacaagtacattcttgcacctggtgaggatttgaaggcgcgtcttgcagatatgcctttgataccaccattcaagaagggcttcttggctgacatcattgccgaagtttacaagcgctacaaggtaactgcaacatcattgttattggaccgtatgaaggacttaggttactatgaatcaactatttctgggctaactgtggggattgctgatatcaccgatttgaaggaaaaaccagcaattattgcggatgcgcataaagaagttgctacgattactaagcagttccgtcgtggtctgattaccgatgacgaacgatacgagcgtgtcattggtgtgtggaacgatgcaaaggatgccgttcaacagaagctgattgaaggaatggatattcataacccaatcaacatgatgtctgactctggtgcccgtggtaacatctctaactttacgcaattggccggaatgcgtggtttgatggccgctcctaacggtaaaatcatggaattgccaattctttcaaacttccgtgaaggtttgaacgttttggaaatgtttatttcgacccatggggctcgtaaagggatgaccgatacggccttgaagactgccaactcaggttacttaactcgtcgtctggttgacgttgcacaagatgtgattgttcgtgaaaaagactgtggaactgatcgtggtttggacattactgccattactgatggtaatgaaatgatcgaaccgttgtacgaccggatgatcggccgttacacgatgaagtcagtttacgatccagagactggtgaaaagatcatcggcaagaacgaaatgatcgacgaagatattgcagatcgtattgttgatgccggcattacgaaggttacgattcgttcagcctttacttgcaacactaagcatggtgtctgcgaacgttgttatggacgtaacgctgccactggtgatcgtgttgaagctggtgaagctgtcggaacggttgccgctcaatcaatcggtgaaccaggtacgcaattaacgatgcgtaacttccataccggtggtgttgccggaaacgaagatattacccaagggcttcctcgtattcaagaaatcgtggaatctcggaaccctaaaggtaaagctgagattactgaagttactggtgtcgtagaatctgttgaagagaatccagcagaacggacgaaggatattacgattaagggtgaaaccgatactcggacatatactttgccgatcactgctcgtttgaaggtggccgaaggtgactttattcaccgtggcgctgcgctgaacgaaggatcaattgatccgaaggaattgattcaagttcgcgatgtcttatcaactgaaacttacttgctcggtgaagttcaaaaagtttaccgtatgcaaggggttgaaatccttgataagcacgttgaaatcatgattcgtcaaatgctccggaaggttcgtgtcatggatccaggtgatactgacatcttgccaggtgcattgatggatattactgatttccgtgatgaaaactacaagacgcttgttgctggtggtattccagcaactgcacgtccagtgatccttgggattacgaaggccgcacttgaaacaaatagtttcttgtcagccgcatcattccaggaaacaactcgtgtcttgaccgatgccgctattcgtggcaagaatgacccacttgttggtttgaaagaaaatgttattatcggtaagattattcctgccggtactggtatgggtcaataccggaacattaagcccaaggaagttagcgttgctagcaccagtggtgtctactcaatcagcgatattgaacaacaaatgaaggaacaagaacaagattagtcttgtgaaaatcctaaaagcgtcaaagctgcgattacagctttgacgcttttttatgttgttagattaaacgaagtgaagatgaacagtaagaaccgctaccagggcaaagcagagaaatgggaggaaggcaaaccgctccttttgatgggtgatcagtgcataacttaacgcgagactactgctgatgaataaaatgacactgacagtatacaggtcaaagatcataagcaaaatgatcatgatctcgacgtctgccagtcccaattgttggcaagcaaataacatgaagagaatactagtaagaataatcagccctaaccagtaactgagcgtcatataagctgggtgaggaagcagccagaatagtgggagcaatcctaaaaaacaaagtggataaacaaaagtatagtaggcatcaagcgtactcagcaagataagtgtcaaaaaaatacaatcataaccgagcatgggcccagcagggaaggcagcacactgcaggaaccaccagccacagaggcattcattgagtgttgagattggattaattcgtgcatgacaataatggcaacggccgcgttgagatacaaaaccaatgatggggatcagttgccaccatgctaactggtgttggcaattatcgcagtgggatctaggcaccgtaatggaacgatgttgtggaatacgaaccgcacagagtgtggcaaaagatgccaaaatggtcccgatgataaagtaaaaataagtcattatgatctcctcctgtaatgaaaatacgcggaaacagttggaaaacattgattttatctgggatcaatcgttgacacttaattgcgtgcgtgatattctattaaaggtgcttttcacaacgcagttattctgtcgcacggcagatttttgctgtcgtcgacggtagcacgaatgtaaacacgatctttgtgtgatttttttatatcataaaaagaaccacctggatgtgtggacttaaaaacaggaaggggaaacaatttcatgccaacaattaaccaattggtacgtaagggacgtaagtccttgacatcaaagtcaaagtcaccagccttgaactttggttataacagttacaaaaaatcagcaactactaacccagcacctcaaaaacgaggcgttgcaacccgtgtcggaactatgacaccaaagaagcctaactctgctttgcggaagtatgcgcgtgttcgtttgtcaaacttgatcgaagttactgcctatattccaggtatcggtcacaacttacaagaacatagtgttgttttgatccgtgggggccgtgttaaggatttacctggggttcgttatcatatcatccgtggtactctcgatactgccggtgttgaagatcgtcgtcaaagccgttctaagtacggtactaaaaagccaaaagcttaaagagaggagtaacttaaatgccacgtaaaggacatgtacaaaaaccagaagttttgccagatccaatgtacaattcaaagttagttacaagcttgatcaaccacttgatgattgatggtaagcgtggaactgcttcaaagattttatatgcatcatttgaccttatcaaggaagaaactggtaacgatcctgttgaagtattccaacaagctatggaaaacgttatgccagtacttgaagttaaggctcgccgtgttggtggatcaaactatcaagttccgatcgaagttcgtccagatcgtcgtacgacacttggtcttcgttggatcactcaattctcacgttcacgtggggaacatacaatgactgaacgtcttgctcgcgaaatcatggatgctgctaacaatactggtgcatctgttaagaagcgtgaagatacacacagaatggctgaagccaaccgtgccttcgcacattaccgttggtaatctgagctttttgcatgatttgcctgaaataataaccatcaaatggttagtggctgttatatgacatcttaatttcatataggagccactttttcggaattaaggaaagttttacaactcggaaggagaaacacttttaagatggctaataaacgagaatactcacttgaaaaaactcgtaacatcggaattatggcccatatcgatgccggtaagacaactacaactgagcgtatcttgtattatactggtaagattcacaaaattggtgaaacccatgatggtgcttcacaaatggactggatggaacaagaacaagaacgtgggatcacgatcacttcagccgcaactactgctgcatggaaggatcaccgaatcaacatcattgataccccaggacacgtggacttcactgttgaagttgaacgttcacttcgtgtgttagatggtgccgttgcggtcttagatgcccaagccggtgttgaaccacaaactgaaacagtttggcgtcaagcatcagactatagcgttccacggatcgtgtttgctaacaagatggacaagatgggtgctgactttgacttctcagtatcaacaatcaaagaccgcctgcaagctaacgctttaccaatccaaatgccaattggtgccgaagatgatttcgaaggtatcattgacttggttgaaatgaaagccgatatctatgatgaagacgaacttggttcagaatgggatactgttgatattcctgacgaatacaaggaagaagcacagaagcgtcgtgacgcaatgatcgaacagcttgctgactttgatgatgacatcatggaaaaatatctgggcggagaagaaatcgccgtttcagaaatcaaagctgccattcgtcgtggtactttgaatcttgaattgttcccagttctggctggatcagcattcaagaacaagggtgttcaaatgatgttggatgccgttatcgattacttgccatcaccactggacgttaagccatacaacgctactgatccagatactggtgaagagatcgaattgattgctgacgacgacgagccatttgctgccttggcctttaagatcgctactgacccattcgttggtcgtttgacattcatccgtgtgtacactggtactttggaatcaggttcatacgttatgaacacgactaagggtaagcgtgaacgtgttggtcgtttgctccaaatgcattcaaatcaccgtcaagaaatcccagaagtattctcaggtgatatcgctgctgcgattggtttgaagaacacgactactggtgattcattaactgatccagatcgtccacttcaactcgaatcaatggaattcccagacccagttatccaagttgccgttgaaccaaaatcaaaggctgaccaagataagatggatgttgctttacaaaagcttgctgaagaagatccaacattcaaggctgaaacaaaccctgaaactggtgaaacattgattgccggaatgggtgaattgcacttggacatcatcatcgatcgtatgaagcgtgaattcaacgttgaagcaaccgttggtaatcctcaagtttcataccgtgaagccttcacacaaaagactagcgcacaaggtaagtttgttcgtcaatctggtggtaaaggtcaatatggtgatgtttggattgaattcgaacctaatgaagaaggtaaaggatttgaattcgaagatgccattgtcggtggggttgttcctcgtgaatacattccttcagttgaacaaggcttgaaagaatcattggaaaacggtgttcttgccggttacccattggttgacatcaaagctaagttatacgatggtagttatcacgaagtcgattctagtgaagctgcctttaaggttgccgcttcattagcacttcgtaatgctgccaagactgctggcccagtaatccttgaaccaatcatgaaggttgatatcgtgatcccagaagaatacatgggtgatatcatgggacaagttaccgcacgtcgtggccgtatcgaaggtatggaagaccgtggaaacgcacaaatggttcactcattcgtgccactgtcagaaatgtttggatatgcaacgactcttcgttctgcatcacaaggccgtggtacatttactatgactttcgatcactacgaaaaggtaccaaagtcaatccaagaagaaattatcaagaaaaatggcggttcaaatatcaaagaatagttagccgctaacgaagcaccgtatcgagacttggtcttgatatggtgcttttttgagttttgaacaataataaaagcgcgtaccacgcggcgaaaagccatgtgatacgcgcttgtctttttaacaagtctattttgagaattcttcatcttgcgcttgctgataaagtttgtccagctcaccagtttgtttcatctgtttgataacaagattgacctgcttcaacagttttttatcacctttacgagttgcgacactgatgttgcgctgtgattttggcgttggtagtgcaacggatgcgacttcatacttatcaggatgttgtttgataaagttatcagcaacgacgctatcaaggatgacaccactgagcttcccattttgcagttcggaggcgagactattgacgttactttcagtaacgagattagatttggttaaatgattctttgcaattgattcctgtagggatgcttgctgggcacccacagatttaccagctaagtcactgatatgagcatatgtggtggcttgtcctttttggacgagtaacacatttttgaccttatagtatcccattgaaaaagcaacggatttttcgcgggccggcgtatctgtcattccagccattacgatatcaactttgttttgattgagatcagtaattagtgaggaaaaagttgtattttgaacctccagcttaacaccgagcttcttagcaatgcggcgcgcaatatagatatcgtaaccagtaatttgtttttgcccatttttgatgactggaaactcgaagggggcaaaatcggcttcggtaccgacaactaacaccttcttgtcctgaattttcttgacactagtatccttctgttgaccacagcccgcgagtgttaagacgagtaataaactgagagacagtgtaagtaaccatttttttgatctcataagcaaagctccttgaatatatatacatttattttgttattttttacatattaaaccatttatttgaattaataacaagtttttttttaaaaatatcatttttagtatgatattaggcgggcagtaattattttgaaagaaacaatgaccgctgcaaatcaactgaattgcaatttcatggatacaaatagaagaaagcaattaattgaaattcaaggaatcggtagtgatgagtggcttgatcggcgtttaaccgttaaaaagaagagcgatgaatgaaaataggcagaaaaatattcatttagtgctgatgaagagcattaaaatgcaattttaaatagaaaaattaataaaaataaatttttatgggaagttcagaatttagttggcaaattttgagacggctattttcagaaaaaataaattaaatcccaaaaacccttgtcattgtaggaactttctagtaatatatataggtgcttgagcttttcggtagggtacagccgtgccctgggtgggcttgagtaaatcagcgttgatgtgagaggttgcgacacacccggccgctttgccacaggatgtggcggtaattttcacggagctagtcaaatttaaaatattgacgaaggagggaacataatggcaaaacaaaaaattcgtattcgtttgaaggcctacgagcaccgcatcttagatcagtctgctgacaagattgttgagactgctaagcgtactggtgcctcaatttcaggtccaattccgttaccaacggaacgtaccttgtacacggtgcttcgttcaccacataagcacaaggattcacgtgaacaattcgaaatgcggacacacaagcgtttgatcgatatcatcgacccaacaccaaagacagttgattcattaatgaaacttgacttgccaagtggtgtcgacattgaaattaagctttaataaataattattacaacatattggaggtgtactcatgaccaaaggaatcttaggtaaaaaagtagggatgacacaagtattcactgaatcaggtgaattggtgccagttactgtagttgatgtaactcctaacgttgtcttacaagttaagaacgttgaaaacgacggttacaacgccgttcaactcggcttcgatgacaagcgtgaagtgctcagcaacaaacccgaacaaggtcatgtagcaaaagcaaatactactcctaagcgcttcatcagtgaaattagagatgcgcagttaggagacgacgtgaaagtcggcgatgaaatcaaggctgatctttttgcagctggtgaagctgtcgacgtcacaggaacaacaaaaggacacggatatcagggtaatatccataaagacggtcaacgtcgtggacctatggctcacggttctcgttaccatcgtcgtcctggttcacttggtgcaatcattaaccgtgtgttcaagggtaagaaattgcctggccgcatgggtggtaatactcggacaatgcaaaaccttaagattgttcgcgttgatactgaaaacaatgtattgcttatcaagggtaacgttccgggtgctaacaagtcattcgttacaattcaaaactcagtaaaagcaaacactaagaaaactcttagcaagcaaaaaaacaaacaataagaagggaggaactagataatgacaacaagcgttgcattatataaacaagatggaagccaaaacggcacagttgatttaaatgctgatgtctttggtatcgaaccaaacgaacacgcgatgtttgatgcaattttgcgtcaacgtgcttctttacgtcaaggtacacatgccgttaagaaccgtagtgctgttcgcggtggtggaaagaagccatggcgtcaaaagggtactggtcgtgctcgtcaaggttctatccgttcaccacaatggcgtggcggtggtatcgtcttcggacctactccacgttcatacaacttcagcttacctcgtaaggttcgccaattagctatcaagtcagcattgtcacaaaaagtggccgacgataaattcgttgttgttgatgcacttagctttgaaacaccaaagacaaaggaattctcagcagttcttaacagcttgaacgttgcagaaaagactttattagttcttgataaagaaaacgaaaatgctgcattatctgctcgtaaccttgctaacgttacggttaccgacgcacaaaatgttaacattttagatgtagttaataacgacaagttagtaattactcaatcggctctttctcaagtagaggaggtgctcgcataatggaagcacgcgatattattttacgtccagttgtcactgaagcaacaatggcattcatggatgacaagcgctatgcatttgatgttgatgtacgagctaccaagactcaggtcaaaaaagccattgaagaaatcttcgatgtaaaagtagttaaagttaacattatgaacgtgaagggtaagttaaagcgtcaaggtcgttacgaaggctacactaagaagcgtcgtaaggctattgttactttatctgccgattctaaagaaattaagttattcaacgaagaataattaaatctagaataggaggaaaataaagtgggaattcggaaatacaaaccaaccactaacggtcgtcgtaatatgactggttctgactttgaagagattactaaaacaactcctgaaaagtcattattagcaccattaagtaagactgccggccgtaacagttacggacatatcactgttcgtcaccgtggcggtggtacaaagcgtcaataccgtgttattgactttaaacgtatcaaagacgatgttccagcaactgttaaggcaattgaatatgatccaaaccgtacagcaaacattgccttgcttgtttatgctgatggtattaagtcatatatcattgcacctaagggcttaaaagttggaacagaagtacaatcaggacctgatgctgatatcaaagtaggtaacgcattacctcttaagaacatccctgttggtactatcgttcacaacattgaattaaaaccaggtaagggtggccaattagctcgttcagctggggcctcagctcaaatccttggtaaggaagacaagtacgtcttagtacgtttggcttctggtgaagttcggatggttcttgcaacttgccgtgctactatcggtactgttggtaacgaacaacatgaattgatcaatgttggtaaggctggccggaaacgttattcaggtcaacgcccacacgttcgtggatcagttatgaaccctaacgatcaccctcatggtggtggtgaaggtaaagctccagtcggtctaccatctcctctttctccatggggtaagaagactgttggtaagaagactcgttcacacaaggctcgttcaagcaaatttattgtacgtggtcgtaaacgtggtccacacactcgctaattagttaataggtagaatccgagaggaggtaacataatgggtcgtagtttgaaaaagggacctttcgcagatgctcatcttttgaagaaggtcgaagcacaagctgattcagaaaagaaaactgtgattaaaacatggtcacgtcgttcaaccattttccctagttttatcggttacacattcgctgtttatgatggtcgtaagcacgtaccagtgtacgttcaagaagacatggtaggacataagcttggcgaatttgtaccaacccgtacgttccatggtcatggaactgacgataaaaaaactggtaaataaaggagggtgaattatggcagaacaaattacatcagctaaggcaaccgctaaaactgttcgtgtttcagctcgtaaagtccgtatggtacttgatgcgattcgcggcaaaaatgttgtcgaagcattagcaattcttaagttcacccctcgtggtgcagcttcagatgttgaaaaagttttaaaatctgctgttgcaaacgctgaaaataattttgatttggatcgcgaatcattgtacgtaagcgaaacttttgctaacgaaggaccaacgctcaagcgtttccgtccccgtgcaaagggttcagcttcaccaattaataagcggacaagtcacattacagtggttgtatcagaaaagtaggaggaataacaagtgggtcaaaagattaatccaacaggattccgtgttggtgtcattcgcgattggcaagcaaaatggtatgctgaaaaagattttgctaagttcttgaacgaagatttacggatccgtaaatatatttcaaaacgacttgctgatgcctctgtatcgaccgttgaaattgaacgtgccgcaaatcgcgttaacgtttcaattcacactgccaagccaggaatggttattggtaagggtggttcagaagttgaagcactgcgtaaagaattaaacaaattaacaggcaagcgtgttcacattaacattgtggaaatcaaaaagcctgacttagatgcacaccttgtaggcgaaagcatcgcacgtcaacttgaagctcgtgtagctttccgtcgtgcaatgcgtggcgcaatgcaacgtgcaatgcgttctggtgccaaaggtatcaagacgcaagtttctggacgtttgaatggtgccgacatgtcacgtgttgaatcatattcagatggtacagttcctctgcacacacttcgtgcagatattgattattcatgggatgaagcccgtactacttatggtgctttgggtgttaaaacatggatttatcgtggagagattctcccagaaaagaaaggcgcaaaacgcgctaacgagcaaggagggaaataaacatgctagtaccaaaacgagttaagtttcgtcgtgtacatcgtggacacatgcgtggtgaagctaaaggcggcaagttcgttagctttggcgactatggtcttcaagcattggactccagctggattacaaaccgtcaaatcgaagctgcacgtattgccatgaaccgttacatgaagcgtggtgggaaagtttggatcaagattttccctcacaaatcatacaccggaaaaggtgttggtgttcgaatgggtaatgggaaaggtactcctgaaggttgggtagcacctgttaagcgcggtaaggtaatgtttgaagtagggggcgtttcagaagaagtcgctcgcgaagcattacgtcttgccagccacaaattaccagtacgttgcaagatcgtaaaacgtgaggaagtaggtgggcaatcagatgaaaagtaaagattttgttcaggaattgaacggattaaccactgctgaaattcttaataaagaaaaagaattgaaagatcaattgtttaacttacgtttccaactggctactggccaacttgaaaacactgcaagtcttacacaagtacgtaaagacattgcacgggtgaagacagttcttcgtcaacaagaaattaacaaatagaatacgaaaaggaggattaacgcatgagtgaagaacgcaatgctcgtaaggtataccaaggtcgcgttgtttcagataagatggacaagacaattactgttcaagttgatacttacaagaacgcccctatttatggcaaacgagttaagtactcaaagaaatattatgcgcatgatgaaaataacgaagctaagaccggcgatttagtgcaaatcatggaaactcgtccattgtctgccaagaaacgtttccgtctactttcaattgttgaaaaagctgttattatctaaatcatcacttttaaattcgtattctgatttgaagatggaaggaggacattaaccgtgattcaacaagaaagtcggttgaaagtcgctgataactcaggtgcccgcgaaattttggtaatcaagattttgggtggctcacgagtaaagactggtaatattggtgacattattgttgctactgtaaaacaagcaacaccaggtggcgttgtcaaaaagggtgacgtcgttaaggctgtcgttgtccggactaaagctggacttcgtcgtaacgatggttcatacatcaagtttgatgaaaacgcagctgtacttattaaggatgacaagagcccacaaggcacacgtatttttggacctatcgctcgtgaactacgtgatgacgatttcatgaagattgtctcattagctccagaagttctgtaatttcatctatttaataaggaggtgcacatcaacatgttcgtaaaatctggtgacaaagttcgagtaatcagtggtaaggacaaaggcaaagaaggcactatcaaaacaacctttgctaaggaaaaccgcgtgattgtcgaaggcgtaaatatgatcaaaaaacaccaaaagccaagtaatgcttacccacagggtggtgtcattgatactgaagcgccaattcaatcttcaaatgttatgttaatcgatccttcaacaaacgaaccaacccgcgttggatttaaggttgttgatggcaaaaaggttcgcgttgccaagaaatctggcaaaacgattgactaatctctaaaggaaggaggaaaaatatttcatggtaaaccgtctaaaggaaaagtacgttaatgaaattacaccttcattaatcgaaaagtttaactatacttctgtaatgcaagcaccaaaggtcgacaagatcgttcttaacatgggtgttggtgatgccaccacaaatgccaagaacttggatgaagctgttgcagaacttcaattaatttcaggtcaaaagcctttagttacaaaggctaagaaatcaatcgctggcttccgtcttcgtgagggaatgtcaatcggtgccaaggttacactccgtggcgaacggatgtatgacttcttggataagttgattaatgtttcacttccccgtgttcgtgacttccatggtgttagcaaaaaagctttcgatggccgtggtaactacacattgggtgtacgtgaacaattaatcttccctgaaattgattacgataatgttaaccgtgttcgtggattagacatcgttattgtaacgactgcccaatctgatgaagaatcacgtgaactattggcacaattaggaatgccatttgctaaataaataaggaggttccacgctttggctaaaaaatcacaaattgctaaaaacaagcgtccagctaagtattcaacacaagcatatacacgttgtgaacgttgtggacgtccgcactctgtttatcaaaagttccacctatgccggatttgcttacgcgaactcgcacataagggtcaaattcctggcatgaagaaggccagctggtaaacaaaccgacacaaaggaggataaacatcgatgtctatgagtgatccaattgcagactttttgactcggattcgtaacgccaacatggttcgtcacgattccctcgaagtacctgcatcaaaaattttgaaagacatcgcagaaatcttgaaaaatgaaggtttcgttcgcgatgttgaatatatcgatgatgataagcaaggcatcattcgtgtgttcttgaagtatggtaaggacaacgaacgtgttatttcaggacttaagcgtatctcgaagccaggtcttcgttcatacgttaaggctgatgctgttccaaaggttcttaatggccttggtattgctatcatctcaacatcacaaggtgttgtgactgataaagaagctcgtgcaaagaaaatcggcggcgaagtactcgcttacgtttggtaatattttaaagtagttaggaggtgcacatattgagtcgtattggttataaagtagttgaattgccagctggcgttgaagtttcacgcgatggtgatgatgttacagttaaaggccctaagggttcattgacacggacagtttctccagttatttcaatgactgttgaaggcaacgaagttaaattcgatcgtcctgacgacaacaacaagacccgtgctttacacggaactactcgtgctaacttcaacaacatggttgaaggtgttacaaatggtttcagcaaaacacttaagcttgtcggtgttggttaccgtgttcaattaaagggaactaagttaattttggcagttggttactcacatccagttgagttcgaaactccagaaggtttaacacttgaagttcctgataacacaacaatcaagatcaacggaattagcaaacaagcagttggcgattttgccgctgaagttcgtgccgtacgttcaccagaaccatacaaaggtaaaggtattcgttacgttgatgaatatgttcgtcgtaaggaaggtaagactggtaagtagtcttaactagaaaaaatttaaagaggtgacaattgtgatttcgaaaccagacaagaatcaaacccgccaacgtcgtcatgcacgcgttcgtggtaaaatttctggtactgcggagcgcccacgcttaagtgtgtatcgttcaaataaaaacatctacgctcaattaattgatgacgtagcgggtgtgacgctcgcaagtgcctccacaattgataaagaagttagtggaaataaaacagaacaagcaaccaaagtcggagaactaattgctaagcgcggttcagaaaagaacgttagcgaagttgtctttgatcgtggcggttacttgtaccatggtcgtgtacaagctttagctgaagctgcacgtgaaaatggacttaaattctagagaaaaggaggaataacccgtaatggcatcatttattgacccatcaaaattagatcttgaagataacgttgtcgctatcaaccggattacaaaggttgttaagggtggtcgtcgtcttcgttttgctgctttagttatcgttggtgataagaagggccacgttggttttggtactggtaaagctcaagaagtcccagaagcaatccgtaaggccgttgaagctgctaaaaagaacctgatcgaagtgccaatcgttggtacaacattgccacaccaagtaatcggtgtatatggtggtggacgtatcttgctgaagccagccgttgaaggttctggagttgctgctggtggcgctgttcgttccgtcatggaacttgccggtgttgccgatgttacttcaaaacgtcttggctcaaacactcctgtcaatgttgttcgtgcaacctttgaaggtttgaaagcattgaagagtgcagaagaagtctcagcattacgtggtgtttcactcgaacacttatctaaataggaggacagtctcatggcacaagttaaaatcactttaattcacagcgctgctcaccgtcttcctgcccaacgtgctattgttaaggcacttggccttggtaagattaacagttcagtgattaaaccagataatgaagcaactcgtggtgcaatctttaaggttgctcacttagttactattgaagaagttaagtaataaaatatcaaccaaggaggtgcaaccctaaatgaagttacatgaattaacaccagctgaaggctcacgtggtgttcgtaatcgtgtcggacgtggtacttcatccggtaacggtaagacatctggtcgtggacaaaaaggtcaaaaggctcgtggcaaaacacgtgtaggctttgaaggtggccaaatgccattgtatcgtcggattccaaagcgtggctttactaacatcaaccgtaaagaatacgcaattgttaatttgacaactttaaaccaatttgatgatggtactgaagtaacaccagcattcttagtcgaaaatggtgttgtgaagaacgaaaagagcggtatcaagattcttggtaacggtcaattgactaaaaagttgacagttaaagcaagcaagttttctgcttctgctgtttcagcaattgaggccgcaggtggtaaaactgaggtgatttaatgttcacaactatcaaaaatggactcaaggtatcagaaatccgtaaaaagattctgtttaccttgtttgtcttgattgtgtaccgacttggtgcatatatcaccgttccaggaattaacgcagcggcccttcaggaagttgcgtcaactggattggcatccattttgaacacgtttagtggtggcgggttagagaactactcattgtttgcaatgggggtttcgccgtacatcacagcccaaattgtggttcaactgttgcaaatggatattgttccaaagtttgttgagtggagtaagcagggggacgttggtcgacggaagctaaatcaagcgacccgttggttaacaattgttcttgggtttattcagtcaattgggattacggctggctttaatgccttaagtacattgaaattagttaataatccaggaattaagacctatctgatgattggtttgattctgacagctggaacgatgcttgcaacgtggatgggtgatatgattaccgaacgtgggttaggtaatggtgtttcaatgctgatttttgccggaatcattgctcaaatgccaagtgggattaagcaactttggcaagatcagatcgttggagcttcaggaaacgatctctggatcggtattgcattcatcgccgttgtggtcgttgcactcttgataattgtgacttttgttacttgggtacaacaagctgagcgtcgtcttccaattcaatacacacgtcgcacaactagcgctccggaaagtagttatttaccattaaagattaatgtttctggtgtgattcccgtgatctttgccggatcatttgtttcaacgccgcagacaatcttgatggcctttcaacaaaatcacagtggtgatagttggtatcagataatgacgaacatatttaatatgcaaaccatccctggtacatcgttgtatatcctgttaattgttctgtttacattcttctacgcgtttgttcaggttaatcctgaaaaactgtcagagaacttgcagaaacaaggaagttatattccgggtgtttggcctggaaagggaacacaaaagttcgttgccggattattaatgcggttaagtacggttggttctgtctttcttggattcatctcgttgattccgttgttagcaagtgacgtttggaacttaagccaatcaattgggttaggtggaacgagtttgctgattgtcgtgcaaattgcgttagatgtaattcgccaattgaatgggttaacaatgaagcgagagtatattgggtttattcacgattaaggaggaattggtaaatgagtaccatgaatctcattttaatgggacttccgggtgccggtaaaggcactcaagcgcaaaaaatagttgaggaatttcatattccacatatttcaaccggtgatatcttccgtgccgcaatgaagaatgaaaccgaaatgggtcttaaggctaaggcgtatatcgataagggtgaattggttcctgatgaagttactaatggcatcgttaaagatcgtttagctgaagatgatactaaggttgggttcatgcttgacggatttccgcggaatttagcacaggctgaggcgcttgatcaaatgctcgccgattcagatcgtaagctagacgccgtcttgaatattcacgttgaaccagaagttttggtggaacgactaactggtcgttttatctgccgcaactgcggtgctacgtatcacaaactttatcacatgcctaaagttgaaggcacctgtgatgtttgtggatcgcacgacttttatcaacgtgaagatgataaacctgaaacggttaaaaaccgtttagatgttaacatcaagatgaacacaccgttggttgattattatcaagcaaagaatgtgcttcatacagttgatggtcaacaggacatcgataaggtttatcaagatgttcagcagattctgaaaaacctgtaaaaagggaagataataactgttaccttgctttgccgttaaacctgtggtaaactactctaggtttagcggcaaaagttaaggcagcttagttcagtctgccatttttacgtcgaatttgtggaactaggaggaagctttcgtggcaaaagacgatgtgatcgaaattgaaggtaaggttaccgaaactttaccgaatgcaatgtttaaagtagaacttgaaaatggtcatgagattttggcacatgtttcagggaagattcggatgcactacatcaaaatcttgcctggggatcgtgttcaggtcgaaatgtcaccatatgatttgaccaagggtcgtatcactttccgctttaagtagttatctaattggattatgactttctaggaggatattcataatgaaagtaagaccatcagtaaagcccatgtgcgaacactgcaaagtgatcaaacgtaatggacgtgttatggtgatttgctctgcaaaccctaagcacaaacaacgtcaaggaaaataattttttaactgaaatggaggtgcactaatcaatggctcgttttgcaggtgtcgatttacctcgtgacaaacgaattgtaatcggcttaacttatattttcgggatcggtgacactacagctcacaagatcctcgcaaacgccggcgtctcagaagatgtccgtgttcgtgatttaacacctgatcaagaagacaagatccgtgctgaagttgatcaacttaaagttgaaggtgacttacgtcgcgaaacttcactgaacatcaagcgtcttcaagaaatcggttcttatcgtggtatgcgtcatcgtcgtggtttaccagttcgtggtcaacatacgaagaacaacgctcgtactcgtaagggtaaggctgtttcaattgcaggaagaaaaaaataattagataaaggagggtaataatttggctacaaaaaaaggaactcgtaagcgtcgtgtcaaaaagaatattgaagccggtgtggctcacatccattcaacattcaacaacacgcttgttatgattactgatttacaaggtaatgcagttgcctggtcatctgctggctcattaggcttcaagggtagtcgtaagtctactccatttgccgcccaaatggcttcagaagctgctgccaaggcatcaatggaacacggtatgaagactgtcgaagttgctgttaagggtccaggttctggtcgtgaagctgctatccgtgcacttcaaactactggtcttgaagtgagcgcaattcgtgatgtgacaccagtgccacataatggttctcgtcctccaaagcgtcgtcgtgtttaattcagctacattttcgtggagttttcttcatattaatgtattttatattaatagcgaaccacgttttgaaaggggtaaaagataagaatgatcgaatttgagaaacctaacattcacaaagttgatgaaagtaataactatggcaagtttgtcgtagaaccactcgagcgcggttatggaacaacgcttggtaattcgttgcgtcggattttactggcgtctcttcctggagcagccatcacaagtatccaaattgatggtgttttgcatgagttttcaacggttgagggtgtcactgaagacgttactcaaatcattctaaacatgaagcaaatttctcttaagatcgactctgaggaagacaagactttggaaattgatgttaaggggcctgctgctgtgactgctggtgacatcgaagctgacggtgatgttgaggttctaaatccagaactgcatatcgcaacagttgctgatggtgctgagttgcatatccagatgactgctaacactggtcgtggctacgtttcagctgatgataacaaagcacgtatggatgatcttccaattggtgttttaccgattgattccatctataccccgatcgaacgcgtgaactatacggttgaaaacgcacgtgtagggcaacgtaatgattacgacaagttgactttggatgtttggtctgatggatcaatcacgccaagtgagtcaattagtttagctgccaaaattctgacagagcatctagcaatgtttgttgatttaaccgacactgctaagaatgctgaaattatggtcgaaaaagaagagactcataaagaaaaaatgttagaaatgacaattgaagaattggacctttcagttcgttcatacaattgcctcaagcgcgccggaattaataccgttcaagagttaaccgaccgttcggaagccgacatgatgaaggttcgtaaccttggtcgtaagtcactcgaagaggttaaggttaaactagccgatttaggattatcacttcgtcaagaagactaacactctcacaaaggaggaaacctgttcatgagttaccgtaaattaggacgcacaagctcacaacgtaaagctttattacgcgatttaactactaacttgattgttaatggtcgtattgaaactactgaagctcgcgctaaagaagttcgcaagactgctgaccaaatgattactcttggcaagcgcggtgatttacatgcccgtcgccaagctgcatcatttcttcgtaatgttgttgcggatgttaaagaagacggcgacgatgtacgtgtacaatctgctcttcaaaacttgtttgaagaattagcacctaagtatgctgatcgtaatggtggatatactcgtattttgaagacaatgcctcgtcgcggcgatgctgcacagatggttgtccttgaattcgtctaacaacatctaaataataaagcgtaataaagaatcactatgattgatggtatagagcgttatgatggtggagaaatcctagtctagcttgaatgcggggtaaaacccgagcgcctcagttgtaagtgattttttttgcgctttttttgtgtttttggtatcgttgaatggtatgatgattggagtttaaaataactttggagtggcgtaaatgcataaaatgatcacggtccaggatgccgtttattcctattctgatgatgagcacctggtgctgaaaaatatcacgtttgacgttgaacgcggggagtgggtttcaattgttggtcacaatggtagtggtaaaagtacaatggccaaagcaattgatggcctacttaagttaactagtggcgccattgaaattgatggcactgcgctcgcggaggatacagtttggaaaattagggagaaaatcggatttgtctttcaaaatccagataaccaatttgtgggagcgacggttgcagatgatgtagcatttggccttgaaaatcgacacgtttcacatgatgaaatggttgctaaagttgatgaagctttacatcttgttcacatggaagcttttgccgatcgtgaacctgctggactatcaggtggtcaaaagcagcgggtggcacttgccggagtgatcgccatgcgtccagagattgtcattcttgatgaagcgacaagtatgctagatcctgaagggcgacaagaaattatgcagctgatgcgtgaacttaagcagacatatgattttacagtcctgacaatcacccatgatattgatgaaacagcatttgctgatcgaatcttactcattgatgacggtgaattagttgccgctgggacacctgagcaggtgttgactaacggcacagatttagttgaccgcggactggaattaccgtatgctgagcgtttgttgaatcaattaaacttgttacatattgacgtgccgcagcagtatatgactaatgatcaggtggtgaaatggctttgccaaaaattgaattcaagcaagtagcatttacataccaacctaatactccgtttgcggttaaggccttagatcatattaatctcgagattcctgaaaattcgtatacggcgattgtcggtcacacgggaagtggcaaatcaacaattattcagttgttagatgggttactgcttccgactagcggatcgattcgtgtggatgagaatgtgataagtgctaccagtagcaatgcccaattgggccgaattagaagccaaattgggattgttttccagtttccagaagctcaattattcgaagaaacggttcttaaagatattgcgttcggaccacagaactttgggaaatccgaagaagaagcctttgcactagctcgtgaagcgatgcagcttgtcgggctcgatgctgacctggcggagcgttcaccatttgaactctccggtggtcagatgcggcgggttgcaattgcgggcgtgctcgcgatgaaaccgtcaatactgatcttagatgaacccacagctggtttggatccacgcggacagcgggaaacgatgcagttattcgagcgattgcacgtggatcaacacgtgacagttattttggtgactcaccagatggaagatgcggcccagtatgccgaccaaattgcagtgatgaatggtggccagctggtgaaggttgcggaaccggcccaaatctttgccaatccgcagtggttaaaggataatcacttaacggtgcccaaaacgacgcaaatggcgcacgaattggaacggggcgggttcacattcaatccgtatccattgacgcttgagcagcttgcagtgcagattaagcgacaactagaaagtaggacgcaataatgttttcaaaggtcttatttggtcggtttgtcccgactaattcacttattcatcgtcttgatccccgggctaaacttgtgttaagcctgtactttattgtgatcatcttcatggctaatagttggcagacttatgcttggttggcggcctttaccttaggggtgatcttatcaactaaagtaccactaaaatttttctgggacggtatccgcccactcgtttggattattttgtttacggtaatcctccaaatcttttttagtagtggtggacatgtgtactgggcgtggggaattttatcggtgacgcaatttggtctagttaacggtgtttatattttttgtcgatttctattgattatttgtatgtccacggtgctgacattgaccacgcaaccattaatgattgccgatgcggttgaggcactccttaagccactggccaagctgaaggtccccgtatacgaactggcgttaatgctgtcgatcgccttacgatttgttccaaccttaatggatgagagtcaaaaaattatgaatgcgcaacgtgccagaggagttaattttggtaccgggagcctaatcaagcgggttcgatcattgataccgattctaattccgctttttattagtgcctttaaccgggctgaggacctcgcaacggcaatggaagcacgtggctacagtggtggtgagggacgcagcaaatatcgactactacactggcatcgtgcggataccgtggcgtgcgtcgtcatgctgggcgttacgctgattttatttggattaagatatttagcataggagtttaaacacgtatgtatcgttataaaattacgtttgcgtatgacggaactaattttgcgggatttcaagttcaaccgcatgaacgaaccgttgagcaaacactgcaaattgcggtcaataaaattgctaaaaaaccgacgccaccattgggcgtatacgggtctggacgcacagatgctggggttcatgcgttagcgcaggtggcccattttgatctaccttttgatattccgggagactcgttacggcgagcgctgaacagtattttaccgcttgatattttagttaaggatgcgcagcaagtcagttctgaatttcatgctcggtataatgcccatcataagcgataccgctaccgtgtatcgcagggagaatttgtggatccgttcaagcgaaattataccgcgcattttaaatacccacttgatgttgcacggatgcagcaagcatgccaagatttagttggtgagcatgattttactagctttgtcgctgctggtagccaaacgaagagcaaggtacggactattttcgatgcgcgggtttggcgagatgagcatgatcaagaaattctatttgagttttccggtaatggctttttgtataaccaggtacggatcatggtcgcattgttattggaaattggtagtaaccaacgtcccattgatgatattccacgggtcttggctgctaaggatcggaaccaagctcgcggaacggcaccagcagctggattatatctagttgatgtcagttataatgactaaaaatcattgacgaatcactaaaaataaagtagactaatcattggtattctttaaccgcttaatagccccggaagcttattaattagttgaagaagacaagaaattggaggattttacattgaaatcgacatacttagctaaaccaggtgaagttgaacaaaaatggtacatcgttgatgccactgatattgcacttggtcgtttatcaacagttgttgcttcgatcctgcgcggtaagaacaagccaacatacacccctaatgtggatacgggtgacaatgtgattgtgattaacgcaacacaggttaaattaactggtaacaaggctagtggtaagatttattatcaccactcaaaccatccaggtggtttgaagcaaaagactgccggtgatttacgtgccaataaccctgaaaagctgatcgaaacgtctgttaagggaatgcttcctcataacacccttggtcgtaagcaaggattgaagttgcatgtttatgctgatgcaaatcacaagcatgaagcccaaaaaccagaagtattagacattacaaacttaatttagggaggaaactgaattggctcaagtacaatatagcggcacaggtcgtcgtaagaactcaactgcacgtgtacgtttagtacccggtacaggtaaaattactatgaacggcaaggatattactgaatatatcccatttgctaacttgcgtgaagtggtattacaaccattcgacgctacagaaactaaaggaaactacgatgttttagttaacgttcgtggtggtggtttctctggtcaagctggcgcaactcgtcacggtatcgcccgtgcattgctcaacgttgacccagatttccgcggacctttgaagcgtgccggtctcttgactcgtgacgctcgtatgaaggaacgtaagaagccaggtcttaaaaaggctcgtaaagcttcacaattctcaaaacgttaatcttatattttcgtttacgagaggcactttgcagaaatgcaaagtgttttttttttatctaaaactaatttgcgtcattgcgcagtttagtgtacgatggatcggtgcgaaaaattaagtagaaatgagtttaacatgcgtgatttaattgcagatcgccgactgatgaacaccgtagagtgttttttactggctgggatcttattctttggaacgttaccgatttttattttgacctacgcgtatactgccatggtcatgatctttcgggcgtggttaagtcagtttaaatttcaaattaaattgacgttgatgagcacgtacacaatggttttaattcttgaaattttattttgtgctcaggtgacgtttggtcatcatttcttttggggaacattgtttgttagtcgtcttttttctacggtaatgatcttgttgccattggcagttgaacggattgtgattattcataaggatgccgactcgtacttgccatctatcagtgaactcaccgctttaagttttgagcaacttaagcataaccgggaagcaatccatcattcgatggaagaggccgaacatgtccgaaaaacgttggcaattgataaattgaaaacaatttttattgatatgaagcgtcatagttcgattagatacgttaataacgggacattgacagatgcttattttgatgcggcgaaggatgcgttgacagatccatacatctatattgtcatctcaaacactggcagtgatgccagcgaaattatttcgttgtttacgcaaaagcagtacaatcacacttcactgagctttgaccgagaattaaagacaattattagttacaacggtgggaataatgtgtatccaccgggactcaatccggaaatagtggaagcctttcataagaaagatgatgcgtcggtactggtgtatcgtttgcaggttacccgcgaacaaaagaaacatatgattgaccagatcgagcaaattaatcacgatgggagtgcctacaacattgtgggattagtggttaaacgctcgctgcgaccgaatatcatgttttgctcacagtttgtttatcgaatgttagagagtaacgggttggcgtattttacaaagccagccggaaatgtgaaaccaaccgactttattgagttggattattataaaaaaaccgacttttgttatgagattaagttttaggaccgtcaacacgattaggtgttggcggtttttgggtcgatctaaatccgatttttactgtgaactttaactttgtgtggtcagaggcgttttttgccccccgactattgtataatcgtatatacggggttcggcgagacgaccaaattgcgttgaagaaaacgcacagtgagtacttaatcggaggagatcgtatgcaaaagacaacaccaaggacagtcgcaattttaattccggcgcttgatccagatcaacatttgattgagattattacagaattagtacatagtgagacaggcaagataccgattgtggttgttgacgatggtagtgagtcacaagcaatttttaatgaaattctaggccagtttgggtcacgagtgaaggtattacatcatcagtataatcgcggaaagggtgaggcacttaaaacggggttccgatatctccttgaacaggacgatatagcgggaattgcaacgatggattcggacgggcaacacacggttgctgatgttaatcgatgcattgctttgtttcagcgccatccacagagccttatcctgggagttcggacatttccaactgatattccttggcgcagtcggtttggtaatcagctaacggaatcgcttgtcagaaaactaacggggcttaaaattacggatactcagactggattaagggttatcccggcgacctatgcccgtgatgcattagcatttaccggtgaacgttacgcatttgaatttgaaatgctactacaaaccagaaaaaaagatgttactgtgcttgagcaaccaattcaaacgatctatattgacagtaatcgggcctctcattttcgggttattcgagattcactgtcgatttacctgcggttcgttaagtttgcactgagtggggtagcgtcgtttctaattgatattgtgttatacacgttgattgtgtggctgacgaagagctactcactggatagcattatgggggcgaccgtaattgcgcgcctactttcttccgtcgccaactatatgatcaaccataaactcgtcttcaataatgaaggacacgcaacgttagttaaatattttgcattgatgtgtgttcagatgattgtttcgggttatttaacgcacggattaacccagatactggtggtcgttgttaatagtggcctgatttcaacggttgcgaaaatgattgtagatttcggtctctttttagtgagttatcaaattcaaaagcggctgattttctgcggagagggacctcatgggattaagtagaaaacgaaaagtgatgtacatttttgccattgttctttcagtactgtatttgctttggcgcgtgttgtttaccattccatggcatacccatattggcgtcctaatttttgcgttagccttggtgattagtgaaatcgtgtcgaatttgacggcttatgtgctgattattttacgcttgatggaagatcggcatcggcaaacaattaccatccccgaatatgatctgtcacagccactaccagatgtcgacatcctgattgtgacgcacaatgaagatgttgctttgctaaaaaaaacggttaacgccgcgacgtttatcgattacccagataaggcccgcgttcatattgtcttatgtgatgatggtaatcgaccagaagttgcccgattagcacgtcaatatcatgttgattatattggaatgaccggtaacaagaaggcgaaatcgggaaatattaaccatgccttagcgcaattacatgcaccgttatttgcaatttttgatgcagatatgattccattttccggtttcctggccgatacggttcccttatttgtcgacaacttgcgccaacaatccgtcgattcaaatacacagccattgggttttgttcagacgccccagagtttttacaatgctgatatctttcaatttaatttgttttcagaaaaaattgtggctaatgaacaggatttcttctcacgcgacgtcaatgttttaaatggctacaataaaattgcgttatttacgggatcgaatgcaatgtttttacgacaggcagttaaagaagttggttggtttccaacggataccctgacggaagattttgagttaggggccaaaatcaacattgccgggtacgcgagcttggcaactgctaaccctcaatccagtggtattacaccggtggatattaagggagttgtcaaacaacggacgcggtgggcgcgaggcgttattcaaagttgccgcaatattcatatttttacgaatccacggattccatttttaaaccgaattgtgctcattaatacttatttgtactggtggtcctttttacgccggctgatctatattgcggctccgattttatatgcgcttttcaaacttcaagttgtgtatgctaacttctggattttgatgatcgtctgggctcccgggtattttctccttcacgtggttttgggggatgcgtccagcaaaattcgaaatgaacgttggggagaagtgcaggaaaccttttttgcaccgtatctctttttaccggtgttattgcaaactttacggattaaagccaagaagtttaaggtgactaataaaaatagcaaggctaccaagcgggatcttctgtatattttgccgtatctgttaatgtggctgacaacgcttgttgccattataaaatttaactatggtaagtggggctctgaaatcattgtcgggagtgtcatcacgttttggttgctgatgcatttcattaatctcagcttttgcctcttcatttcgctggggagaacaatttaccgccaaaatgaacgcttcgttcgcaaatttaatggcgaaataagcatcgatggacaagcacaatcgatccccattcggactaatgatatttccgaaactggcctttcgtttgtgactgttgatccacgtattgagcttgcggtgcaaacccattttacgggggttctttggcaccgcgatcaaaccaaggttcagtttagtggaacgatagtccggcaaacaaaggatcgggagcagacgaattttggggcggttgtgaccaccacgagcttcaaggatcgtaactactttttacatcttgtctatgatggagaaagtggcatgctgccgaaagagcaggattcttggatcaccccgtttgatgaattgaatatgaattttacgttacgacttaagcaactgcagcgtaaacttagtatttttactacgcgtaattaaacgaccgggaggaaaacaacgtgtcaataattggacttttgatttatctcgtttcgttagttggctttgtcggcacactgcggtcatttggtgtactccgttacctttcatggatttcgtcaatgttgctccaagtcctgatactgtacgttatggcaatgttcaaccagcttaatttaggaattcaattagtagcctttctgggatgtagtttatttattattcggatgattttactaatgttgaacattggccgagtacggtttgaagaactgcattactttgatgtgtggatgatcttgctaggattactcctaggaaaggtgctttatgcgagtcccttgattcattatgataactactcacattgggcgttaatcgtgaagtttttaaccttcgaggggcatctcccaacggcaagcgatccacttatttcgtttacgtcctatccgccggaaatggcattaatgatgactaacttagttaagtgggttggatttagcgatggcacgatgttactaggtcagtttattctgatttgggcatgtctatatgcgacttttgccgttgtgcgagatcgtactcgtggattaatgtcatttacactgtgctttgtcattacaattaccaacgtatttaatattgcaattcgcatgaataatctgctggtcgattatgtgttacccgtgctaactgctgccgcaattgccggtgtctatgcgtatcgtgagcacccgtggctccaattcggccatgtaatgttgtttgtcaacgcgctcctgctcgttaaaaattcaggtggtttcttcgttgcgatgattgcgttctattatttgtactgtattttgaagtatggccagcaaaaatggcgttggcgtattccccaggcaatacttgcgacgggacttggggtcggcgttggggtactgccatttatgtggtggcaacaacatgtgcaccagacgttttcaggagtgtcaaaacaccaaattagtacgcaagcctactctaaacagctgtcgggggaggatcacaccgtcatttttaagatcggcaaacactttgttgatcatattttaaattttgggtcgctatcaacccgtggtgtgattcttatcaatgtcggattactgattggctggttagtgatgagatggtggctacatcataaaaaccagttgctgaccactttgattgtattggatattacttttattgcatattatattagtttatttgcgatgtacgttgtctcaatgccgtacgcagaagccatcttgttggatgggttagaacgatatatgtcgagcattgttattttgagtctgttactcggagctatggtacttttagtcacgatggatgattgtttatacgaacaacgaatcgagaaacggagtataagatcctttagctcgatttttacgaaaaatatgtatcagattgcaacgtttgtgttaatgattttttcgattattttaatgttttccgagattaacggtattgaatataataattcgattgggaataatgagttaccggtacagatgcgaaaaattgcacgacaaagtaagcagtacaatcatactaaaatcttactggtggatccccatgctaatgatgttggggattactatgctggctatgttggacgctactatttcttttctgaccaggtaacaggacaggaaaatttcatgatgagcgtcaaagagtttaaagctttgacgcagcagtatgattacattgcgattcccgaatggcatcggacgtttaccgtgatgacgagcaaggtttatcatcagcactttaagacggggctatatcgggtaaccaagcataaattagtgaaagtaaaccatatttaaattaaaggactgtataacttatcttttgtgtgagttatacagtcctatttttaattattcaaataatggtggtaaagtagcggtgatcttgaagtgatacttaatcgccgcaataatgtgttgtgcagcaaatccatcaccgtatggatttttggcagttgccatggcttgatagagatgatcatcagttaggagcgcctgcatggtttgcgtaattatttgtggatcagttcccaccagtttaagggtgccggcttcgataccttcaggccgttctgttgtgtcacgcagaactaagactggctttccaagagaaggcgcctcttcttgaacaccgcctgaatcggtcataataaagtaactacgggccgctaaattgtgaaaatcaacgacatctagtggatcgatgaggtgaattttaggatcatcacctaaaatctgatcagcagtttgttgaacacggggattgagatgaacggggaaaataatttcgacgtcatcattgtggtcaacaacatcgcgaattgcctggaaggtgcgggccatcggggctccttggttttcacgacgatgcattgtgacgagaatgatccggtgctgaggattaatttgagataaaacatcatggtgatagtcctttgagacggtttccttgagggcatcgatcgccgtattaccggtaataaaaatatgttcggcagcatggttttctttgcgtaagttcgctgcactgagttttgtgggtgcgaagtatagatcggcaatgtcatcagtaacttggcggttaagttcttcgggaaatggtgattgtttattccatgtccgtaatccagcttccacgtgtcccaccggaatttgatgatagaaagcgctcaagctcgccgcgaaggtggtcgaggtatcaccatgcactaagacgatatctgggcgaacttgttcgaagacgctgttcatctcggtgagcacattaacggtgatatcggttaatgtttggccttgcttcataatattaagatcgaaatccggttggatcttgaaaatgtgtaaaacttggtctaacatttctcgatgctgggcggagacaacaatcacattttcgagtgtcggttcacgttcgatttgctggataacgggggccattttgatggcctcgggacgtgtcccgaagattgacattacttttagttttttcatgactaaattccttcctcataattacagattaaggcagtaacttaccttaacttcttgatatggtaattaaagtataatacagtcaatagtagatacgtatacgttgggagcagatattttaatggatagattagtatgaaaaaaagcgggttactattagtgataatggtggttatgatgggcctcgtgggttgtcagaagagagcacaagtcaccatgccaaagggaaatatgatgcagattgtgacacaccaacagtcgccatttttcaaagcgcaacaaaagcggttggatcattttgtcgcgcataaaatggttcatcagggtggtatctatacgaactttcgaaaggttgcgcatcaaaagaatgtggcaacgggtcacgaaatgttgtctgaatcttcaggattgtggttagagtatttggcccaaacccatcagtaccgccaatttcgagagttttaccgactaacaaaaaagcaatttgatcagggcgaacaattcagttatcgtgttgaccatgccaatggtaagcaataccatgtgaatgccactttggatgatctacggattattagatcgttacagttgtatgcacaattaacacatagtcatcgttatcggtatgaggcagctaagcggtttgccttgctgaaacgtaatgtgattagtggtggtcaagtcagtgatttttacgacagccatactcatcaaaaaagtacgacgagttcactggcctactacgacctactaacgctgcactattttgaaaaaacaacggctagtgacaaagttgcctatgcacggcaactgaagcttgtcaaaaacggttatctgggcgatgcgttcccactgtatagtgctagctatgattggaagactaagaaatatagtacagccaacttaaatatgtccgagaatttggaaacaatgttacacctttccgaggttcatcaattaaatccgcatactttaacatggctgaaacaacgggtgaaacagcatgctttaagtaacggttactcggtgacgggggtcattgtcgatcgaggacagtctgcggctaattatgctctggcagcaatgatctttgccaacgagaatgatagtcagaattaccaacgggcgatggcgcttgtttggcagtcacaagtgactgataaagattcaataatttatggggcgttgggtgatatgcagactaaggatgcttattcgtttaacaacctggttgcacttttagcttcattatattaaggatggttggcttgaataattggattaaaaataaagggcgtttagtaactagatacgtatcaccggcaaccgttgcgttagtattggcggcgattattagcggtatcttactattcgtaccaccgattcacggattggccgacaatggggatttttaccgggcaattttaagtaatggaatctatcgattaccgtcatcacatagtcaatttttagactacgtgatcactaaatttggaatttttaaatattttaatgaaaataatacggttgtgatgtcatcacagtcattatttgttcggtttgccttgttgttaaataagttattttatagtagatcggtgtttgacttgcgttttatgggcgcggtgtactacgtttttttcttgggtgcagtgtatttactcgcaaaatcgttgacgtatccattccggaaaatcagtagttacgtgattgcggtactagttgtcgtcatttttgcggattcgtctttcacattgtatttcaactctttttttggagaatccgaaatgttgattgccacaatgtatgcatttgcggccattatgttattggtaaagaaatgctacaaaaggcggtggccagcactgctactgttttttgtcagtactattttaatgattaccagtaaacaacaaaatgcaccacttgcattgagttacaccgttatcgccatcggcctattctttttatcacatgtgaaggttcaaaaaattatggtagcaatcggaattgctggtatcttagcttctggggcgctgacctatctggccattaattcagattttaataatatcaatatgtttcaatcgtttacacatggggtgctggtggaaacacaggatccaagtaagaaaattaagcagcagggattggatgaagaatttgcgcttatgcgatcacaaaactactacgcgaagcaatttgatgcggtcaaaccaaccggaaaattagttcaaaaaagattattatccaaaatgaatattgtttggattacaaaatattatttaaaaaatcaacggcagtttatgaatttaatggatttagcggccaaggatatgatggttactcaggtaaaggcggttggcgattacacccgtggctccggccatcgcgctggggcgcaaactaaatattttgtgttgtatagctcatatgtcggggccttttttccaggcaagttcgcttttatttgcttactagcagtgggcttcattaccgtctatgcggtgggggcgtacgtagactttcggcaacatcggtatcaaggaattctccgcttttgcctcgttttaggatgtatgacggtggtcgtttttgtaccgatcatttcggtcatcggggatggtgatgcggatttagccaaacatttatttatggcccctttgagtctagatcttgtattcattctctttatttctgacattttaaaccacactctctggcatacgaagagggagggtgaacaacatgattaaaaaatggcgatggtcaatgatggtactgctgggcttactcgttttctcgatcataacggtaatcaagccagtaccggtagcggcggcagagacgaaccgagtgttacttgtctatgactcaaaaaatacggttgcacacggtgagaagaaaattgatgcgctgcaacgaattttaacatcgatgaatttatccgttaagacggtcaaagcgtcgaactaccatgctggtgaactgaatgccacctacaccggggtgattacgatggtgaattggcgtcaggccggattaaaaaatacgcaattcgaaacggatcgagcacactttacgggaattaaattgcacatcggcgattgtttaacaggaacggaagctaaggatttacaagggaagatcaaagttttaaatgaacaacaattgatcctcaaaaatgggaatgatcaacaactgctcccctttagtgatcatttggaagtactcgatcagctgcctaccaacgcgatcaaggttggccagttaacgtcacagcaaacggaccaaaagacatatgactatggtgtgattgttggtaaaaatgcttacttaccgtatttgaagacacggggactgagtttattggtcgctgaacaaacgattacacaattgtttggtcaaactcaacagtatcaaccgttattaacgtttacggatgtctcgccatacgcaaatttgaaggttctggaccagcttagtgagtactgctataagcgaaagatcccatttgcaatcagtaccacgacggtatcagataacactgatttacaggcatttgctcaatttacggcgtttttacgccgaatcgagaaacgtaacggcgtgatttttgtacaaacacccgtgattggtggtgcgacgcaaagtgatggacaaaagttaagtgagatgtttacgagctatctcgtcagtttttcacggtatcaagtttatccagtggggattagtgcaccggggtactggaatcaggatcaagtattacgacgaaattcactcgccaaagccaaccactggctattattaccgaacaccgacgtcacgtatttgaagcaggataataaaagtcaggttgctaaccaaagtttcatggccgtatcggctgcatctttgacaactattcagaatcaatcccaaattaaatttaacgttccgacggctgttacagtcccggtgccatcgagtatgaagaaaatccatatcgtggaacgtgaaattagtgaactcggatttcagtggtttaacttcacgcaatcaaagacttcgactgagattaagtcgggcaccacgacagttaattatcggcagggtaagtactatgtaaacggtagcgaagaacctattacgatgagtgatcaagcacatacaaaggagccggtacaaccgaagactaaggtgctcttcaaatcattctttaagacccagggccaaattattggtgtcttcttcggcattgtattcatcgtgttattgattttcattttgattggtcgacgaatttatcgcaatatgtttaaacgttaggatgtgaggagtattactacattagacttttttttgatggtggcgattatttccatttgggggattttaattgttaatttagtgcttacaattgctggctacacttggtacttaaagcaggttaaacaaccgacaccgcagttgcctgagcaaccaccgtttgtatcgatcatggtaccggctcataatgagggaattgtgattgtaaagacggtgctatcgctactgagttttgattatccgcatgatcgttatgagattattgtgattaatgataattctagtgataattccgcggaattattagctgagctgcaagaggagttttctgaaaagcgactcaaagttatcaacacggacaaaaccaatggtggcaaaggtaagtccaatgccttaaatattggattgacccacgcgcgcggtagtatcatttcaatctatgacgccgataacacacctgaacatggggcgttaagaatcctggtcgcacagttgttatctgatgatcgcttagccgcggtgattggcaagtttcgaacccgtaataaaaatgccagtctgcttacccggtttatcaatattgaaacgttgtccttccaatggatggcgcaggccggtcgtcaacatctatttcacctatgtacgattcctgggacgaactatgttattcggaggaacgtgttagaaaaggtaggcggctgggatgttaaggcactcgccgaagatacggaaattagttttcgggtctatcaaatgggataccgaatcttctttcaaccacgagccgtaacttgggaacaggaaccgcagacgttggatgtctggtttcatcagcggactcggtgggtgaaaggtaacatctacgtcattatcaaaaacgtgaaacggttgtttcaaaaaaagggccgaccgattcgtttcgatattttgtattatctatcggtctactttttactgatgctctcgctgattttgtcggatacagtgtttgtattatccgttgcggggatcgcacattcagatttgcagggattcagtaacgcattatggctttttgcaattttgatgtttgtcatcagtacgttcacgacgattacgacggaaaagggtgaactgaccgctagcaacttattaattattgtgtttatgtatttggtttatagtcaaatgtggctggcagtagccgcatacggaatggtggggtatattcgtgaacaagtatttcataagcaggcaaaatggtataagacgaaacgttatcagtagggcttggtggctctttttggtgacgttcattgtcgggtgtggtattggcatgaccggtgtgcgggcggataaccaaacgtacaccgaacaatttcaaaataacactacctcgctttcgggcaagtcagtcgagacaaatatgtactttactaaaatggactattgggacataaaaaaggcaacttttaatttgacgtatcaaatttcacagctggcagagacccaaaaatctgacatcacagtttcgattaatggggtcaaattctattcgtttcgaccacatgatggggatggttttcaaacggaacaaatctcaattccggttgagctactgacgggggaaaataacctgcaaatcagcggtcaagttttgaacaaggcaggaaacagtaactacgatttagcccaaacaccggcgaactggctgacgatcaagcagggatcgaatgtcaattttgagtatcagttaaaggacgcggataatacgctgcattctttctacaatcatttttctggtgaagataccgtcgcgaacggtcagtcgcgaattgtgacggcgaaccaccccggtggcgatgagttgactgctagtatgattaccttatcgggtgagtcacgtgtgatcaccacggataatgaccaaatccaggttgtcaagcaggcatccatgaatgcgcagcagggtgattatcttatggttgttgcgacgtatcgacatctgcccaaggagctgaaaaatgcggtcagtgcgacagaggttgctcaccatgcagtgattaaaacgcactatgttgatggaaagcactacctaatcgtgaccgctcaaaccggcaagctactcaagaaggctgcccgttttgtggcaaatgccgaattaatgaatgaaaccaataaggctaccgaaaccgttggtagtcggacacggacgtttacgtcggcgttacatgatcaggggcattaccagctgacagatcaaacggataagattatcggtgccggtcaccgggagaccagttactttgtgagtcttccgaacgaccggtctaacgctgacggatcgacggttaaattgcatttacggtatagtaaaaatctcaactttaaccgttccttagtcaccgtgtacgttaataacacgaccattggaagcaagaaactgacggctgttcatgctaacggtgatacgctgacggttaaggtgcccaatgggatgaccttaggtagtagttttaccgttcgggtggcgtttgatctggaaatgaaggatcaaattacttctgataatagtgcgactccatgggcggaagtggggacttcatcgaaaatgacggttaagtcgcaaaagagtaatgatttgctatttacgaattacccgacacttttcatgaaaaaccaaacgtatgataacttggcagttgtgattccaaagaaactttcaaatgatgattttcaaagtttaacgaacatctttaacttgattggcaattttgcgaagagcaatacgggaagcatccaattttatacgcatcaaccaagtcagcatgttttaaagactaaaaatgtgattgtcttagggacaccacaaaataatcactttattcgaacgctgaattcccacctttactttaagtatgcggccgattttacccgtttaatttcaaacgaaaaattaagcatcgaaaaagattatgggaagaccattggaacggcgcagttgatgcggtcaccatacaattcgaaacgggggatgttggtggtcactggggcgacgtctaaggctagttatctggcaacgacccagattaattttcagaagaatattacgcagtactcaggggatgcgattgttgtcgatcagaacaatagtcattatggataccggtttaagaagaataaagccattgataagtcactcgaacgtcaccgactgtttagtaaaaatacaagtttactaatctatttaggacttgctttagtcgtgatggccttagtatgtttagggattttccttatggttaaaaagcaaagaggacttaatacgaggaggaacccgcatgccaagtagagataaaaaagaaacactcatggaagatgttggcttactgttatttttgcttttgtttagcgcgacagcaatcatgatgttgctgacgaatcatattttgattaacgttatctacttattttgtacggtagcattgatgatcgtgacttattttatggggctcctgccctcactcctgactaatatgttttttattgcggtccaagtggtttattcaatttatgagtacgtggggagtactaaagcgattgtatggacactcagtttttggatgataatgcccctattgttgtgtttggcactctactatatgacgcgtaatcaaattgagctacagcaatccaatagtgatttacgagcagctctgattgaacgtggggcgttcgatcagcaaactaatctccgaacgacggttgcttatgtagaggatgcatcggtatttattgaaacgaacgagcggtttcagttacctgtgacaacggcaattatcaaaattcgatattttgatgatctcaagcggatgatgagtgaaaatcagctcaagaatttgctccgggtaacgtcgaatacaattaagacgattacccgcgataatgatattacgtatttgttgaataatgaggatccaacatgggcaatattactgtattcagatgccaagggagccacaattgcagcaaatcgaattaaagcgggttttgataaggcagttcgacaagatacagggttagcgaacttagccatttcgatggtggttgggattgccacatgggacaaggaaagcatgaacaacccgtatgatttaatgaatgcggggattaaagaaacacaatatgatgtgtaaaatttcatagatcaagcctaaagtagtcatttattgaataaatggctatttttgtggtttcaaatttcgttgctatcaggtggtcacaacttatcttattttagggagtggaaagcaatatctaagtagtcgtattcagacaggatagtaactatttgcacaatgagaactgagattgccagtattgattcaatttcaatcgagggctaagtcatataaaaagggaatgaaccaccccaatattggttgttaaataagcaacgccgaattccagatgtggttgccagtacagggcaggataagctaagttagaatgtgattaaaatcggagtgctgaagttttttgaaatcagttatcaacaaactatcagtaactatatattagggcatataaaaaaatactattttaaaatgtaaccgatttttgtaatatggaattattaatcataaacaaaactgtaagcacttgctgaattcatgataatcgcatgataaaggtaattctaaaattgttatcattttggtaaaaaaaagcttgctttaccatgcatattcgatataataaatgcataaattaaatgtaactgctcaattcaaacgttagtttggatacgacccgttcccggaggatacttggatatctcgccggatgaacgggttttttctattcttttgaatcagttacgtttttaacaaatgaataattgccagtttgagcagaaccatgctcagacacgacccgttcctagaggatatattaagtatctggctagatgaatgggctttttttattctttgtacaatccagaaaaaagtagatattagtggaggagtattattatgatgaagttaggcaagatgggtcttaagcaattaatttttggtgcagtagccgttaccacagttggaattggtggaacgattggcgcaaaggcggccattgatcactactgggcgggccacgataatgtggaacaaatttctaaagacgttgatactttaggaaatattgtgacgcaaaagaagcaggcactggcagataagcaagcaaaacttgatgatgttcagacgactttgacaaacaaagaagcggctctgacacaagccaatacggatttggcaacggcaactaacaagattgcagcgttgacgactgataatgcgactaaagatgccagtatccaaacgttaaacggaaatgttgctgacttgaagtcacagcttgcaaatactttgcaagctattaaaaattccgagggcatcaccggagtgactgacgaacaggttaaaacacagtcaaatggttctttagaaacggaaattaacgttttaaatgataagatcaatgcgctgaaggcaaatgatcaggcaactattgacgctgctaacacggctttgacacaggttcaaagtaaggccgatcaacttcaaagcgaagttgatagtttgactaaggaaaacgctagcttgacgcaagaagttgctgacgccaagacagctttgcaaactgctcaggacaaagcgaccgctgccgaagccaaagctgaatctgagagccaagctaaggatcaggcaaactcggataaagattctgctgaatcagagctgaatgatgctagctcagatgttgcttcggcgcgcgcccatgcagatagtgtggttgcccaagcacaaagcgatgatacggcaacatctagttcgagttctaactaattttattgaatgatcagtgacgaagggctttggcgaggcaacttgcaggcccttttatcatcttcaaaatattaatgtcgggagggaatttaacatgttaaagaaagctatgatcgggtttgcaacggtatttgggttgatcgttttaggatttgctggttttggtgtcaaagtttttgctaaccaaacatgggcgtcatcgggacataaagacgtgcaacggattaatagtgcactgacacagttagatacccttctgtcggaacgtagtacacaaattaatgatcaacaggtgaaaatagcaacacaacaggctacgattagctcccaaaatgatcagcttgcacaaggtagtgcaacgacaacacagcttaacatgcagattacgctattaacgaataatcaacttgcattaacggatcagttaactgaagcggccaacacgttattgacgcagcagcaagaaagtgcagccgcgaacaatgctaatagtcaaaaaattgctagtttacaggtgacgattagtacgttagaacagcaaattactaacttgaacaatcaaattacaagtttgaaccagcaactaagtgacgccaagaacagcagtggcgtttcgcaaactgagtacaatgcattgaatcaaaagtatcagacactcttgaacaatcctagtacggattcgattcggaattcatccctctaccagttggtttatcaggggtacaaggctgaaaataatgatatgagtggttggcagtctgatttgagtgatgccttaactgcgattaataacggcaacactgatcaagccaaacaaaaaattcaagaagcgcaacaacgaatgagtagtaatataaccactgccaatcagaagctttcacaagcagagcagatgcagtaagtcatgctaggatgaagccaagcgaatggttatttaaaaaggcccatttacctaacggattaaaacatccattaagtgaatgggccttttttatgaagaatagtaacgatggtaattaaaagacagttcagtttcaaatgaatactgaactgtccttttaattatttctccacgtcttgtaatttttggttgttatctagctgtgatttaccttgccagtgcattttctgaaggacaatcatgctgagcaggagacaaattaaaccagtgatggcgaagatcaaaagtataccagtgacctgccagatcacttgattaccaatccccgaggtgagtgcctgacggaatcccagaatagagtaggtcattggcagccatgggtgaatggcattgaagaacgaatttgtgacttccattgggaaagtaccgccggagccacctaattggagcatcaggaggaccattgcgacgaaccgtcctgggttatcaaatgccatcgagaagaacataatcacgtacatggaggctaatgaaaagatggttgcgattaagaacatttgcgctgggtgatcggcgtttaagccagcagccatcatgagcgcggtttcgatgacggccatgccaatggcgacaatcccactgacgactaccttgctggcaaaccattcttttggactatgaccagtcattgagattttccgaattggataaacaaagttgaagactaggcagccaacgtagagggcgactgatagaacgtatggtgccaatgcgtggccgtagttagaaacgtggctataagactggtgattgagcgtcgaaggcgctgcaaacatggcggccgtttgagcattcggatggataccgttaattttggccgagccactggaaagcgcggactgaagtttaccagagccagatactagctgagtagcaccactggtgagttggccagaattattagcaagggtttgcgtgccgctcgctaactgattgacaccggatgtgagtgttggtacttgactgttcatttgggatagaccgcttgaaagctgcccagaacccgagttaagcgccgctgagttgttcactaaggtttgagtgcccgattgagcttgagaaacgcctgatgtataagcatttaaaccagtttgaatctgttgtagtcctgaatttagcgtttgtgatgcttggattagacccatggtgctctgggtattgccccgttgatccaatccctgtttaacggtttcgagacccgtttcgagttccgtgatggcctgaacgccaccgtcaagtgcgagagggacttgcttaagctgcgtttgaagggtcgttaatttttgtgataggccggtgagttgactacttgattccgagagcttggttcccacagaggtgagattactttgcatgtcagaaagcgagttgctggtggcgcttagctggctgccagcattagtgacgttcgtaccgacttgattaatggccgctgcaatttgggtagccgttgcgggatcagctgccgccattttcttgtagccatcgctgttcaggagtgtttgcaactccttgagtgattgacctgcttgttgtaattgagcggctgtgctctctgtattactggtgttaaagacgtttttataaattgtcgataaatcttgaccgctggtcgttagcgccgttttaatttgagtagaattagcattaaaactggctaaactggtattcagtgcagccatgtccgcgttgttaccactagaaacgcccttaacaagggttgagagtgcggtgagggccgttttgacactgttaatgtcggattgattggagcttagttgactgccaatttggttagaagcttgctgcatggccgccgtcaacttcgcatttccactacttgcactcgcgacaccgctcgtgagctgactggaattggctgttaattgctgcaggccgctattcacctgcccaaccccgccggtataggactgaattgccgttgttagagtgctaccaccactggccagttggctaatcccattagcaagggggacgactttaactttcagagtttgaacgccactattgacctgattgacaccaacggcatataagttaagtccgtcattgagggtgacagtgccgtcgtggagctgagtttccgcttttgcggcggatttcattcccgttccaacagtttttagttgctgaaagacagctttggcgtaggccttagtgacttgctcacgaatctgtgtattcagttgtttagcacccatgtcactgatgacacgcccgatataattgagtgagtcattggttttataagtcaggtgcatttttttcggcgaggtacttaagaccgttgttgcatttttagaaaaatcagccggaatggtaatgaccgtgtagtatttacggtgtttaagccccgctgctgctttatgtttggaaacaaagtgccattggagctgatcgttttgtttgagctctttgacggtttgttttccgacagccatggtttttccctggtaacggacgggacggtcctcgttcacgacggcaacgggcagatcacctgtatgaccatatggatcccacaccgatttaagaaagaagatacagtataaaaatgggattatcataatgacaatcgttgataagagaattagtttattatgaaaaataaacttaaactcatttttgatcatttgcatattattcactcctacaacatgaccctaattagggccattctcccataatgtttagtaaacataatacgctttcataaaataaaacgctactcccaataccttatataacatgggattaactatggttgaccatgctaatagtaactgattagcaatcattatatttttttatggtgagccaaaataatcaacaatataattctaattgaccgctacaactaggcagactgcttactatgtcttatgatggtactagaatagttgaacagataacagaaagtgagtgaaatgatgcccgaagaatatcatacctataaaattaaatcgtatgtcaacgcgagccacgcgatgcgttgggaagatggagaaggaaagcagcataatcatacgtgggagatcatttgtgaaattcacacctcaaatgatcatatgattatttttaatgatttggaaaaggcggttaatcgagtactggctggtatatcgggccaattcttaaatcagttggcgtattttgagaaggttaatccaacgctagaaaatgtgaccatctatttgtttcatttaatcggcccagaactggaaaaaatgcaggctaacttaattcgaattgaagtgggagagtccccgacaaggttctattgcatttcagctacggagtgaccaattcattcgggacgattagttgtgactggaggaaccgcgttgggtaggatataatatggataaaatggaggtagtgaaatgacttttgaagcagtattaccagatttaaagcagggcaaaaaggccgttcggacaggttgggaaggaacggaactcttcgttgaattggttcctgagggccaatttaagggggatgtgttaaatccttatttcttgatcaagacggcggatgaggcttatagcctatggtcgccaacggattgcgatattctcgccaccgactggcaattggtcactgactaatggccggcgaatttgatgggcaaacggtcattatcaccggtgccgcctcgggaattggtaagtcacaagtggcacgattccttgatgaaggggcaactgtcattgctgttgatcgggatcgcgaggggctgaccgtcctcaaagatggataccccgatgcggccttgacgattttagctggtgacgtggctcaggccacaaccgctaagcaggccacgactgcagctttgcggcaaggagggcacattgacgttgtctgcaatacggctggggttttggatgcgtatcgaccagttttggagacgtcaattgagcaatggcagaccattttgtccgtcaatttgactagccagtttcttctgatcaagcaaacattaccaatcatgctggaacagggacacggggtgtacgtcaatatggcttcgattgcgggattagtggctggtggtggcggcgcggcctacacggcttccaaacatgcgattatcgggctaaccaagcagttggatgctgattatgcagcccaaggaatccgagcaaactgcattgcccccggtgccattcaaacgccgatgaatgcggccgattttgccggagatggtaagatggcgaattgggtagctgagcagacgccggccaagcgctgggcccatccagatgaagttgcagatctagcggtatttttagcaagtgctaaagcggattacattcatggaacggtgatgccgattgatggcggttggacagaaaaataactaacagtcgacaaactaacggtaatcatttacaatgaaatggttgaaattttagatcaactctaatttgatcgcactacgacacttccttcacctttggtcgtagttatgactaaccgatgttcggttacaaaggagattataataatgaagaattctgctcaaacgtcacgtatttcggtgcgtgaggtaacaaagacggcggtggtggccgctttgtatgttgtcattacgcttgttttatcaactatcagtttcggggtcgttcaaattcggattgccgaaatgtttaactatttggtactgtttaacaagcgttatctctggggtgtgagcctcggtgtctttttatctaactttgcatcgccaacctggaccctagatgttccgattggaactgcgtcgacgtttgtctttttactcattgtcatgttagtgacgaaaccaattaaatcaatgcccattaagtttgtggtaacggccattattatttcattatcgatgttcacgattgcttgggaactcaacgtaatgactaaagcgccattttgggcgggctggttgacgattggattaggtgaactactctctatgacaatcggaggcattattatttacctgttaagcaagcgaattaatttaacaaaataagtaaatgagaaggatcacggtggtgattcttttttttgacttatttttaaaattggtctagataattataaagcttggtattaaaggatttaattcgctttcaatggctacttataattagtaacttacctaaaagcgccttatatcaaggattagtgcagattagaccaatttaagaaatgagtataaagacttgtatgtacagggtaatcacggtaagatattactcgtgtgattaagagaattctaggaggaaatagattatgaagacttatctgcaacggatggggcggtctttgcaactgcctgttgcggtattaccagccgctgccttgctggtcggaattggccattatatgccagattcctgggctgttgcgcagttcctgcaggccggaggaaacgcgatcttagggtcgttggcgattttatttgcaatcgggcttgcaattggcatgtcggaagaaaaggatggtgccgccgcattggccggtctggtagcctatttggtacctatcaaggttctggatccgtcatccgttgccctgttagaggggattaaagagtcacaagtggacccgtcatttgcttctcttagcagtaatgtcttcatcgggatcattgcgggacttgtggccgccggtttatataaccgattccacaaaacaaagctacccatggcactctcgtttttcagtggtaagcggcttgtccctattttagccgcaattgtcatgctcctatttacaatattattgctatttgtttggccaccagtgtatgaggccttggtggcattcggaaaattcatcgttggattaggcgcagccggtgccggtttatacggctttttcaatcgtctgctgattccgacggggttacatcaggcactgaatgcggtcttttggtttaatacagctgggatcaatgatatcggtaacttctgggctggcaagggtgttaaagggattacggggatgtaccaggcagggtttttcccagtcatgatgtttggattaccagccggtgcatacgccatttatcggaacgcccgaccagagaaaaaagcagaagttgggggcctaatgctggcgggtgcctttgcttctttcttcacgggagtgacagaaccactagaattttcatttatgtttgtggcctggccactgtatgtgattcatgctgtgttcaccggattatcgttgggctttgccgcactgatgcattggactgccgggttctcatttagtgccggtttagtggactttttgttgagctttcatttgccaattgccaaccgcccgtacatgctgcttgtacaagggctagtcatggcggtgatttactactttggctttgacttcgcaattaagaagtttaatttaatgacgccgggaagagaaactgacgagttagatgcgtcaacgccggaaattgtgacgaacgacaacgacgaccagtatacggtgatggccaaaaaaatctatgctgcgattggtggcaaggagaatattaaggtgatcgataactgtacgactcggttacgattgcaattgaaagacccacaactggttaatcaagtggccgtgcgtgctgctggagttgcgggggtcaatgtgttggatgagacgaatgtccatatcgttgtcggaaccgaagttgaatttgtggcgcgggcactgaccgatatttatgatggtaagattgaagcgacggttgcccagaagcaacccgaacaaaagccggctgctccagcggaagaaacggttaaagcagggatgaccgatcagttttatagtgttgccaatggtgaattggtcgatcttgagcacgtggcggatgcgacgtttgcgcagaagttgatcggtgacggttttgcggtcgaacctcgggataaccaaattgtggctcccgttgatggcaagatcgtgacggtctttccaaccaaacatgcgattggcttggaaactgaaaacgggctgaaggtcttggttcatatggggatcaatacggtggaacttaaaggggctccatttgaagtggcggttgaagttggtcaacaagtaacccacggtgatttgttggcaacggctgatcttgatgcaattcgagcagcaggtaagcaaacaaccatgatgacgatcgttactgatatgaatgacgtggcttacatgaaatttagtcaaccaactggcccagtgaaagctgatcaggcaacaatgacagttacaaccggggcatagtgcgtgaaaagctgtggcaaatgctacagtttttttgtttactggtatttttcaccggatgaccatagttaaaataattaaattgatgtaaaatttatagtaaattgataccccttcgactgtggacagtgtaaaataggcacacagaagggtgtgaattagttggcgcgtcgacggaaacgaaagtttaaatggcagaaattattttcacggcgtggtcaaaatcgcctggctaaaattgttttatgggtgattattttagcgctagtggggtacggggttcaggaactacatcaagttcggcagcgacagttaattgtggaaaagcaaacggattctaagcaattatttattaagcaggtcgcaccggaagctgaaaagatggatcaaaaatataatgttccggcttcaataactctcgcacaggcaattttggaatcagattggggcagtagcacgctatcggcgaagtattacaacttgttcggggttaagagttccgataccacgaacagtaaggtgctgacgacgaaggaatatgtgaatggtaagtggattgtcacgagtggtcggtttcgggtttacacaagctgggatcagtctattgatgcgcacacgttactgatggtcaatggcacgaccgatgatccacaaaaatatactggggtcacacaagccagtagttatacccaggcagcacaggcgttgcagacggctgggtatgcaaccgatccggactatgcgtctaaactaattcgcgtgattgaaacgtatcacctaaataagtacgatcaataaaactagtatgaggagacaagcaatgaaagcactcgaggaaaagattaagcaggacggcgaagtattatcaggggatgttctaaaggttgaccgatttttaaatcaccaaattgatacagactttatgtttagcatcggtcaggaatttgcccaaaaatttcaggatgaaaaaattaccaaaattttgacgattgagtcctcagggattgcgccagccgtaatgaccggactacaactacacgttccggtaatctttgctcgaaagcataagagtctcacattgacggatgacttgtatacggccaatgtttactcgtttacgaagcaaactgaaaaccaaattacggtgtcacgcaagtatattgaaccaaatgaccgagtgctaatcattgatgatttcttagcgaacgggcaggcggtctttggccttcttgaaattgctaagcaggcccaaatcgaagttgccggggtcggaattgtgatcgaaaaaagttttcaaccgggtgctgacaagatcaaggcacagggaattcatctggaatcattggcccgaatcaagtcattaacggacggacaagttgaatttatgccagaataggttaaatggagtgagtcatgatggaaaataaacatattttatatccaggaaatacaattggcattattgggttaggaagcggcacccggcaattagcacaggccgctcaaaatgcgggctttcgggttgcggcttacattcacagtgaagcagaacgagacctggcaaaatttgtagattataccgtgattggcgcatggaatgatcgggacaaactgaaagaatttggtcaaagctgtgatgcggtcgtttatgaatcggctagtgttcagtccgctgtgatcgaatacctatcccagtttactttcatcccacagggaaaagaaattttagaaatcacacaggatcggctgttggaacgggcctttttcgatcaaatcaacgttaacattgcgccctatgtgacggtgattcagttggatgatgtgtaccaatcgattgactcaatcgggtatccggcagtattaaatccaattcaaaagggactgggtgagcggtccatggtgatcgagcgacagtcagatattgtaaaggcggccgattatctggatacgggcacctacgtgttggaatcgtggatttcacgttcccgtgagttttcactgatggtggctaagaccgatgatacgattaaagtgttcccattaattgaaaaccaatatcgggacggtcgtgtattggaggctcaggcaccggcagtccttccaaacgacgtgcaagaagaaattggccgaattggtcaagccgttgccaaaaacttgaactaccgcggtgtgtttgaagttgggttctacctgacggataccaatacgttatacgtcaaggggattacaccagccctagttcgtcagggggacgtcttaacggcggtttgcaccattgaccagtatgcggtattgttgcgggcggtcgcggggctgccactcccagatatcaaagtgctccaaccagccattacgatggcaattaatcaggaacaaattgatgaaattaaaacacagtggcttttgaaagaaaactggcagtttaatttctatacgccaactttacaaaagaaagttcatagttatggctttgtgaccgcaattggcgataccttagataaattacaacttcaaattgataatacagatgtctggtcggatagtccggcccagaccgaaacgactgaagattagatcgaagacctcttggactgcagtggtagttcaggaggctttttttgatgagacccgaattattaggttttgaatctcaaaatcaagacgggatttgttataatatgcagtgactgaattttagaggggattgaatgaaagtgacaagccaatcactattagcaggaatgaatgatcgtcagcaagaggccgtccttgcaaccgagggacccttattgattatggcgggggccggttccgggaaaacccgggtattgactcatcgaattgcgtacttaattgaagaaaaacaagtcaatccttggaatatcttagccattacgtttacgaataaggccgcaaaggaaatgcgggaacgggtgggcaaacttctcaatgaaggggcccgcgacgtctgggtatcaacgtttcatgcgttgtgtgttcgcatcttaagacgtgatatcgaacaaatcggatacaaccgcgcctttacgattgccgcgacaagtgaacaacggacgttgatgaagcgtgtttgtagcgaactgaacattgatacaaagaagtttgatccccgggcacttttgtccgcgatctcaaacgctaaaaacgcgcttcaaacgccagctgactacgcgaaagaagccagcagcccgtttgaagatgttgtcgcgaacgcctatgatctctaccaaaaacggttgcgagaaaatcaggccgtggattttgacgatttgatcatgttaacgatccaattgttcgaacaaaatccagaaacattggctttttatcaaaataaatttcactatatccatgtcgatgaataccaagatacgaatgatgcgcagtaccggttggtgaaccttcttgccaagcgattccgcaacctctgtgtggtgggggatgccgatcaaagtatctatggttggcgtggggctaacatgaacaacatcttagattttgaacatgactatccggacgcacagaccgtaatgttggaacaaaactatcgttcaacgcagaccattttggatgcggccaacgaagtcattgccaataatatgtaccgacggaagaagaagttgtggacgcaaaatggggaaggcgataagatttcgtattaccgtgcccaaagtgaaaatgacgaatcacggtttgtcgtttctaagattcaaagcgaaatgaagacgaacaaccgaaactataacgactttgcggtcctttaccgaaccaacgcccaatctcgtgtcattgaagaaactttcctgaagtccaatattccttacacgatggtggggggacataagttctacgatcgaaaggaaattcgtgatgttttgtcatatttgacactgacggtgaataagagtgattcaatcagctttgaacgggtagtcaatgaaccaaagcgtggcatcggtgcaagtagtgtggataagctgcaagcatttgcccaagaacatgggtggtctatgctggaagctgcacaaaatgccagcattaacaatgatctgacttcgcgggcccgcaacgcccttgaatcgtttgggacgttggtcgaggacctgggtaagatggttgactatatgacgattaccgagttgacccaacaaattcttgagaaaacgggatatttggatgctctgaaggctgataacacgcttgaatcacagtctcgtcaagaaaacttggatgaatttttatcagtcaccaaggaatatgacgatgcccatgcggatgatgaggtagaatcaaacggtaataaaatcgtgaacttcctcgcagatttggccttagtttctgatcaagacgatgtcgatgaacaagcaccggcagtcacgttaatgacgctacatgcggcaaagggactggaattcccagtggtcttcttaatgggcctggaagaaggaattttcccgttgtcacgagcaatcttggaagatgacgaactggaagaagagcgacggttagcctatgtcggcattacccgggcaaagcaaaaactctacatgacgaatgctttttcacggatgttgtatggtcggcggcaaaataaccaagcatcacggtttgttgaagaaattaatcccgatctcattcatgtggaaaatcaggcggcggggtcaatgaccaatggccgctcggtaccgtttgctcatcagaatgcgaccgcatcagcctatcatcagttccagacgcaggggcgttcacagggccggcatgttaatagcacgcaaccggtcaaaccagtggcggtcaatgctggtaccggagcaaacaagttaaactggaagtctggcgataaggttagccacaaaaaatggggcattggaaccgttgtgaaggtgaatggaactggtgaagacatggaactagacgttgcattcccatcgcaaggggtcaaacgattgttagcaagttttgcgccgattactaaggcgtcaagtgattaaaatatttaggtgataaaaatggaagaaaagctgccagtgacagaattaacaattgaacaggcacaagcggagatcgagactctgcgacaacaggtaacccagtgggggacggaatattaccaaaatgatcaaccgacggtagaggattttgtctatgaccaagcctatcaacgcctattagcacttgaagcgcagtttccggtgcttcaatctcaagattcacctactcaacaggtcggggccctcggcgagaccgtgttgaccaaggtcccgcacgaacagccgatgctttcaatgggagacgtcttttccacggaagaactgtttgcatttaatgaccggttacaaaaaaatggactagatcaaccggagtataatctggaacttaaaattgatgggctggccatttcgctcgtctatgaaaatggtcaactcgtgcagggatcgacgcgagggaatggacaaattggcgaggacattactaaaaatgttcggatgatcaagtcagttcccactcaacttcccgaaccgctgagtatcgaggtgcgtggtgagtgctatatgcctaagcaggcgtttgtcaaactcaatcagcagcgtgaaagtgatgggttaccggtttttgctaatccgcgaaatgcggcagccggaagtttacgacagttggatgctaagattaccggacggcgggaattgagtacgttcatttactacgttcccgattatgagactctgggagtaacgactcaatcggcggcactagcccggttgaaagatctgggatttcaaattaacgagcattatcaggtggtgcaaactgctgaacagattcaggcttatatcgatcaatatacggcccaacgtaacgatctcgaatacggtattgatgggattgtcgaaaaggtgaacgatttggggatgcaggttgaattaggcaatacggtgaaggtcccccgttgggaaatcgcctataaatttccacctgaggaggctgccacgatcgttcgcgatattgaatggacggttggccgcactgggacggtgacgcccacggcagtcatggatcccgttcaactggctggcacgacggtagctcgcgcttcgctgcataaccctgattaccttgcggaaaaggatgtgcggcttggtgacacggtatatctgcataaggctggcgacattattccagaaatttcaatggtggaattgaagaaacgagccgctgatagtgtgccatacatgataccaacgcattgcccggaatgtggggctgaattggttcacctcgacgacgaggtggcactgcggtgcattaatccaatgtgtccggctcagatcaaagaaggactggcacactttgcttctcgcaatgcgatgaacattgatgggttaggtcccaaaattgttcagcagttgtttgaacgcgaattagtgacggatgtggcagatttataccacctgactgaggcgcaattattaactttagataaatttggtgctaaatcgaccgaaaatctattgacagcaatcgacaatagccgtcataattcactggaacggttactttttggtttaggtattcgtcatgtaggtgccaaggccggaaaaataatcgccaagcattttaaaaccatcgaagcgcttatggcagccactagtgaagcagtggccgaggttgactcgattgggccaattattggtgatagtgttgccacgtattttgctaaccaacaggtagctgaattagtggctaaactgcaatccgcaggggttaacacagattatctcggagatgatgatgcacaagttatcgacagtgattgggctggtcaaaaggttgtgttaactggtaagttgacggaaatgacccgtaaagaggcccaagaatggctggaacaacatggtgctgacgtggttggaagtgtgtcgaaaaaaactaatttggtcattgctggaacggatgctgggagtaagttgacgaaggctcagtcactcggagtcgatgtctggaatgaacagcaatttgtggccgcaatgaaggaggatctccaaaagtgaagtcaaaaaaattttgcctaaccgtggcgctaatggcctgtacgatgattttagcgtcctgtagttttgggagtaaatcaaagtcgtcgagttcaagcaactacacgacaaccgggagtgcggccagtggtacgtaccaaggtgtgattaaaaatgggcggtaccagacgagtaagtcgcggggcgttactgcctcgcaaaaccaaaatacgtttaacctgaaaagctttgaaagtgggttaacggacatttctaaaaaggttttctcaactaagagctatgtctttcaggaaggccaatacctgtctaagagtacggttactaactggttgggccggaaaacaaagagtaacgcatctggcttgaatcccaaaaagggaaagaccaacggaacgcggaacccaacctacattcaaaccattgaagagcaagattatatgactcaagatggggataatttgaagttgcatgggattacgatcggcattggcttgaactcggttgactactacaagaaaacgaccgatggcccaacgtatcagcaaaagattagtgatgcagagttgaaagcgtacggacaacaagcagcccaaaaagttttgaagcgtcttcgtcagaagaaagctttgaagaatgtcccaattgtcattgcactgtacaagcaggcggcgaacgatagtctagttggtgggacgtatatcgagtataacgtcaacaagggtgattcgttatcgagttggaagacgttgaacatcaagaataaggtgttaccaaagtcatccgaatcaacgagttcaaccagcagcgatgacaacgattcatttgacaactttaagacgcaggtacagacgttcttccctaacttgagtggggtcacggcccaagctcagtacaaggacggcacgttatccggaatgcatattacggtgacgacgcagttctacagcgaaaccgaaattacgagctttacgcagtatatttcgacggcggcccaaaagtacttaccaagtgggatcccaattgatatcaagattcaatcatcgacggatatgcaggcctttgtataccgggattcgggacaaaagaagttctcgagtcatgtgtttgatagttattaaaatagagtgtgagcgggcgcgtatagacgccgtcatataagagaagggcccattaatcgtgaacgatgcgattgatgggcccttctcttatatgctaggagtctgcgcccgcgaacacgttttgaatcggcaaataatgactgataccgcaattttaagctagaagcgcattctaccggtaaatttatcagatatttaaattgataactaaaaatttatagggcagatgtgatacaataacatgatgtaagtatgaacaatctgaaaagaggttaatagcacaatggcgagtcaaattgacgaacaacaagtaaagcacgttgcttcgctggcaaaattagaatttaccgacgaacaactcagcaagtttacccctcaattagaaagtatcatcgacttgttcgaaagtatcgacaaggttgataccactggtgtaattccgatgacatcggcaagcgaccagatcaatgcaatgcgcgaagacaaagcagttaacagtcatcaatgcgacgaattactgaagaacgcgcctgatacagaagacggatacatcaaagtaccggcaatcattgatgaaagcggggatggcgagtaatgaatttttacgacaccgatttaacacagttacacgatgacctagttaacaagaagattagcgcaaccgaattaactaaggccacgtttgaaaacattcatgcaactgaagaacaggttcaggcctttttgacgttgaatgaagaagcagccatgaagcaggcccaagaagttgatgccaatggcattaatgctgaccaactggtagccggaattccattgggtgtgaaggataacatcgtcaccaagggattacggacaacagccgcatccaagattttagataactttaacccaatctacgatgctacagtgattgaaaaattgaaggcgcaaaactttatcaacgccggtaaactcaacttggatgagtttgcgatggggggatcaactgaaaattcagcttaccaaaccacgcataatccatgggacctaacccgtgtaccaggtggttcttcgggtggttctgccgctgccgttgccgctggccaagtgcttgctgcactaggaactgatactggcggttcaatccggctcccagcttcatataacggggttgtgggaatgaaaccaacgtatggtcgtgtttcacgttggggaatcattgcctttggttcgagtttggatcaagtaggttggttaactcaaagtgtaaaggataatgccttgttgacgtcattgatcagtggtcatgacgaacacgatctgacatcatcaactcgtgaagtgcctaactttgccagtcaactcaacgatgacaccaacgttaagggtcttcgaattgccgtaccaaaggaataccttggcgaaggggttgatgaaggcgttaaggaaacgatcaaagctgctttgaaacactacgaatcactgggtgcaatcatcgacgaagtttccctgccaaacacccaatatggggtggccgcttactacatcatttcatcatcagaagcttcatcaaacttacaacggtttgatggaattcgttatggtgttcgggcaaccgatgtccaaaatcttgaagatgtctacgtgaagtctcgttctgaaggctttggggatgaagttaaacgtcggatcatgttgggaactttctcgttatcagccggattctacgacgcttacttcaagaaggcgagtcaaattcggaccttgattcgtcaagacttcgaaaaggtcttcgaaaaccacgacttagtgatgggccctgctggcccaaccgttgcttacaagattggcgctaacattaccgatcctaaggcaatgtacatgaacgatgtgttaaccgttccggttaacatggcaggtcttcccggaatgtctattccagctggattctcagataatatgccagtcgggttgcaaatcattgggaagccatttgacgaacaaacgatgtacaatgcagcctatgcatttgaacaaaccacagattttcataaacaaacaccgaacttagggggccaaaactaatgaattttgaaacaaccatcggactagaagttcacgttgaattgaagaccaattccaagattttcagtccttcaccagtccaatttggctcggaccctaacgcaaatacgaacgttattgattggggctatcctggtgttctgccaagtaccaacaagggagttgtcgaagatggtattcgtgctgctttagctttgcatgccgaagttgaaccccaccaacactttgaccggaagaactacttctatcctgataatccaaaggcttaccaaatttcacagtctgaaagcccaatggcacacgatggctggattgaaattgaagtcgacggtcaaaagaaaaagatcggaattgccgagatgcatatcgaagaagatgccgggaagaactcgcatagtcctaacggtttctcatatgtggatttgaaccgtcaaggcacacctttgatcgaaattgtgtcgaagcctgaaattgcatctcctgatgaagcgtatgcctaccttgaggctttgcgtcaacgaatccaatttactggtatttctgacgttaagatggaagaaggatccatgcgtgttgacgtcaacatttcaattcggccaattggctctgacaagttcggtactaagactgaattgaagaacttgaactctttcaactatgttcgtaagggtcttgcattcgaagaaaaacggcaacaacaagttctgatgtcgggcggtaagattggtcaggaaactcgccgttatgacgaagcaagtggaacgaccatcttgatgcgggtgaaggaaggttcagacgattatcgttacttcccagaaccagacctgccagtactaaatatcagtcaggactggattgacgagattggtcaaacaatgccagaaatgcctggtgatcgtcgcaagcgttacatcaacgatcttggcttgaccgactatgatgccatggttttgacacagaccaaggaaatgtcagacttctttgaagccacgattgctgaaggggccgatgccaagatggcgtctaactacctgcaaggtgacgtgaatgccttcttgaatgacaaccaagttgacttacaagaaactgatttgacaccggcacaccttgcgggaatgatcaaattgatttctgatggcacgatttcaactaagattgctaagaaggtcttcaaggcgattactaagggtgaagatccagatgccttcgtgaaggaaaagggcttaatccaactttcagatccagcacagttacaaccaatgatcgatgaagttttggctgctaacgaacaatcagtggaagactttaagaatgggaaagaccgggcaattggcttcttagtgggtcaaatcatgaagaagacacatggtcaagcgaatccgaaggttgttaaccaacttttgattgcttcactgaaagctttgtaagataaacggaggaagaaacaatgcgtaaacgagcacgggtaatttataatccgacttctggccgtgaagctcttaaggacgacatgattgatattttagcggtgtacgaaaaagccggttatgaaaccagtgcctatgcgacgacgccagaacctaattcagcacgcgatgaggcttatcgggttgctaaagagggctttgacttgattattgccgccggcggtgatgggaccattaaccaagtagtcaatgggattgccggattacggcaccgtccaaagatggcgatcattccggccggaacgacgaatgattatgcgcgtgcattgcgaattccacgtgaggatccggttggggcagctaaaattgtgttgaagaaccaatccattcatatggatattggtaaggctaatgatcagtactttattaatattgccgccggtggtttactgacggagctgacctatgatgtgccatcacaaatgaagtcattgtttggctacttagcctacttggttaagggggcggaattaatgccgcaaattaagccaattcaaatggatatcaagtacgatggcggtgaatttcacggcgaggcctcaatgttcttgctggcattgaccaattctgtcgggggctttgaacaaattgttccggatgcctcattagatgacggtaagtttaccatgatcattgttaagtctgccaacatgtttgaaatgatgcggttgatgacgcttgttttgaacggtgggaaacatatcaatgatccgaaggtgatttatcggaagacgtctaaggtggttgccaagccggttgataaccgcatgatgatcaacttggatggcgaatacggtggcgatgcaccgatgacctttaagaacttagctcggcacattgaaatggttgctaatctggatgaaattccagatgacgccgttttaggattaccagcagacgttcaaaaagccgaagagaagtttatcaaggcggttgaaaaactacctgaagatgaaaaaaacggtaaaactgaatagtaaattaagctataaaaaggatggtgataagcgttcagtttatcatcatccttttagctgttaagaaaacatgctagaatatgagttggtattttaagttacattgtcgcaggagtgagtagccgctagtgggctattccaattaaaaaaggagaaagcacttgaaaattaacgcaccagtgcataaaaatgaaaccctctcaggaaccgtcattgatttgacgtaccaaggaatgggcgttgtcaaagtggataattttcccatctttatcaccaacacacttcccggtgaggaaattgaatttaagattacgaaggtcgcacggagctttgcttacgggcgcatgatgactttaatcacgaagagtcctgaccgggtccctgaaagggatcggcagtacactcaaacggggattgcaccgttgcaacacttggcctactccgcacagttgaagttcaagcagcaccaaattgcagaattattgcaaaaggcgcacttggatattgatgtgtcagaaacgatggggatggaaacaccttatcattatcggaataaggcacaaattccggttcgaatggtcaatggtaagttggaaactggattctacaaacgtggtagccatgatttggttcccatcgaagacttttacattcaagatcctaagattgacgaagcaatcttggtcgttcgggacttgttgcgccattatcatatcgaaccctacaatgaagaaactaatcggggaacggttaagaacgtaatggttcgacggggatactacagccatgaaatgatgattgtttttgtgacccgggctaaaaagattccaatgcacgatcaaattgttgaagcaattgttgaaaaattaccagaagtgaagagcattgtgcaaaatattaacccagaaaaaacgaatgttttgatggggaaagaaaacaagacgctctggggcagtgatacgattgaagatcaactcttaggtttgaccttcaccatctcaccattgtccttctaccaagttaacccacagcaaactgaaagattgtatcaagctgcaattgaccaagccggcctgacggggaacgaaacggtaattgatgcctattgcgggatcgggaccatttcactagccgtggctcagcacgcaaagcaggtttacggggtagaagtcgtcgccgatgccatcacggatgcaaagctgaacgcgatgaagaaccacatcgaaaatgtcgagtttgtgactgataaagctgaaaagcaaatgaagaagtggcaagctgacggattgaaaccggatgttatcattgttgatccaccacggaaaggattggcaccggaatttattgaagctgcaagcgaaatgaaaccggataaggtggtttacgtaagctgtaatccagccacgttggttcgtgatattcagttattccaagaacgtggttatcaagtggcccaaccaattcaaccagtagatcaatttccacagacaacccatgttgaaagtattacggtattaaaccgtcaataaattcagattaaaaaaataaaggcggtataaattgatggatgccaaagcaaagatgaaggaactcatcaacaagaaaaagcagagcggtaaccgtcctgcaaatcaagtttcaacggctaaaaacgatcgcaagaacatgcgtaaggggcctaaaatttttaacaagtaatttaaaaacagtcgattcacgagcgttcactcgggtcgactgtttttttaatatctaaggattaaactaatcacggctattaaaacaatgaggaaccagcctcgtgtccaccattttcggacgtgttggggatcaaaggcatctgtgaagaagagtccaatgatactgatgacgagaatccaaatcatgcggtcagccttctttcgtgaaggtgctcggcgagtaggctcccaccgataagcaagacaaggactaatgcaaaagcggtgtgataaccacgcagcgtcgcagtcagtacgtgaataccatgatttaacgcgcttagttggacctgttgttgcacactgatcaaaatcgaggtaccgatcgcggaagcagtaaatcttaacatattattaccggaactgccgtgggcaatcagagagccggttagattctgcatccccagtgtggtaacgggcatgttaacggctgagaagccaaagtttcgaatggcgtacagtaggattagatcgatcattggtgttttggcatcgacaaacagaaatgggagggtccccacgatcatgatgaaaaggcccaaccgaatcatatgtcgtccgccaaagtgattgagtacataaccagtgatggggctcatcacggccgttgttaaggccccgagaattaggaccgcccccgatttgatggcgggcaggccccgaaccgtttgaaggtacaaaggtaagacgaattcgaatcctgcaaaggcaacttggataattgaggtgatggtaacggcgatacgatagttgtggtcgttaaaaatggatagcttgagtactgggttttcaatatgctgctggcgccgaaagaatgcagttgtgaaaatagcaccaacgaggagcccgccaatgacccgccagtcggtccagtgccagttaccggccattgcacaaaagaagaggaggcacccgaagccaattgttgaaagtccaacagagggccaatctaggcgcgaccgacttttagcaactacgtcttgaagaccaaatgagcccaagacgagggcgagaattaaaagaggaagtagtgaaccgaatacgtcattccaccgaaactgatcaatgatccagcccgcataggtggggcccaccgcgggagctaagccaaatacgattcccataagtgcggagacggtcccacgacgctcgggcgggtaaatagaaaagagcatcgttgtgccgataccagctaaaagcgcgcctccaattgcctgaagtagtcgtcccaataaaagttggataaaggtgtgactaaaaaagcagctggcggtgccgagaataaagaaaagcatcgatgtttcatagagccatttggaactataattatcagctaaccaagctgttacgggggtcatgattccaataattaaggaatatccagttgataaccattgcgcagtagcagcggtaatggcgaaatcatgcatcagtgttggctgagcaacagacaagatggtttgattaaaattgctacaaaacatcccaatcataacgatggttaaaaagaggggacgatttaaattcgaagttgtttggcgaatattcatagcgcctcctttggtaaaagttgtttccaagggtgttccttgctatactgcaaggagactaaccagaaagaacgtgaaattcatgcatttaacaagtgaaaatcaattttcggaacggttccgattaatcgctgagctggaagctgccaatgtcgagcgacggttacgtcaggttcacgtgaatcgacaacaagcacggcttttagtgtttttagataacgagccgggatcatcgcaaaaagcaattgcacagtatttaaaccggcaagacgggaccattacgaatatgttgaagacaatggcgaataagggattactacgccggcaaattatggaaaataacgaacgacaaaaacaggtctttttggaacccgccggccaaaaacttgttcaacaaattcgaacggtatttagcgagctagagcaagaaatggcagccagtgttgtaccagaggaacgagaaacgtttaaacgacagttagaccaagtcattacagcccttaatcagcgatgatatcaatgatttgggcttttttgatgataaccatcccgtatgcaaatccctgacattcacccgtaatggtggcatggccgtgatcgggaatatctgatagatcggcatcgtgaaagacgcacgttacccgggtatggccgttgtgggtatctcccaattcaatgcacggcagaccgtacatatcgggaccgacatagcggatgggaccatcgatagtcaggatgtccatgttgcgattctgaccgtcttgataaagttgaaagagttcatcactcgtgagttgcatgttgtttgcctccaattttttaaaatcggatcatagtttagcataatttaacttgtagttcaaactatttaaagaacaagttaatggtgatatttgacgaatgtatgctaaaataagtaaaaatagaaatagcaggtgacccaaatggcagataagaaaacgttacaggattatgaaacggatattccagcattaattgaattattcgcggctgagccagacttgcaagcaatgctccaatcgttgactcccggataccaacgcgagtgggcccggtttatatacggtgcgaaggcggaagcaaccaagcaacgccatcttgaacaaatgaaaacagttttaaaggcggggtataagtccaagcgggcttatgatcaacggcctaaagactaagcgtctgcgatcagtggttaggttagccacggtggcgactcattaaatcagaaaaaggacgttcaaatgatactttttctgcagcaatttcgttataatagtttgcataacaatacaatgatttcaggtggtagtgatggtagataaattcgaacaactgattgatgaattaggccttaacgaacagctattccaaggcttctttggtttggaggttgaggagcaccgaattacaacggacgggcgactcagtcgttatccctatcctggtgcgttcggatctcgtcggtaccatccctaccttcagtctgattttacagatagtatgttggaattaatcacagaaccgacgcgtggtggtaaagaagcggtcaagaatttaaagatgttgcaacaaattgtgcaaagttatctgcaccaagacgagcggatttggccgctgagcatgccccctaaactggttgctgatgatctcaattttgcgaaagaagattttacccgaccgtggttccaagggtaccgagactacctagaaggaaagtatggtattgaacacgaaattgttgctggtgctcatatcaactatagtgtcgatgaaaaagtgctaaagacgctgtatgaaaatggtttggcggacggttacgagagcttagcggcctttaaaaacgcgctctactttaagctagcgcaaaactttgtgttaaatcgctggttcttcacatatttgtttggtgcctccccaatttccgaaaataattatcaaaaattaccacgcgacctagactacccggtgagaagcctccggagtagcagtctgggatatagtaattacaatgatgaagtggtgacgtatgagtcattggctgatcaggtaagtcagcttaagcaatttgtcgcagatggtaaattttattccattcacgaattttatggaccagttcggattaaaggaacttcggacaatcttgatgagttgcttaaacagggcattgactaccttgaatttcggtcatttgacctagatccactgtcgcgggcaggtcttagcgatgatacgctggatttactagaaatctttttggcctatagtatggcggctgacttaccaacggacatgacaacggcgttacgagacgctgatcagcgtaatgaagagattgcccttggtgatcccaaagaccgtcctgagtgggtccgcgatttgggcggtaaactgttgaatcagctggcaatttttgcccaacgcgtgaatgcaccgcaaaaatataccacggcgattgcgattgcggctaaacgagttcgcaacgtggacttgacactcggtgcgcagttagccgttcgaattgaagacgattcgcttctgtcgtacggattgaaagtggctaatgatcgttatcttcgggttcgtagtgcccaacagccggtgcaggtgctcgccgatcgttattcggagtccattcagaagttagttcgtgaggcggttgtgatcgggattcggtgtcagctactgaattataaggttgaactgacgtatgaggaccatcaagaaacattcgacgcgcaggccaccttggaatttcctaagggtgtgcacgagtttgtattacagcattttccagaagcaattaaattagtgaatgaataaaaatagggcgcaattccaattttggagttgcgctcattttttaacgatggtaagtccgaattgttgggggctcataactggccataaactgttgaatttcatcgatagaatcagagaaaagcagtttgctgcggccttgttctgagagaaagccttcgctggtcatttgatcatacatcgcctgcaggggttgataataatgattgacgttataaaaggcacatggttcactgttgtccccaatgagggcccatgaaaaggcttcagcaatttcttcgagggtgcctggaccaccgggaaaggcgatgaagccttccgaaaggttcatcatggcggatttgcgggcggccatgttatcaactacttggaggtgagtaactgtatcgagtactgttcctcgattttcaagttccttggtaatcacgccccaaacgacgccgttatgatcaagaaccgatttggcgatgacgcccatgaggccatacttaccgccgccgtacactaaaccaatttcatgttcggccaaccattggcctagggctgctcctgcttgctggtaaaccggattagatccgagagaagcgccacaatagactgcaatttttttcacattcatcaacctgcttactttgaattttaataccactattgtacagcaaattacgcggagatgaaaacggcgtaaaaaagcatccccaccattaaatatgacggggatgctgaattaattgactagttattaccaaatttacgttggaagttcgcaatgtttgcgtattctgtttgaagctgacggctcaaacgaatgtagattggaacgagttcgcggtaaacagggaagttgtctgggtttggttgataagtgttggtcttaccaatgaacttttcaatttctgatagatcatcgatggttccaatactcttcatcgccagcacaacagcggctaaacagccactttcgaaggcgtcagggatagtgacaggactttcaaaaatgtcggctaacatttgacgccagagttctgaacgggcgaaaccaccggttgccatgatttcttttggcttaccaacgacttcttcaagggctagcatcacggtgtagagattgtaaacaatcccttccagtgcggcacgaaccatgtgtgcacgggtgtgattccgagtcaaaccgaagaatgaaccacgagcgttagcgtcccagattggtgcccgttcgccgccaaggaatgggtggaagagcaagccatctgaaccagctggaatttcttttgcgatttgagttaacaaatcgtatgaatccatgttcatcatatcggcagtcactttttcaggggcgaagagttgatcacgaacccaacggaagacgatgccaccgttgttaacaggtccgccgaccacccatttgtcctttgtcagggcgtagcagaaaactcggccctttggatcaatggttggcttatcagtaaccacacgaacggcaccagaggtcccgattgtaacagcaaccactcccggcttgatggcgttaacgcctaagttagagagtgttccgtctgaagcacccataatgaatggggtatcagttggaatgccgatgactttggcgtactcgtcgtgcataccagttacttgtgccagtggatcgactaattctggtaattgttcccgcttaacgccggttacttcaagggcttgttcgtcccaatctaagttaaagatgttgaaaagaccagttgcggaagcaatcgaatattcttctttcaaaacgccgaagagacgccagaagatatattctttaataccaacccagtaagcagcatcgtcatagatgtcacgatgttcgttcttcaaccacaatagtttgtagagtggtgacattgggtgtgttggggttcccgtctttttatagagttcgaaaccgattccatttttcttatattcatctgcatatttttcggcgcggttatcggcccatgtgatgacccgtgtaattggttggtggtttttatccaaaccaatcagactgtgcattgcggcagagaacgaaacaccgcgaagtttaccggtttgcaaatctgctttgcggaccacttcagttaatgcatcaacaacagcatcgaagatttcattgggatcttcttccgccatgtccggtttgtcttggtagagtgggtatagcttattagcgtagcccagtacgttgcagttatcatcgtataaaacagccttggtactggtggtacctaagtcgaccccgatcatgtaatccattaaaatatcccttcctttttgagtgtgcttaaggattaaaattaagttgaaagaacctatttatagtagtactaaattaaagtatcagactacattatatgaaaaacgctttcacaaatcaagcgatttattgtaaaatatttacatataaaaaatgacagtcaaattcaggagatgaaactttgaaaaataacggcgttgttagaattaaggcgtattatcctagctttagtcatggcgagcaaaagattgcggattacatgttgaccaatttagataccattcagagaaatacaatttcagaattagccaataattgtcacacgtcgacagcttcaatttctcgatttgtgaaacgcattggctattctaactatcgagactttttgtttaacctagccacgaccgataaggcgccatccagtttaacggagatgatcgaacaacgggatacagctgctagaattactgaaaaaacatttaacggggcaattaatgcacttcaatcgaccaaagcaatgctcaatgaacggcaactcaatcaagcggtagccctgatcagtaaggcccagcgggttactttctttggcctcggtgggtcatcaattgtggccttaaatgggtatcacaagttcttacggaccagtcttgattgtcagtatcatcccgatttcgatattcagatgatgcaagccgttaaaatgaccaaaaaagaatgtgccattattatttcgcattctggtgagaacaatcagacggttgcgattgcacgcaggttgcaccgacaacgggtgccgatgattgttatttcgagttccccagatagttcgctcgcacagttagctgaaatcaggttgatttcagtcgcagaaaatattaacgagcgtgcggaaaacctatcgtccttggtcgcacaactaacaattatggatagtttatttttggcagtggccaccgaacaggcggatgagacggcgaaggtgatcgatgaggtcaaccaggcaattaatcaaacttataagtaatcgttacaatctgctaccaacaatgttacttgagacgaatatttggtaaaatggaactatgaattttggtaggagatgtagggatgaatgggtgtaacaaccgaaccaaaaaatgcggcaccagttagtcgccgtcagcgatttgatcatcagcgtcaacacgggcgtcaccgatgggtggttactgtggtgattttgcttttggggatgctggcagttggcggtgtttggtggcatagtcatcagcagtcggtgcttaaggcatatccaattcggggcgtcagtattgaccaggatgatggctacattgattttcatcagctgcagagtgcgggggtcaagtttgtctacctcaaggcaacctcgggagcgagctacatcgatgacaattttagttctaactatgagcgtgtctcaggaacgacgctgcaggttggaatttatgaagaattcagcttttctagtagcgcggaacaacaatatcgctacatggtgagccaaatcgggcaacagtcaggaaacttaccgattgcgattcacattaccgactacggcaagtatgctagtaatccaccaaactacgacaagcagggtcgaaagttggctcggttagttgagctgctatcggaacgctatggacagggatgcattatctgggcgggaccacagattcaaaagaaactcgtgatgccgcacacaccgggcacgaaacggtggaccattactgatcagctcaaacgccaaagttcacaagtgaagtttatgcaatacacggggaacgaaaaattagaggtgggcggtaagaagaccgacctagtcatttccgtgttcaatggtagtcgcaaagaatggaaagaagaagtgaactagtcgcgtgggtgttaacgcgcaaaatgaagctacaaaaaaagcccgaccaatatggcgggcgaataatagctattttttgggacttgttagggtgtaagtttgatcatccgcttcatcaacgagggtaatgggccgttgctcgttagcttgaattgtgatgtggtaaccaaatttatcaatgtaaattagatggtgttcgtcaattagttcaacgttggcggaaatctcatgcttatcaattgatagtttaagttcgggtgtgatttctagatagtgtgttcgattacgttcgatatcgtaatattcccacgttccggcgtagaagattggcagcgacgtagcatgctttttcttgcttcggcctatcccgaacgtactggtcagtccagccgctaatcctgcaccgaatagtaacatgccgcgtttcttcatcctatcatactcctcttctttgttagtttgtggcaccgcagttagcgatctttcgaacattcaagcacattatacaataattaatgatcaatatgttttacatttacgtaaaatatagtaattagttgataaagtacattatgattagatgacagaattatttcaggaggtatggcacatgttaaaattaggaatcattggtacccactggattactgatcagttgttggatgcagccgcgcaaaatgggcactggcaattgacgagtgtttactctcgtgatcggcagcgggcacaagaatacggtcagccacatggcgcaaccgcgttttatgataatttagacgacttttttatgaatggtgatttcgatgtcgtgtacgttgcttcacccaatgcactccattatcaacaggttcgacaggccattgaaaacgataagcatgtcattgtcgagaagcctgcttttaccaatcccgatgaatttagtcagattgaggcgctacttcaggcccatccggcagtaagactggtcgaagcggcccggcatattcacacgccgttgtttaaacaggtgcaagcacagctgggacagatggccaccattcagggcgcgactttgacgttcatgaagtattcgtcgcgttacgatcaggtgctggctggcgaacagtccaacgtcttttcgttggactttgccggtggtgcgttacaagatctcggtgtatatccagtctatgcggcggccgcactgtttggtgaacccaatagtgttgtctattttccaacaatgattgaaacaggggccgacggaaaaggggttgccattctcacatatgatgatttcgaggtgacattgaactttggtaagattgccaattcgcacctgccatcagaggtatatgggttaaaggatacccttgtcatggataatattgcggatatgacaacggctacgtactatgacgacgaacaaactgcccatgccttaacggccgaggtggctgaaaattcaatgcggcctgaaattgatgcctttaccgctttgttcgaagcaccgaacgatttaaatcaattaaaaaactatgaaacctggtttaagctgagtcgactggtcaattcattattgtacacactacgtcaatcagccggaatcaaattcccgaatgaatagagaggataacaacgtgatcgaagtatttcaagaacattttaaggaactggggttcaagcaaccgacggtgatccaaaccgcggtttttgacgccctatcacaggaccgttctgttttggggattgcaccaacgggatcggggaagacaattgccttcacattaccgattttacccaaggtcatgcctaagcagggggttcaaattttagtgctatcaccctcacaggagctcggcgtgcaaacggctaacgtcatgcgcgaatgggctcggttactggatatcaaggtcttggcactcactgggggggcgaacatgcaccgccaagtcgataagttaaaggcgcatcctgaagtggtggttggtacgccgggacgagtcttacacctgattgacacggggcaccttaagctgggaaaattacagacaatgattgtcgatgaagccgatgatatgctccaggatgaaacgctggcagttattgaagatattgaacggactacgccaatgacggcgcagttgggcttcttctcagcaacccggacgaaaacattggacgaactgagctatatgtttggccgcgatattgtagaatacgatgtgcggcatgaagaccattcccaaggagtcgtgcggcatgctaatctacaggtcagtcggacccatcaaccagatatgctgcggaagctcagtcatatcaaagattttcgggcgctggtatttttcaatcaaattaagacgttaaactacgtagcggctcggttacgccatgaacatgtttcagttgcggtactcggtggtaatcagcgccaaacagagcgggaaaaggcccttcgaatgttccgaaaacgccaattgaagctcctgctaacgacggatgtcgtagcccggggattagatattgaaaaattaccaacggtggtgaactacgacttaccgacgaatccgttgacgtatgtgcaccgagtagggcggaccggacggcaaggggaacccgggatggtgattaatttcgggaatgatcatgatctgcgagacctgaaaaagttgctagcggacacggattatacgctaaagccgatttacttctatcacaatcagctcatagatgaacgaccgcaagaaggcgaaaaggctgaatcagttcaagctaaggctcaccgtaagatgcgcaaggatcaacacaccaatgataaggtaagtgtcgataagcacgtcaacaagatgtttgatgaggccgatcagtataataataagtccaagcggcacaataaaaagaagaaacgtagtcaaaaggataagggaatgcggcataagcggcaaatgcaggcccaaaagaaggaagccgaacattctcacgacgagtaattttaatggataacctttacagaactcatgattaatgagaaaatattggttgtcttggtccaatagtataactggatagtactcccgcctcctaagcggatgatcccggttcgagcccgggttggaccagtattttgagcattttcaacgtgatgttgggaatgctcttttcgattgcaagaaagtggcaatgatgactttcgcctgtgcgtggggatggtttgatacaggatttttgtcgataaggattaaaaggattaaatggtcttaatttaaaaattgactaaaacccggtaaagtgtgtgcaaactactttacattcttcgaagcgatattataattggcctatggttaaataataatttactataaagaggtgctaatggaatgtatattattaaagtcggccataagtggatcggaaagcctaataaacagggaaactactgcctagtggacagtagtgattcagcatatgactttcaaacgttcgaaaaagcagaagcctatgcggacctcgtcaatgggtttgccacccctaaaagctaatgacacaatttaaaaataaagacgatctttgcaattacccggtagtgggaaaacaaagatcgtctttattttgtttggattggttagcgcaatgatttgcgatatccggccgcttgagcctgtgcttccgtgttgaagtagacagcattagatgcattcattcggtaacctgcctgtccaggaacgtggtaaatatgactattagcgttaccgacaatctttccttgaacgtcacccgtattcatatcacccgtgttggtggtattggaggcagtcgctgtggtcgtgcttgaagaagtggtggtcgcggattgacgactttgtggctgtgttgagctggcggcttgggcgcttgctgttaccttgctagtaccatcagcgtagtgaattttgacgccatcctcgatgttgaaaatatagacattaaacgaaatggcattactaccaattgactgcgcctgcatgtgaaccccgcgtgctacgagttcgtcaccacgaaaaatgggggtgacttggtagcgaacgtaaccgttgggattgttcttgaggtagtaggctaaatcatcttcatagcgtaacatctctggtgaatttaaagatcgggtaccggtgatgagattcttgggattattgttttgcccggtgagttgaaacccaatcaggtgggatcggttatagaggtagccacttttaatgcgcttgttgtgccaaccggtaggatcgacggttaatgcttcccgtttttcggttggcatcagacttttactgagcatggcatttgctacggtcggtcgattttgacggtctagattaccatagctttgccaagcacccttagtcgttttcagttccttcttggtgaaggtcgggttaccgttattaacatcgattgtttggtcgccctgatactttaacttggcaagcttttggttgttttttgtcgtactggttttcttgtggtgcttagcggcctgaaccgttgtttgtgaactagatgttgttgggacgttgagcccgccagcactgaccatcacagtggccaacactgtgatgatcggagcgaggatcgtccgtctaataattttaggtaacatcaattaatcctcccatgataaatttaatgtaaattcatcataccatcgtatgataagtaattacatcgggaaattatcaaaaaagaagataaaaaaatttcccgtaccgtagagggcgggaaatgaaaattgaatttaattttagttagaccgtttctcttttgaaagagtcaatgtattcggtaatcttcttcaactcttcctctgataaatcactaggaaggtgagatgctaagatccgagctgttcgatcgatgtgttctggatcgagatgttcatctaataattcagaaatcgtcacatcgaagtattgtgccagctggtacattgcggaaatccgtggctttttcaaaccggtttcccagttgctaatttcttgcttggagaagtttaaggcttctgccagttccttttgagtcaagttacgttcgtttctgagagcagcaatcttcatggaaagcactggtttattttcgcgttgtgtcactgtttcaacctctttcttagctttaaataacataccctaatcatctaatgttgcgccctaaaaagcaagaaatatgccaaatactaatctacttctaattattagacacataatttaattgtttgatcatttttcaagccgttttcacgataagtctatcaaaccggcaattaaaacgccttcttactagcgttagctaagctgataagtcgtatgaattaattaatagtataaaaaaggtgtctccgtcatggaaacaccgttggttatttgacttttttgaaaatgtaccatttagaaaatgcgtagttcacgatgatcacgacgacgttatcgatgaccttcaccaagatcgagttccaattgagcatggaaataccgacgtacatgataatgatatcgatgacgagggtcaggattcggaaaaagtagaatttaacgaactcaacgataaacgctttgaaggtggtatagtgtgatgaaaaaacccaaactttattcgtgaggtaggcaaccagcactgagaggaaccaagcaataacgtttgctacctgatagttccagttccagtaatccaagatggcaaatacaccaatattgatgattgtggtaatgccaccaaagaagatgtaagcgatcatagattgatattttctaaacaggacccaaactttattaatcatttactttttcgacaagactctttgcgaatgcattgagcgtgttgatatcctcgttttctggttctagattaattttgacagcttcggcgcccttggtggccttggctttttcgaaagcggcggcaaacttgtcaacagagacacagtagtcgtccaagtagaaggtatccccagaaccggccacgccgtaaatcttacccgagaggtctagttcctgtaaatcttcatagaagtccatgccttcttctggtagggcgccttcatcataggtgtacggacaaacgacacagatatcagcgtcttcaaattcttcagcgtcggcttgggtgatctcggtttcgtcaacatcaactcccaaatcttccaatgcttcggtgataacatcggcaacatcttcattgttaccagtaatggttgcgtatacgacaagtgcactagccatatggaatttccttctttcattatgtaatacttcgatgtcccctagtatagcagatatcggcttttgaaaaaagaaaagccccagcgaaatctttaaactcaggttagtaaaagtgtatactattatagaataagggacggatgaacccgaccaaaatcgtcgttaccaaagtaacggatatgaaactgtcttaaaaaaggagtccattatgattagtttaaaatcaccacgtgaaattgaagcaatgcgccaatcaggcgcactactagccgggatgcatcttggtttgcgcgacatcattaagccgggcatctctagctgggagatcgaggaattcggacgcgactacattgaaagtcatggcgcgattgcggcccaaatcgggtttgaaggctatgaatatgccacttgtgtcagtatcaatgatgaaatttgtcacggttttccccgcaaacacgtttttctgcaggatggtgacttggtgaaggtcgatacggtcgttaatttggacggggccttcagcgattcatgttggagttatgccgttgggacccccagtgatgaggtccaacgcttaatggatgtgacgcataaggcactttacctgggcattgaccagtgtgtgattggtaaccggattggtgatattggagcggctattcaacactacaccgaagacgaaaatggctatggtgatgttcgtgaatttattggtcatggtattggccccaccatgcatgaggatccagcggtgccccactatggcgaagcgggtcgcgggttacgcctgaaagaggggatgacgattactgtcgaacctatgattaatacagggacgtggaaggctgatacgagtgatccaagcggttggttagccaagactgccgatggcggattgagctgtcagtacgaacatacgctggcgattacgaaagagggacctaagattttaacctcccaggatccggaatttgatgccaagtatttataagtagacgaggagtttattatgcgacaatcagcctttaacaaggtcagcctgttttttaagaccttttttagacattatgggatggctcaggtttcaacctcggccatcgtgcttgcttattattcgctactgtctattttcccggcagtcatcgtggtggggaatattttgccgctggtcggattgaaagcgggcaccgtactgaattacctgtcaacggccatgccaccgtctatttttaactttatccggccactgattttagatttcttgaaatcggggagtggtggcttgctgtcaatcggggcaattgtgacgttgtggtccacgagtcaagcagtcgctgcttttcagcggagcgtcaatcatgcgtatggcgtggcggaggatcaaaacgcaattgttaaccgggtactgtcgtttatgtggatggtggttgtgattttgatcatggccgtactcattatcttctttagtattggcgagttaattttacgggaacttcggcactacgttcatatcgacatgagcctgattaacttcgttgcatcgattaagtggccagtaacattctttggactatttattttattatgtctgctgtattattttgtgcccaatgcgaaggtccggttacgctatgtaatgtggggcgcgctgctcgccaccattttgtggatgctcctgtcacaggttttttcgatctatacgcatttgtttgccagaacggttacatcgtacaagacgattggggtctttattgtgttgatgctttggctagatttatccggtattatcgtcatgatcggggccacgttgaatgccacactccaaaacttattcggtgtgattcgagaaaaaaagcatccgtttgagaatatgattgaacattttaagaaataatgtgaggagatctaactaggtaccctcacgtaagataaaattcctgattgatcgtgaacgtgacggttgatgaggaattttaagctgtgccggcgaaaatggatttgtaagccaatgaatgatggcacaaaaagaccgaaatccattttagtgaatgaatttcggtctaataatgttatgctgttgcttcttccgctttgaagacgggggtttcaatggtttcgacgtacttggcagagacgggttccacgtaaagcttttcgccgttactttcaaacagatctagtttggcaagcatgtccatcgcagccttaactgaggcttcgtccatgttatcgttcgcgtaatttaactttaacgtgtgtgactttcctaaactacccttaaatgctaaactcaatgctttcatatatgaacttcatttctatttgaaccgattatctgggattatttaacgtccaattggtaggccgttgtgacaatggcactatcaaaagtatctttagagattgtttgtagtaattcaccaagttgttgaatgttgtcttccttagcgtcttcggttaggtgactgaaagtccgtgcgatgcccttttcgtgcccttcgcctaccatcatcaactgaacctttgcgtttgagaatgttttaatcattgtgaaaactcctttgaatttggtttagtaagtggcggccgctgcttacatgaataagaacgaaatggaacggtaaaagttaaccatcattgaaaaaaagtttgattgataggtaaagacacggtgatggtttatcttagaggatcgctaggctataatgttaactaggattttaacggagggcatcaatgacgaaaaaaattacgaagattgaagctcagaagcggcagggacgctataacatttatttggatggcaagtttgccttcggggtggctgaaaatgtgctgattcgcttccaactcgcgcgagggctggaaattgatgagcaaaccgagcagcagttaattgatgcagacgatgtcgcgaaggcctatagtcgggcgttagattatttgtcgcatcaactacgggcagaaagcgaagttattcagaagttaaagtatttggaaattccagcggataagattccgacggtgatggggatgctgcgcgagcaacacctcctagatgatcaaaactatgcggatagtttcgtgcggacgatgatgctgacgtcggataaggggccaactgtgattcggcagaagctccgtgccaaaaagattggcgaaaacctgattgatgcggcactagagaagtacgatcaagatcgaatggtggaaaatgcgactaagctggcggaaaaacagttgaagcactaccataaggtaccgttgaagatgcgcctacaaaaggtacgccaatcgttgatgacgaagggattcaaaagtgacttaattaagcaagtgttagatgagttggaaattcaggatgatccggacgaagaatgggagcagttgaacctccaagctagcaaaatttggcaacgaaatcgccggttcgattatcgagaacaggtaatgaaaaccaagcgtagtttggttggcaagggtttttcatttgatgagattcagcggtggatggatgagaatagcgacgataatcgaagtaattattaaggcattattaattaatgagagatatctgtaaattaacttttttagcaagctttttactagtatgatacaatttgtacgatgtaaattcgaaaggcattgtaaatatgacgaaattatcaattattgttccctgttataatgagcaggagacagttccacttttttatcaaaaggtggaagaagtgttatctaagcaagatgagttagagccagaatactggtttatcgatgatgggtccaaggataataccattgaagaaattcacaaactgaatcaagctgacccaaataatgtccacttcatttcattttctcgtaattttggtaaggaggctgcattgtatgcgggtctctctgctgcgcatggagattatgtcgttgtcatggatgttgacctgcaagatcctccagaacttttaacagaaatgtatgcttatttaaaaagtggacagttcgattgtgttggtactaggagagttgaccgtgagggggagccgccaattagatctttttttgcaaatacgttttaccatctgattaaccgaatttcaagcactgatattgtcaatggagcgcgtgattatcggatgatgacgcgtcaaatgattaatgcaattctttcaatgactgagtataaccgattttcaaagggtatttttagttgggttggctttcggactaaatatattgactatcaaaatgtagaacgggttgctgggcagacaagttggtcattttggaagttatttaaatattcaattgatggcattactgacttctcagactttccattgtcgattgcttcatggacaggtgtattatcattctttgcagcgatcgttggtttgatatttattgttgctcgcgctgtaattgttccggggagtagtgtttctggatgggcatcaatggtatgtattatgttatttattggtggtttacaattgttgtgtttaggtattgtcggtaagtatgttggaaaaatttacctgcaaagtaagaaccgaccgatctatattgtgcgagaaaagaaatagctagaggaaaacaactatgcagagtaaaacatatcttttttttaaacggatttttgatattatattgtcagtgctggcattaataatattgagccctatatttttgacagtttttcttgtggataaatttggagataataaaggacctgtattttttaagcagttacggatcggaaagaatcatcaaaagttttatatctataaatttcgatcaatgattgtggatgctgatcaaattctacactctgatccggagctttataagaagtatgttgataataattacaagctggaaccggatgaagatccacgtgtaactaagcttggtgcgtggctaaggaaaacatcgattgatgaaattccacaatttgtaaatgtattaaagggtgaaatgtcgttaattggacctcgtcctgttgtagaggaagagttacacgagtatggtaataatattgataaatttttatcggttaaacctggtgcgatggggtactggcaggcaagcggaagaagtaatatcggctatcctgaacgatgtgaaatcgagatgtattatgttgatcatgcttcgttttggtttgatttgcaaatcatgtttaaaaatttattgagtattgtcaaatctgacggtgcatattaggtagttgaggagttctcatggaaaaatccctattagacaaaaaagttctgggtagtttgagaattgatggaactactttgtatttttttgcgtttttaattaattttatccctgcgtttttaatgacatccatgtattcaacaatgatgccaattaaaattttttattattgttcatatttatctgcgttgattatactttttaaaatttttttgtttgatcatttcagtaagtcaagcgcatggttctacatgatttcgattccattattatttttaacttggaagatttcagattcagactatgcttttgttaccggcatgtttatcttgggtgcaaggaatattgaatttaaaaaaattgttagatggtatctgactgctgggacgagcttattgatattagtgatgatttcagctggacttggaatcattcaaaatcttgcgtatgttagagatggtgctttgagacaatcctttggaattatttatccaacggattttgcagcacatgtcttcttcctactattggcgtacgtttacttacggtttaaaaaatttacgatatacgactacttactaatcgcaatcattgcagcggctgtttatcgcttttgtgatgcacgattagatgtagtttgcatactactgatcttacctattgttttaattgcaagaatgataacagtgaaaaatagtttgaacggtaagaagattgttgcactgtattggatagcgataccgctattaacagtaattacaatatttgttacgatgttttatgatgctagtaatacgatctttctcaagtttaatgaaatattttccggtcggcttgcctatagtcatgttggctatgaaaaatatgggtttagttggctaggtagccacgttgttgaacatggctggggcggagaagcggggatgaaggcgttctcagggcatagtgccaattttacgtattttatgcttgattcttcgtttgttaggatctttttgatttatggtacaatattcgcgatcattctattaggtgcgttaattactcggatgatctatcaaattcacattggagattatttagtcccatcaattattttattaatgttggtaagttcctttgtggatcatcacattctggatctagcctacaatccatttattttagtgattttagctgatctaccacaacgaatacaaacggaggattttaagaatgaacaagtcgttgacagtgaatgatattattaagattatttggaaaaatatcatttgggttattttatttggtgtaattggtgcaggagcaatgggtggctttgccaaagtaagacagcacaccacatattcagcatctcgaagtattatgattgcgcatgatacgtcaagtgcactagttaaaagtaaggattcgcaggtgaaagcagatctaaatatggtacaaacgtatgcagatctggctaaagaccctattgtactgaataaggttgccaaagaattaaaaggagacctgtctaaaaaagtaacggctgatgagctaagtagtatggtaacagttgaaacaaaaccggattcacttgttgtatcaatcaaggccagttcatcgaatgcaaaagatgctgttaaaattgccaataagacggcgaccgtatttgctaaaaaactgccacaactggcaactgatcctggagatgtaacaacactggcaaaagcaaataaagagagcctgacaagtacaacgtcaccttcagctaagaaatatgctgtacttggattagcagccggtttagtaattggaattgcggtagctttttcaatcactagttggaaaaaaattctttaatttacgttaagattgcctctttgagacggtctttttttttaacactttagttttatcggtgtgtttgataaaattagactgtttgtatttagttaaaaataggcaaggagaaatcatgcggtcagaaattgcgattttaatgtcgacttataatggtgaaaaatatttaaaagagcaaatcgaatcaatcataaaacagagtaatcaggattggcatctctacattcgagatgataattcgaaagacagctccagagcgattattagagagtatgctgaaaaaaatgaaaagatcacatttattaatgctgacagcaccgataatgttggcgtgtgtcgttcttttattgcattggtgcagtatgctgaggcacaatattatatgttttgtgatcaggatgacgtttggaaaacagacaaagttgatcagactttgaatagaatgcaacaagcaaagtcattactaagaccggttttggtatatactgacctggagattgtggatgaaaatttaactccattgggacgaatgtatggtgatcgagtatggttttcattcattcagtttttatttacgaattgtgcgactggttgtacagtaatgtttaatcaggcacttaaacaaaaaataaattttaataccctaaattatgatgatatctatatgcatgattggtggtttgcaatggtagcggctcaatttggtgaagttctttacgtcaacgaaccgacaattaattatcgacagcatgctggtaatgtggttggaagcggagaggaaaatacttttcgacgactggttgcacggtttgttttacatcaatcagatgtcatccatgctcagcaaattgttcgtgcagcacacgaattcaatcgtttatacggtgatgaagtaagtggtatggataagcaatatttaagtgcgtatggtgacttatatacaaaaagttcatttttacataacttaaacttagtcgtaaaatatccagctcagagaatcaatcccaaagggaagttattttatagttatttgtttgtgatgtttgccaaaaattttaagtttagtgataggtgattaacttgaacacaaagatattagttgcagctcataaaaattatcagatgccagaaaatcgcgagttatacatgccagtgtttgttggggcagcattacacacaaacatgcaattaccatttcaaagcgatgctcagggtgataatatttctattaaaaattcaaattataatgaactgacagcgatttattgggcatggaaaaatttggatgcagatgcgattggacttgtacattatcgacgttatctgagccttaaaaagcagaaatcactggatactattttaaatcaagagcaagttgatcatttatttgaaaattatgatgtgatcttgcccaagaaacgaaattattacattgagtccaataagtcccactacctgcatattcatgaagctcggcctttagaggtattacaggacgtaattgctcaagattaccctgaatatagtgattcattagagcatgttttagagcaaacttcagcgcatatgtttaacatgtttattatgaaacaaccaatgtttgacgaatattgtgagtggatgtttgatattttaggtaaagtcgagaaacaaatcgatatttcaacgtattcgtcatacgaaaaaagagtatatggttttttgagtgaactcatgctggatacttggttaaatgtgaagaagtattcatcagttgaggttaattttgtgtttatggagaaacaaaattggttcaagaaaggtggaaacttcctgctacgaaagttgaggggtcacaattaaatgactgacgcgcaaaaaaaaggtgttattctggttccatttatgtctggtaagggtggaacggaacgtgttgtccagaatttgtttgtcgcgatgcaagctgcaagtccgcggacactccaaatgtcggttctttcgattggtggaagtgatgattatgaatgggcaaaaaatctgccgattcagattgtgaaagtggggaaaagtcgaacagccagaacattagcttatatgacggtattgccgtttatcattttttcgtatgttagaaaacatgagttagactttgttgtgtcgactaacccaattatgtggtatttgactaaagttagttgtcgactcttaagaaaaagaaccaaagtgattgcgtggtatcattattcgttggaacaaaagccagttaagaaattatttctgaaaaatgctgatcattatttggcaatcagttctggaattgttcaacagctgataaaaaatggtatatcagaaaaaaacatttcattaatttacaatccagttcaaactagcgaaagaatagtcgaacgtccagatagtgtgattacgtttgtatatattggccggattatgttggatgggcaaaaaaatttacgcgaattgttgaaagctcttgaacatgtcagtggaaattggaagttagagttgtatggcgatcttcaacaagctgaacccgttaaaaaatttgctcagtctcttaagattagtaatcgtttggtttggcatggcttcgtagcggatccttggtctgaaattactgaagcaacttcgctattactaacatcgaagtatgaaggactaccgatggtactgtgtgaagggattatgcatggattgtacctagtaagtgctgatattgatactggaccagcagatattatagagccagaaaatggcgtgctttatgaatcgggtaatgttgacgaactgggtcgcatacttcaacgaattgttgatggacaggttctaccagatagtacggtcattaagcgaactgcgaaaaaatttgaaattgaaacgtaccgtcaaaatttttatgatgcggtcgagcggtcttttaaaaagtaaggagtaagagtatgaaaaaatatgattatttaattgttggtgctggattatttggcgcaacgtttgcatatgaggctgcaaaacgtggtaagcgggtcaaagtgatcgaaaaacgcaaccatgttgcaggtaacatttatacaaaagaaatagatggtattcaggtccatcagtatggtgctcatatttttcatacgagtgataaagatatttgggattatgttaaccaatttgctgaatttaatcgttataccaatagtcccgttgcaaattttaacggtgaaatctacaacatgccgtttaatatgaacacatttaataagatgtggggtgttgtgacacctgcacaagctcaggcaaaaattgatgaacaacgccaagaaatgtcagggaaagaacctactaacctggaagaacaggcgatttcattaattggtcgagatatatatgaaaaacttgtgaaaggatatactgaaaagcaatgggggcagaaagctaccgatttacccgcttttattattcggcggttgcctgttcgtttgacatatgataacaactattttaatgatacttatcaaggcattccaattggtggttacacacaaattgttgaaaaaatgttagctagtgatttgattgatgttgagacaggcattgatttttttgctgataaaaatcaatatttaaaaaattatccaaaggttatttttaccggcatgattgatcaattttttgattatcaacttggagaactagaatatagaagcttacgttttgaaacagaagaaattaatgtggataattatcaaggaaatgccgtggtcaattatacggatgcagaaacaccatatacacgtgtgattgaacataagcactttgaatttggtaaaggtgacaaaaataagactattgtgactaaagagtatcctcaaacatggcatcgtggcgatgaaccatattatcctgtcaataatagtgcaaacaacggactttataagcgctatcagaaattatcacaaacggtaccaaatgttatgtttggtggacgtttgggtcagtatcgatactatgatatgcatcaagttattcatgcggcgttagttgctgtctcacaggagtttagtaaagattaattatgaaagtcattaagaactatctttataacatgggttatcagattttagtgctacttgcaccactaattacagttccgtatgttgcacgtgtgttgggtgctcatggtgcagggattaattcatacacgaattcatgggtcacattctttctgttgcttgggcaaatgggtgtggcactgtatggaaatcgtgaaattgcttaccatcgagataacaaaaagcaacgatcccaaattttttgggaaattgagttattacaggctttaacaattatttttgcttacattgtatttttaggatttctgtatcagtttgcccatggttaccgtagctattttttgattcaatccttacttatcatcgctggtggattggatgtttcttggtatttcatgggaatggaagattttaaaaaaaccgttttccgaaatatggtcataaaaattgtatcaatcgcgttaatttttaccttagttaagcaacaagatgatttgggaaagtatatttttttactgggaatgtctcaggttgtcggaaatttaacgctatggccatatttgaaaggaagtgtccagtgggtcggtttccgcatgttacgtccatttcggcacttctatccatctttactattatttattccgacaattaccactcaagtttatttagttgttaatagaattatgcttggtcgacttgcagatactgttgcagttggacaatttgactatgcagataagattgttaagatcgtactcgctgtagtaacggctaccggatctgtgatgttgccacacattgcacataagtttgctggtggggatgtgaatggtatccgcaaaagcttatataattcgtttgattttgtgactgctctttcggtaccaatgatgtttggattagcggccatttcaactacttttgcgccctggtttttgggtgctgattttacaccaactgcaaaaattatgttcatcgaatctccagtgattgttctaattgcttggagtaacgtcactgggacgcagtatttaatgccggtcaatagagtaagtgaatatacaatgtcggtatctatcggtgcgattgcaaacattgctttgaacttgttttttattgaagtatatggtgcaaatggagctgcattggctactgtgatctctgaattggtagttacaggtttacaggtttactttattcgaacaacgattaagcggcgacaattatttaaaaatacatggaaatattttattgctggtggaatcatgtttatcgttgtatttagattgaacggcattatgaatatgtccattcaaaatttaatcatgcaggcgcttgctggaatgatcatttatacagttggcctagtagtatttaaggcgccaattttagatcaggcaaaggaattaattgaaaaaaagattaaacattaataatgtaatcaaattgttgtataactttagtggtttgtaatttgttcgtaattaaaaaatgataggataaaagttatcttagtacaaaaacgttaataattagggatagaagttatgggaggaattactacatgccagtggctaacaaaaagtttatgaaggataggaatcttttatattcgggaattgccatgtttacatttagcgcgatggtgctatttgggcaggggacggcgaatgccagtcaagacctcaacaatgatacacaaagtgtaaactcagctaatattgcagatactggtactgatgcggctagtaccagtaccagtacttcgttaaaaacagatacgtccgcaactagcacagttagtgcatcagtgcagccagccaatcaagcatctacaacgagtagtgccagtgcggtatcaacattgtcacaagccactactaaagtatcagatgagactgttataagtgctacaagtgctacaagtgctacaagtgctacaagtgctacaagtgctacaagtgctacaagtgctacaagtgctacaagtgctacaagtgctacaagtgctacaagtgctacaagtgctacaactctgacgactaactcctcagtcacggaaattcgattagttaatccaacgagtgatgagattacacaagctaagtcggcagcagcagctacttatgcagcaacaggacaagcacaaaaaatagtactagttgattctggaagtacatcgacaacggctgctttcttggcgtcgattaaacaaggagctttgcagggctgggttcagtatggtgtattaccatctgtaaccgctgctcaggcaattttggaaagtgctaccggaacgtccggtttggcgactaaagggaacaatctttttggaattaagggctcttacaatggacaatcgattacgatgaaaacctctgaatggagcggctcaggatactatactgtatatgcagccttcagaaaatatgccagtttttctgaaagtgttctggatcatggtcgtttcttgtatacgaattcacgatattcgaatattattcataatcgtagttatacatcagttgcaaatgacttacatgctgatggttatgcgacagatccatcatacgcatcaaaattgattaatttgattaaaacatatggcttggctagttgggatactgaagcatttgctcttacggataaggtttctgctgggaatttggacaacgtgtctgttaatggaagtacattgaatattaacggatggtttgccgcgacagatgctgctggtaagtcaaatacgtatgtaattatacttgataagtctaccggaaaagaaattagtcgatataagatttctcttggaactcgttcagacgtacaaaaagcctactcaaatgttgctaattctgctaagtcaggtttttcaattagtgtaccgtatactagtcagtttgctgggaaaaatttgacgatcatatttcgatacagtgcttctgcagatggaaacagtaactatatagatagaactttttcaaccagtttgacccaaaatattggaaatattgattcaacgacagttactaatgacaataagttgaacgtcacaggatggcatgcgtccgatgcttccttgggtagaagctatcattatgttatcctctgggacaagaccacagggaaggaacttggtcgtgttttgacaactacattaacgagaaatgatgttaattcgatttatagttatgtttataatgctgcaaaatctggttttaatgttacatttccttatagtgttagcgctgggaacgatgttttacaagttgtaagtcgatatagtgcctcggctgatggtaatagcaattatgtagagtattggtctgcgccaattcagatgacgcgaagtgacgcacgacttgatcgtgcagcattaagttcagatggtaaattgaatgtttccggatggcacgctgcagatcaaacaataggtaaaaattatcattatttgattctttttgacgaaactacgggtaaacaagttggggttgttaaagcggccagttcggtgagaaacgatgttgcagctgtgtatccaggaatatataatgaaaaaaattctgggttttcgggatcatttaatttaacggggatcaatttgacacacaaattgtcaattgttagtcgatattcaacgagttcgaccggtaatggtaatgctggaaagtacgttgatttttggctaagtgctccagcatttaatacagtaaataaggctagtttagataactttagctttaatggcggaacttcgatcaatgtatctgggtggaatgctactaatcaagctttaggaaaaaattatcattatattattttattcgataaaacgactggtaaacaagttggctcgtttttagcatcatccgtgattcgaaatgatgtggctaaggttaatagtggaattcttaattctggaaaatctggttttagtggtagtttcagtttcaatagtagcttaattggtcatgacttagtggtagttagccgctactcaacgagttcgatcggtaatgggagcaatggtagttacgtcgattattggtttggcgagaaaacattttccggtaatcaaggaaatgttgaaacggttaagagaactaatagtggtctcaatattagtggttggcaggtttcagatgcgtctgtgtatgaatcgtatcggtttgtgattgtatttgatgcaactactggtaaagagttggcacgagtgagagttacgacaaatgttgtacgtaatgatgtgggaagttacttacctgatatttataattcagacaaaggcggcttttcagtgacttttaaaaaattgcaaattccgagcggccataaaattcaaattgtgagtcggtacagtaatagccagactggcgagggaaagtatacagatttttggtctaaaatatatacgatataaaatatgcaaggtaattaattttattaaaattaattatcttttttttacctttttttattaaagtgattgataaattattaaaaaagtttcaatataactattatgcagggttgtacttaaactaatagggggagtaattttgaaatttacggagaaacaaagaattattagtggacaaaagcaatttaagcagtctttagtcgctggaattgcgctagtaacactcactttggtaacaattattggggtggaccaagaacacgcatacgcttcgagtactgataccgagatttcaagtacggctgtgcttgattctagtgctactgcagggacaattgaggcttcaagtaccagtactttaaattctagtacttcgagttccaatactccaagtagtgctgctagttcggcagcgaagatagctagtagtgcgagcgctgtacaagtgtcagcgagctctacatcttcagtagccagcagttcgactactgctagtgaagtggctacatcagcttcaactgccacaacattaactagggtgtcacaatcgagtgttactgcacctagtgcacaaaatgctggtagactggattctactacgattcaggggaatcagttggaagtatctggatggcatgctacgaattatgccgaaggacgagattatgattttgtaattgtatatgatgtaaccacaaaaaaggaaattacacggcaacaaattcaaccagttcagagaaatgatgtggctagtgtatatccaaaattagcaaatgcttcaaagtctggttttcaggcaaattttgatttaactgatgcaatggctggagatcaaattcaaattattagccgctatagtgctaatgcaatgggtaacagtgattatgttgattattggtttacaccaattattttcaataaaaattatggtcgtttagactcagctaaaattactggtaacggtgatttgcaagtgagtggttggcatgcggcggatcgttcaattgacaaagatactcattttctgattgtatttgattccaccactaatcaacaaatttcagtagcatctgttaaaaatacacaaagggcagatataaagaaagtctatccaggagtgtataatgaagataacgctggattcagtagcattcttagtcttaagaatgtaaatctaagtcatgatattaaattggttagtcgatattcttcaagtaacaaggggaatggtaatcaaggtcagtacgttgattactggtttagtgttccaaaatttgatcagagtaacagaggaaatctagagtcgtttacatttaatggtggaaccaaattacaagttgtaggttggaatgctactaatttatctgctgggaaagacaatcattttattatcctatttgataaaaccactgggaaacaggttgctagcacaacttccagtgtaaaacgaaacgatgttgctcagacatacaagcaagtagcaactgctgctaattctggttttagtactcagtttaattttagtagttctttagtaggacatgatttggtagtggttagtcggtattcaagtgatgcttcaggtaacggtagcaatggtcagtacgttgattattggtttgaacctaaaacatttaattccgaaaattattctgttgatcattttaatgtaacaaaaaacaacactaatgtgcatgttgatggctggtttgcgagtgaccaagcggctggaaaaaataacatgtttattattgtaataaataaaattacaggtaaggaagttgcacgaacgaaagatacgtatatcaagcgtaatgatgtgtctaaagccttttccaatatctataacagtaacatgagtggattttctgttgatattccagtaactagtggaatgtctggcgaaccacttcaatttgtgttgagatcgacaggtagttcggatggaaatagcaactatcatgacatgcgcaccggaacgtatcaaatgccatctcagaataaaggatcgtttgacagcgtgaatgtgaatatggacacttctaatatggcagtatctgggtggcacgctgctgatggaagttatcttaagaattatgagtatttgattgttacagatttaagtggtcatgagttaactcgtgtaaaggttaataattcacatcagcttcgaaatgatgttctgggtgcttattctaaaatttataatgcacaatactcaggcttttctgccaacattacaattacttcagcaatgaaaaataagtttgtcaaaattattgatcgttttacagatgatgcaaacggtaatggaaattatgtggattattattccggtcaaattgctattggagtagtttataatgtgacagcaaatggaattaatgcgtatattacgaataatcatttatcgcacgcaacaattcaaactcaaatatggagcgggtatcctaccgatagtagcatgctttatgaaaatgggtatggtagtccagagggtgtagttatccatgaaacagccaactatggtaatgatagtattcctatggaaatgtcatacgcacagaaccactacgagaatgccttcgtccattcatatgtgagtgatgcccagattattaatgttgctaatacaaattacaagtgttggggtagcggggcgcaaggcaataaacggtttgtacaatttgaacagatcgaggttcatagcaagacagcatttgcgtatgaactgaataacgccgcgtactatactgcatatttacttgatgaatataagctaacaccatcgttgtgtacgaatggcagtggaacggtgtggtcacatcatgacgtgtcaacatacttaggtaataccgaccatacagatccagacgggtattgggcaacaaatgcaaagaagtattttggtacttcgtattcaatgactgatttctttgaattagttaaatactattttgctcaactataaaattaaagataagatggtcatttaatgaaattaaatgccatcttttttttattacatgttcgatttatgttagaattaacgagttatgaagagaagaatggaaaaattccattgaataaataattgtactagtgattacaaggagagataaaagtgaaaggtattattttagctggtggttccggaacacgtctgtatcctatcaccaaaacgatttcaaaacagctagtgccagtgtatgacaagccaatgatttactatccactatccaccatgatgttggcaggaattcaagacattctcttgatttcaacgccccgcgatatcgggcggtttgaagatttattaggggatggctcccaattggggattcacatttcttaccaagtacaagaaaagccgaatggcttggcagaagcctttattgttggcgctgattttatcggtgatgattcagtatgtctaattttaggtgataatatctactatggtagtggtctgtccgagttggttcagcgttctgcccagaaacaagttggggcaacggtctttggctaccaagttacggatccggaacggtttggagtggtcgaatttgatgcagcccatcatgtgaaatcgattgaagaaaagcctgaacatccagctagtaattatgcggtcacgggaatgtatttttatgacaaccaagttgtcgatattgcaaagaacctaaagccttcgccacgtggtgaattagaaattaccgatgtcaataaagtctatctagaaaaaggccaattagatgttgaactgcttggtcgagggtatgcttggttagatacggggacccatgaatcattacacgacgcagcggcctatattgaaaccgtccaaaagcggcaaaacttgaagattgcttgtatcgaagaagtagcttatcggatgggctacattgataaagaacagttagttaaactcgcgcaaccgttgaagaaaaacgattacggtcagtacatgttacgattagcggaggagaagtagttattatgggaaaattaattgttaaagaaacaaaattacaagacgtcaaattgattacaccagcagtgtttggcgatcaccggggctttttcactgaaacctattctgatcgtgattttaaggcagcgggcattaatttcgactttatccaagataaccagtcactatcgacgcaagctggtgtactgcgtggcttacactttcaacgaggccaagctgcccagacaaagttgattcgagtggttaccggtgctgtgttagatgtgattgtggatgtgcgggctggttcaccaacttacaagcagtgggaaggctacattctttccgcaagtaatcatcgtcaattgttggtcccacggggctttgcccatggtttcttgactttgacggataatgttaacttcctttataagtgtgataactactacaacgcagaagctgatggtggtatttcattcaagacaccggaattaaacattgactggccaattgattttgataaggcgattacctctgaaaaagatgccgcgcagccatcatttacggaattcgaaaaagacaatccgtttaagtacggcgaaatttaggagtagatgaccatgaaaaatattattgtaaccggtggagccgggtttattggctctaactttgttcattacgtggtgaataaccatccggatattcacgtaacggtactggataaattgacgtatgcgggcaacaaggccaatttagctggtcttcccgcagagcgggttgaactagtagttggcgatatttgtgataaagagttggttgatcgcctggtttcgaagacggacgcggtcgtgcattacgcggctgaaagtcataatgacaactcgctgattgacccaactccatttatccaaaccaacattgtcggcacgtcagtcttaatcagcgcctgcgtcaagtacggcgtacgttatcatcatatctcgacagatgaagtatatggtgacttaccactgcgtgaggacttaccaggccatggtgagggcgtgggggagaagttcacccctgacgcaccctacaagccaagtagtccttattcatcatcgaaggccagttcagatttattagtccgggcgtgggtccgttcctttgggctaaaagcgacgatttcgaactgctccaataactatgggccttaccaacatattgaaaagttcattccacggcagatcactaacattttgagcggcattcgaccgaaattatatggttcaggtaagaatgtccgtgactggattcacaccaacgatcattcacgagccgtttggaagattctgacggaaggcaagattggggaaacctatctgattggggccgacggtgagaagaacaacaaagaagtgctggaattgattctggaaatgatggggcaaccaagtgatgcctatgatcaagttaaggatcggccaggtcatgatttgcggtacgccattgatgcggcaaaactgcgtgaagaacttgggtggaagcctgaattcacggacttcaagagtggcttacaacacacgattgactggtacacgacgcacgaagattggtggaaagcggagaaggacgccgttgaagctaagtacgctaaaaatggtcagtaacgtgtttagaatgactaactaaattaaacgataaggagtcgaagtcaggtggcttcgactcctttttggaggaattagaatgcaatatttagtaactggtgcaaacgggcagcttggaacagaactgtcgaaaatgatggacgaccgtggcctgaactattggggctacgacgcgaaagatatggatattaccaatcgtgacttggtctttgataagattcgcgacttaaagccagatgttatttttcactgtgccgcttataccgcggttgatcccgctgaggacgatgggaaggcgttgaactggcaagtgaacgtggatggcacgaagaatgtggcggatgccgctgctgaagtgggtgcaacactagtttatatcagcacggattatgtcttcgatggcacgaatgaaggcgaataccaggttgatgatgccacgaacccccaaaacgaatatggccgggccaaactggcaggtgaaaatgcggttcgggcagcgtcagataacaattacattatccggacgtcatgggtctttggtgagtatgggaagaactttgtctacaccatgttaaatctagccaagacacatgatacattgacggtggtcaacgatcaggttggccggccaacctggacaaatacgctggcgcaattcatgttatatgtggtgaagaaccagtcggcctttgggacgtatcagttgtcaaacgatgattcgtgcacgtggtatgagtttgcacgtgagattttgaaggatacggatatgaaggtattaccagtaacttcagcgcagtacccacaaaaggcaaagcggcccgcgcattcgattatgagcttggataaggctaaggcgactgggtttgtggtaccgacgtggaaagaggcactgcaaaagtttataacaaaaattaattagaggaattagataatgggtaatggaaatacttgtgcggtagttgtgacgtacaatcgaatagagctattaaaagagtgcattaatgcactcttgaatcagacgagtaatgttggtcatgttgttgtttatgataatgccagtagcgacggtacaaaagaatatctggattcaataaaaaatgatcaagtaattagttttcattcagatacaaatttgggtggtgccggtggcttcagtaatggtctaaaattggcatacgaaaaaacagatgatcaatatttttggttgatggatgatgatacaattgttgcagaggattgtaatgaagtttttcttgaaaaagctcagttattagatgatcaatttggatttttaagtactaatgttcgctggaaagatggaacaccaacgaatgtaatgctgacagatacaatgtggcctaacagggttgatgatggattaattgaaatggaatatggatcatttgtttcattttttattacacgtgattctgtagaaaaaattggattaccaatttctgagttttttatttggggagatgattccgatttttcattgaggctacgacggattaatccgggatattttgtgattcgtgcacatgcagtgcataaatctggttcaagcgttgttgctccgggggttgcagaagatgatgaaatgcgaattaatcgctattattattattatcgaaaccaaatgtacatttggaagcatcattatggaaaatattggaaattatttttcaagtattcacttcaggcattatttgtactgaaaaagtcgaaaaataagcgctttaaaagaatgttagtggtttatagagggttgtttgcttcgctttcttttaatcctaagatagtttttgtaaaaaaatgatattttgatttttattatttttgatgaaatctttaatgaatatgcttgaaaaatatatatgtgatttgaaagagagaatatgaaagaaaaatttaaagcgaatagtgcagtaattttactttttttaattataagcttttgcgtgatgataccgttttataaacacaatgtcttgaatagtggtagtgatatgcagtttcatttaaatagaattaatgaaatctatcaatgtcttagaaatggaggtacgtatccatttgtttcagtttactcgtttaaccatgttggaatgcccgttaatatgatgtatccatcagtctttctatattttttcgcctttttgaggtttttgattcataatcctgtgacagcaacgtatgctggaattaatttattgatttttttatcatgtgttattaactataaaattggattgaaattttggaaaaatgataaacgtaaatcatttatatttgcgattttatatacgttatccacaaattattttttactattattttctggttttactttaggagaagcaattgcagcggtgtttttaccggcagtattctatggaatgtatagtattttttttagtgaaaagaatgagtggtatattcttgcgttaggaatgatttgtgtactgtatgcgcatttattgagtgtactaatctatacaatgtcgttatttattatttttttgattgctttgaaatattcacataatattctgaaaggtattgtgtcgttagttcttgctgtagtatcggttatgttaggtggaaccttttttttcgtaggattctttaaagctataatgtcaacacatatgcatatgacagcagtttttgatcttcaaaataccgcaattggtcttggtgactttgcaaaaaatagtttggataataatgcgattggggcaatcttttttattatattaattatatccatagtcaagtggagtagttttagaccggagattagggtgatcattgtcttagcgatggctttctgcatattaacgactaatttaattccatggcgactttttcaaaatacaccactaaatgtgattcagtttccatatagatttttaacagttgctaatttatttttagcaattatatctgttgaacttttttcattttttgatttagaggttggtatcaaaaaatggataatgcctatagttgtaacggctttatgtggaataagttttgtgagtagcacatttgtcttcttttccaatacacaatctgaacctgaagtttcaaggattccaactgtgaaaaaatccattaatatgactaattttaaggttacacctgcacaatttaataatatattaaaatttaataatggggttggatccacagattattggccgcaaaaaagtgttccattttttaacagtatagtaacgcataggttgattttgaatggtcattatagaattaaggtaaatccaaaattgtatcctaacagcattatgtatgaagtgaatctaaaaaacggtgtgcagagtattgacttgcctgtactaaattatagtttttataatgttagtgtagatggaaaagataaaaaattttcgatgtcaaaaagaggaactatccaaattaacaacctgaaaaaaggtaaatctaaaattaacataacgtataacgtatctgctgttcaaaaaatagctgtagttgtttcagttgtttcaattacactgttatttgtattatgtgagtatcaaagaattaaatcgataaaaaacgataaaaaagcaaaagattaagtaaaataatgttaaggtcaaggaatcatatgatggaaaataaagttatttgaaaaaatatttttatggagtcgaatgaaatctattcaattgggggatatatttgatgagtaagcaagaattaatgttaaccattttgatgccatgcttgaatgaagcagaaacactagaagcgagtatcttagaagcactatctttttttgataaaaataagggtatttcaggtgaggttttaattgccgataatggaagtacagatggaagcatcgaaatagctgaaaaatattctactttaggtgtaaggatagctcatataaagacaaagggttatgggaacgcattgatcggtgggacaaaagaagctttgggaaaatacgttgttatgggtgatccggataatagttatgacttttttcatttattgccatttattgagcggcttgaagctggtgatgatttagtaatgggaaatcgatttaagggtggaatagaggatggtgcaatgccgccactacatcgatatttgggaactcccgttttatcattcattggaaggttattttatcataataaaattggagattttaattgtggcttaagaggatacaacagagatcgaattttagctctacatcttagaacatctggcatggaatatgctagcgaaatgattgtacaaagttctcttcataattacaaaatatctgaagtgccaactgttttgcgagttgatggtagaagtacaaaaccgcatttaagtacttggtcagatgggtggcgacatctacgttttcttttgatgtatagtccgaaatggttatttttatatccagggttatttatgtttgttattggaataattggaatggcagttttatctcagggaccagttcggataaactccgttaatcttgatatcaatacccttctttattcgggaggattaacgattgccggaattcaggcagttttatttgcagtatttgcctatatctacgcaaatactactagttattttccggttgtagataaattatctgaaaaaattgaaaaattaaccgttgaaaagggaattgtagttggactaataatttttattatagggttgattctggcaattttttcagttgttatttggtctagaagcagttttcaaaatttaaatccattgaaagtaatgaaaattactattccggctatgatttgcatgattagtggcattcaaatattgtttggaagttttttagctggaatactaaaaataaagagaaatgataatgactaaaaaaaaatatattatctggtctatagcgtatttatttgtcattggcgtatatttttgtttgatttttagaagaaatttttatattcaaccatttgcagcttatgattcagcactacaggttaagttagcaagttatttagttaaagggcaatggctgggtccatataattcaattaccttggctaaggggatttcatatccgttttttttagcggtattacattttttaaaagttccattgtggatcggcttaggtatgttcaatttagttgcagtcggtatatgttgtgtaataatttcagttatcatttcaaataataagcttaaatggggattatttacattactaattttgaaccctgttttatttgacacctctcaagtaacgttatatcgtgattcattgagctatggtttaatcttacttattttggcttggattgtcgggacttttataagtgttataaagaagaagtttagtctttttctttgtgctacttttgttggaattatttcattaccattttggaataatttacgagaagatgcattttggatgtatccgtttgtaattgttggattatttgtgtcagctgtaactgctatagtcatttatagaaaattaaaatggaagttagtatggcttgttttaatgttgcttccattttctatgtcttatattgtaaatcaaacaatttctaaaaaaaatttacagtactatggtagtttcgtagtaaatgattataatgatggaacatttaaatcagcgtatggcgcattaactaatattaaaacaaatagttgggtaatcaatgtgccagttaataccgaaatgagagagaaagcgtatcgtagtgttccagcttttaaaaaattagagcagcatttggataatcatggctcgggatcgatggaatcctttaaaaattttggtgttaaagaaccaagccgcggtaatgattatcaaggtggctggttcttttgggccttacgaggagctgtatatgactctgggtacggtgataattcaaaaaatgcacaaaagtattacaaaaaaatagcaaaagaaactaatcaggcaattgctactggaaaattgaatggatatagaaaagaacgagagtctttaactccgaaatttaataggcaaattttagttccaacaatgaaatatattattaaaggtagtgttcaaactgttttatatacggggttgaagtaccaagtaaaatttaatcatgcaaactttatgaatccatattttcatttcatgtctagatttacgaaaactggatatccactacaacaaagtaaacagaagataacttataaagtactttttttacatgtaatgcgttggggagaagtttttgttacaattttagggtttgtaatgattttaatctgtttttcaagaactattaagagctgttttaatcgaaatattaaactttatgagtttatgtattttacacttacacttggcatattattggaaatattattacgattagttatgataggctatgtttcaacaacatctttcaaatcttttaatattgcatatttaagcagtatctatccgttattcactattcaagcaatattaagtattacttactttgattatcttaaatcaaataaaaaaattcggtataatttttgaaaagcggtgtatttgtcgatagcggcgtcaaaatgtcgtttgggcgtgcggacattttactgccatcattaacattagataattattcagcaatgatgattgaagacggcatatggttttaccgagtaggcctacgcaattgaccaaacatggcaaaaaataactaaattaagaaaaactcttgagctcatgtgtcaagagcggcgataaaatgtcgttcctgcattttgccgctgctatttacactcatgaaaaataagatactcaaacgtgtaatagctatctatttttatgtgcttactacacctaatctatgtataataaaaatccctttacagattatcaaatgaattgttttacttcatttaataattcataaagggatttttttgtccgtaactgcaagaaacgaaacactattctaacttagttactagtagcaccagcagtcgtaccggtggtcgtgcccgtaccagtagcagttgtggttccaccggttgtagttgttgcagtacctgtaccggtgtttccgctcgtgctagtggcacccgttgttgtaccagtgccacttacatgacgagtggtatagttgccataggtcgttgtacccgtggtaccagtccctgtcgacttgctggctgtggtaccagtcgttgatccagttgtaccagagtgtgtgccataggtcgtagatgtcgatttagttgaactcgacttacttgaacttgaagaaccactgcctgcaacgttatattctgcgttgttgggcaggatgaaatcaacgttggtaataccatcatagtttgattgtccgtcgtacatggcggtttcattattggtgaccttagtgtatttcaatcctaaagcatgacggattagtttagaaacacgattaatttcttttggtgatgcaatttggaaggatgtgccactgatcgtcgcattcaatccttggaaatgataggtcttaacatgtttcattgacttgtggtagttagcgtatagcgttgctaaactattaattggaatgttggtccgcacaccttgtttagcagcatctaaaattttgttcacagcactaactgaaccgaggccctttaactctttgatgactgacttaattacttgttgttgtcgtttttgacgaccgtaatcgttattaggatcatcgtaacgcatccgtgagtatttcagagcattatttccattcaacttttgctttcctttagggaaatggtggccttcatacgtaaaggcaaatggattatcaacggtcacaccgccaaccgcgttcacgactttcttaaggacacccatgttaacgatcgcgtagtaatcaattgggatatttagcagttctttaacctgttttacggtttgcttgggaccgccaatggcgtaggcggcattgatcttaacgtagtcagcccccttagaggttttgaccttgaccagcgtatcacgcggcacactggtcatcgtgatggtttcctttttcgggttaacggtcacaacttcgagtgtatcggtgttaccaccagtatttgcgcgacctagtgcaccggtatcaaggcccatcaaaagaacggatacaggtttaccttcttgcaatttcttgctgaccttactgctactattactgaagataccagtagccgtagagtgcaccttatggtattcgtacccaacagcggctaagaggaggatagcgacaacgccgaccacccagcgaatccaatgatgttgatgcttctggggcttttgctgtttatgattatgtgtgttccggcgtctgttgacccgggtctcttcttgatccattagttaattatgcctcgtattttttatgatttttggaacattctcgtttattatacccgcctaggcttagttatgggagtaaaaatataaaattaaggcgattttaaatatttctttgagtttatggcagtagcccttaagagtgtgtaaacaccacttattttattctatatgttatactacaaaagataccccgtcttatataacactatatgaggagtgattattatgaaaacgattattacttatggcacctttgacctattacataagggacatattaggctactccaacgggctgcttcctatggtgatcgattaattgtcggtttggcgactgatgaatttaacgcagtgaaggggaaacgtgcctacacgagttatgaagatcgacgattcatgttagaggcaatcaaatatgtagatttggtcatccccgaaacttcctgggatcaaaaggtaagtgacgcccgaaaataccatgttgatgccttggtgatgggcaatgactggactggtcagtttgatgatttaaaacaatactatgatgtcatttacttgccgcggaccgaaggcgtttcgacgacacaaatcaaacacgacttaaatacagctgattaacgtaatcatgaacgggactgtgaacagattagcagctccgcttttttgtgaccgaaattaaattaatcgttttcccacatcatattcgttataattaacgtaacgaaataataaaggagttcaatcaaatgattactttaaccccagtggggaaccaacgtgcgtactggacgaaaatttatgaggactcatttcctgcagcggaacagatgcgtacggacaagctatacatgcttagtgatgatccaagtagtcgagcgcacgctgcacttattcagcaaaaccagacgaatatcggcattgtttactatgtggtcagtgttgacgatagcaaggcctttatcctttatctagcggttgatcctgatcggcgtggagatggactgggatcacaggcgatttcgtatctgacacagcgctttatgaacgggattattttagagagcgaagttcttgatgttcatgcaaataaccgaactgatcgtcagcggcgttacgatttttacctgcgtaatgggttaatggattctgggtatctgagtgatacactgggtggtgtgttccatctattaagaagcagtcaacaggtgtcacttgaagactactttgactttttggcggcgcttggtttacgatcacgcgtttctgtgaaagaggaaggctgaatcaaggttgcgatttgttgatagtcttcggcgaaataactgtccttcaaatagaccaaattaattggatgttgaattgaaaaatcagtgacgggtaactcaatgagttgcccgttttttaattcgtgatgcacgagtgaccgatacatgaaacttacgccgaacccactgaggagcagcttgatgatgggagacggattcccaatttcgatgatttgatggaagtcgtgaacacggtagttttgggtagctaaccagttggcaaagatattacgggtgccagatcctgattcccgaatgagtaggggaacatcaatgagatcgtcgagagtgacgtggattagttgggcgagtggatgatgggcacttgtaaccccgacaaatggttcgtctaggatgtgaatggcatcaaactcttccttattaaaattcccttcaacgaggccgaaatcgatggtgccattccgaagtgcggataagatggcccccgtattggcaacttgggtggtgatgagtggactcatggtgctgagctgggtgaccagctgtggcagcattgaagaactaagcgataatgtgcagccaagccgaatcggtcgttgatcggttgtggagtgaacttgtttaagaactttggtactttccaattgtacttgatgagcgtagtcggccaacgattggccagctggcgtcatttcgatatggttgtgcacctttgtgatgagggggaagccgagttctgtttctagactccgaatttgttgggagaccgctggttgtgtgatgaagagcttttcggcagccttggtaaaggatcgagtttgggcaattaaatcaagtgtttggtatcgtttatcaagcatcgtgtcatctccttataagctatccttatattaacacaaaaaatactaatttttacttatcatagaatcatgctaagatatgaaacgtaaataagagaggggagataaataatatgttagcttttggtgtaatgcggacacgcagcttttacttagccgctgtattaacgttgatctgttcggcgattgggacaatgttggcgggcttaccgtattttgcaattattggtgcgctggtgatttcactgatcttgggaatgttacttcaggtatatcaaccagcaattgaatcgtcgaaggcagggattggatttatttcaaataagttcctgcgtttaggaattattctattaggatttaagctgaacctcatccaacttgcgcaggcgggggtgaagacgattaccttagccattgtcgtggtaaccgggacgatcatcttaacctataatattgcgcggaagttaggggttagcgaacaactatctatcttagcagcaagcgggactggaatctgtggtgcagcggctgttatgggaatttcacctcaaattcaggtgagtgaagataaagctgatcaaaaacgtgaggacgaagtattggctgtcgccattgtcgccatcttggggacggtctttactttgattgaaattggcctcaagccgttactgcatatgacgcccacccagttcggtattatggctggtggctcattacatgaaattgcccatgccgttgcaacgggtggtgcaggtggtccagttagtttggacactgctattattactaaactatcacgggttctgatgttggccccagcggcgttgattatcggtgtttggtatcaacacaaggtgaacaaggataatccggcaacagctggaaagcaaaaattgccaattccatggttcatggctgggttcatcttggctagtgtgattgggacctttgtgccaatggggactgaagcgctgaacggacttgtaaagatcgcgtaccttgtgttggggatggccatggctgcgctcgggatgagtgtcaacttcaaagtaattcttcatcggggcaaaaacgccttcttagctgccggtatttcatctgtgattctattaacgtttgtgattattgtcagcaagacgttcttctaagtcgataatttataagcctaactctggtttgttggagttaggtttttttctactatattagataactatctattagactttgtctcgggggtgtattaagatagtataggactattttggaaagggacaattaaatgaaaacaccggaacaattaaaacaagccgttaacactcgtcggacctttgcgattatttctcaccccgatgccggtaaaacaaccattaccgaacaaatgttactttttgggggcgtagtgcgcgaagccggaacggttaaggctaagaaatcaggcaactttgcaaagtctgactggatggaaattgaaaagaagcgtggaatttccgttacgagttcagtgatgcagtttgactatcagggaaaacgaatcaatattttggatacccccggacatgaggatttctctgaagatacttaccggacattgatggccgtggattcggctgtcatggtgattgacggggctaaggggatcgaaccgcaaactaagaaactcttccaaatttgtaagatgcgtggaattccgatctttaccttcattaacaagtttgaccgtgatgcacgggaaccacttgatttgatggctgaactcgaagacgttttaggaattcaatcgtacgccatgaactggccaattggaatgggccggggccttgtcggtctgtatgaccgtttcaacaagcgggtcgcattggcacatccgacagatgacagccagccatacattcctttggatgctgatgggcagattcctgctgacaatccgttgcgcgaagacagtatctggcaagataccctcgacgaggtggatttgttagacgaagccgggaatgattttgacgaatcaaaaattgccagtgggcagttgacccccgtcttctttggatcggcattgacaaacttcggggtacaaacattccttgaaacttatctcaactacgcaccagcaccgagtgcccataaaactgaaaatgatgaaaccgtagaaccattaagtgctgacttttctggatttgtattcaagattcaagccaacatgaaccccaaccatcgtgatcgtatcgcttttgtgcggatctgttccggtgagtttgatcgcggaatggatgtgacgttggaacggactggtaaatccatgcggctatctaattccacacagtttatggctgattcacgggagaccgtcgaaacggctgtggctggtgatattattggactgtacgatactgggaacttccaaattggtgactccatttatactgggaagcaagatatcaaattcgagaaattaccacaatttacaccggaattgtttgtccgggtcatggcgaaaaacgtcatgaagcagaaatcattccataaggggattgatcagttggttcaagaaggtgccgttcaactgtattcgacctattcgacgggagattacattttgggtgccgttggtcaacttcaattcgaagtgttccaattccggatgttgaacgaatataattcagaggttgtaatggaaccactggggcacaaggtggcacggtggattaatccagaccaactcgatgagcatatgtcctcgtcacgtaatatcctcgttaaggatcgggctggggcaccactattcttgttcgaaaaccaatttgcagaaaactggtttaagagcaagtatccagacgttgagttaatgagtaaactttaaaatagcataataagaagcgaccaccaatgtaaattgatgatcgcttttttgtacgattctatactttgtgacggatgaaccacatttttcggaagttaagttgcatgatcaatagcgcaatgatgatcaatacacccccgataaagagattttctgtgaatggctcaaatccaaagacgacggaaaagatactgccgaacatggattctgtcattaaaatgatgccggccggtgttgggtcagtaaaacgttaaccaaccacttgaagggtttgtgcgccaaacgaagaaataataccgagaatcacgacgggccaaataccggctttccagtcgacggtggcgtaggttccgtgttcaaataatagcgaccaaattaggccgaaaccaccttgggtcacccctagcatgaaggaaagaatccacggattagaatcggtggccgtcatgccaaagtagacgatttggagggcgtaaaagagtgcggagagaatggttaataagtcaccgatgtgaatggagaagccctggccgataatgttagttaagaaaatcatccccaccatacagattaaaatggctaggtagcttttaggctctggtcgtttatgaaagaagatccagacaataaaggggataatgacgacgtagattgcggtcaagaaggcattgttggcgggtgtcgtgtacattagaccaatcgtttgaatttggtaacccaaaaagttgattaagcctgcggtcagtccgattcgaaggtcaaccttggtcatcttattgatggccttatgaaagaaaaggtaggctaatgcggcgtatatcagcccccggatcgcgttgattgtgccggcatgcatgcccgcgttggtggcctgcttagagaaaagatagccggatccccagataatagcggctacgagtaacataaagttagccttagtttttgatagttgcatacttgctcctcccgaaaaagttcatttaaataatataccactaaatgatagttaatggcggagtggtaactaaaaagatcgcgatagtttagtcgcgatcttttagtagaaactatttaaatttaatgtaagttccgttgatgaagcccttatcttggatttgataccaaacgacgccatcattattcacagccttaccgacaatctcgacggtcgtgtcgtcggccaattcatcctgtacctgcccgtaaggtttatcgtaagtctgaatttgcttgttggggatgtagtcaatgcgggccatgacgtggtcgagcggttcaatcgctaacatgtcttcttctggcatcgctttttctccagcataggggtttttggtaatggtaatttgatggtattcgatccattgatcgggtcccatttcgtaccagaatttaccattgctggtagctacccgcttgaatgctttgacggtcatcccggctgggagggtgatgttgcgggaaatcccgttaatcgtatcatagattgtggtgtcggcgttcagatgaagatacatatcaacggtttgaacttccacccagtctttgcggcggtagtagagacggacgacgtgagaatcttcatcgaagatgccgtttaaatcaccttcggctttgataaatttaaaattctcgatttctttttgttcaacggcgtagtgctgaccgttacggccccgtagtaggaccggtaagataagattggccttggtgtcaatattgatatagtaagcccataccgggacaccagtgcgaaaagattcagtcacattgatcactccaatggtgtttatattgcttttattatacagcttttggggacaacaaacacctcattcgaataaatggacaaacaattggtcaatacagggtgaaatgatataataggcccatcctatattgacgggagatcattatgaaaaaacataattcgacgtatcatatgagtattttgagtattttaattgcaatcattattttacaagactttattcccgtactgggcaatatcccgattggaccattgagtcttaccacgcttcatattacggtcatcattaccgcgattgttctgggaccggttgacggcgctatcgttggtggtgtttggggtgtgatcacgtggatccgcgcgtttaccatgcccagtagtccactagcacccttagtatttgtcaatccgttggtttcggtcgttccacggatctttatcggattaattgcgggatggctatttctcggtctgatgaaggtgatcaagaagccggtggtgccaatggtgattgcggccattgggggcgcattgaccaatacgctattagtgctgggatttatctacctgttttaccatacgccggccgtcgctcaggcttatggagttaacgtcgatcacttgtttaaagcgttacttgccatctttgcgactaatggtcttgcggaaatggtactggccgcagtcattgcaccagccattgcgacaccgttacgccgattgcatcatcgaacaaaatagaatctaaaaaaggcgatcctgatttgaattcaggatcgccttttactagcttaagaacacttattgatgaggtgtgtccgcgctaggtgttgcagctgcgctcgtgcttgggacgttcgcagtaatgattttaatatcgttatcgtcgagagttgcttcgaggtttttcacgtttggattatctaagacgaagtcggcaatgcgatcttcaatctgttcttgaataacccgccgtaatgggcgagcccccattgttggatcgtagcccagttcgaccaatttttcttgaacgggttgggtgacattgatgtagagaccacggtcagccaacatcttgttgacgtcgtcgaccatcagacccacgatcttcatcagattatccttagttaaagcattgaattcaacaatggcatcaaagcgattgagaaattcaggcttgaagtagttgcccaacttatcgagaacagaatgcgttttacccgaagcttctgcgccgaagcccacactggcttgtgcatcaccagttccggcgttagaagtcatgataatgatcgtgtccttgaagctgacggtgcgaccttgtgagtcagtcaaacgaccgtcatcaaggatttgcaagaacatatgcatcacatcgggatgtgccttttccacttcatcgagtaagatcaagctgtaagggtgacgacgaacctgttcagttagctgcccagcttcttcgtacccaacatagcctggcggtgacccaattaacttcgatgtactgtgtttctccatgtattcactcatatcgaaacgaatcatcgaatctgcatcaccgaagagttcccttgctaattgcttagcagtttccgttttaccaacgccggtaggtccgacaaagaggaaggagccgattggtcgacctgatttgttcaagccaatccggttacgccgaattgctcgagcaaccttattaacggcttcgtcttgtccaatgacatgggattcaaggtttttatcaagatccttaagctgcgtttcttcttgtttttgaagatcgccaacggggatgttggtcttttcttccacaatatgctgcatatcctcaacatcgacagtggccgcttcttcgctgtgattttcttctgcgtccttcttagccttttcaagtttggcaacttgatcacggtagaaggcagccttttcgtaatcttcattatcgagggcctgttgcttgtgtgcttccgcagtatgaatttcattttcaatcgttgctggatcagccgttttcagagttaagttcttcttcgaaccagcttcatcaagtaaatcgatggctttgtctggtaagaaccggtcttgaatgtaacgtgctgataatttagcagcagcttcaattgcgtcatcagtgtatttaacgttgtgatagtcttgataccgggttttgatgccgtttaagatttggatcgtttctttgactgttggttcgtcaacttggatttgttggaaccgacgtgctagcgccgagtccttttcaattttgcggtattcgctcagcgtggtagcaccaattaattggaaatcgccacgcgccaaggcaggcttcaaaacgttgccggcatccatgccaccttcggcattaccagcacccataatctcatggatttcatcaatgaaaagaatgatattgggattctttgaaacctcggtcattaattgctgcatccgctgttcaaattgcccacgaatcccggttccttgaacgagtgaaacaacatctaaacgaataacttctttattagcgagtttttgtggtacttgtcccgcaacaatttcttgggcgaggccttccacgacggccgttttaccaaccccagcttcaccaatcaaaacgggattattcttggtccgtcggttcaggatctcgatgacccgggcaatttctttgtctcggccaataactggatcaatcttgccttgtttagcaagatcggttaagttaaccccgaactgagcgagtaggctattgccgcggttaccaccttggccgccttgtgcttgtgtctgttgaccgttaaaagcttcttgcccagcggcttgttggccaccttggccctgcatggcctttaacaagtcatccaagtttccaaaaccaaatggattttgcgccattccgtttcctccattcatcaggttgttttgtgcttgttgtagtagttgataacaattctgacagagatcaacttgcatcttttgaccattgattgttgcttgtaagtgaatggtcgccggatttttctgacagttctgacataacattgaggcaaacctcctttatttgtaaattagggtctatctgctcacagtcccattgtaaaaagaatttctttgcaatccaactaaaaagcacttaagaaaggcgatttaatgtttgacctttcttgaccattgactacattatacatgcatttaaagtgaatgcaagtaattagtctgacgatttgtaagttgcctaattactggtgtaccaatggtttgataggcaacgaaggtgatctttaatcactttcacggttgattttagcactttgatagctagagtgctaattatttgtcgcttcttgagaattttgttaatcgattgtgtataatatagaagaacattaattggcaaggaggtgcataatggaaaaagattatgtgcaattaatggaagatttacgaaattctgtgattgatagttttacgattgattctgatgaatttcaaacttttcaggttgagtatcataaatatgaatttcgccagtcactagtcggaattgccaaacgcggtggcacagtcgaatatcgacgtaaaccaaagtaaagcaattgaaagaaatgacagctattttctcataaatgacgcgattagttccagttaatatcgaatatcaccatttgtgtgttaaaaaacggatatcgggagacattcaacagtagttcggtcttgtttttaacgcttacaattgctagaataaactagaaggagactattatgtctattcatgatagtctacaatttaatcctcgaaggagattgatcacaatggaaaaacgcgattttaaagttacagcagaaacaggtattcatgcacgtccagctactatcttggtacagactgcatcaaaatttagctcagatgtaacgcttcaatatgagggcaagagtgttaacttgaagtctatcatgggtgttatgtcacttggtgttggtcaaaacgctgacgttactatcagtgctgaaggccaagacgaaaaagaagcaatcgaagcaattgctgataccatgtcaaaggaaggacttgctgactaatgtcaaaccgactcgatgggattgctgcctcaaatggcatagcaatcgctaaggcgtatttgctagtcgatcccgatctatcttttgagagagagaatgtcagtgatgtggatcatgaaatcgggaaagttcatgattcttttagtgagtctgcacaggagctcaaagttattaaacagcgagctttagaaactttagggcaagaagaggcggaagtctttgaggcccacattaccattttgaacgatccagaactaattggcgcgatcgagcaaaagattcgagacgagaagttgaacgctgagtcggccgtcaaggacgtcaccgatatgtatatcgagatgttcgaacaaatgacggacaatgcttacatgcaagaaagagccggcgacgtaagagacgtgacaaaacgtgtcttgagtcacttattaggtgttaagttacccagcccagcattgattgatagccagtcagttgttgtggcctatgatttaacgcctagtgatacggcacagttaaatcgtgattacgtgaagggctttgttaccgatatcggtggccgaacttcacattcagcgattatgtcacgaactcttgaaattccggccgtcgtcggaactgaaagtgtgacggcagatgtccacgatggtgatatgctaatcgtggatggcattcatgggaaggttgttgtcaacccaaccgatgaagaagtcaaagagtaccaacaaatggcggaccgttttgctaaggaacaggccgaatggaagttgctgaaggatgcggacacgcagacagcagacggacaccatgtagacattgctgcgaatattggaacccccgatgatttatcgggtgttattgataatggtggtgaagcagttggcttattccggtcagaattcctttatatgaattcagccgaattaccaacggaagacgaacagtttgaagcctataagaaggttgtcgaaggaatgaacgggcggcaagtggtgatccggacgatggatatcggcggagataaacacttaccatacctgccacttcccgaagaaatgaacccattcttagggtatcgggctattcggattagtttagaccgtcaggaaattttccggactcagttacgggcactgttacgagcttctaattatggtaagctcgccatcatgttcccaatgattgcaacggttgatgaatttaaacaagcacgagcaatctttgacgaagaaaaacaaaagatggttgaagctggcaactcggttgctgataatattgaagttgggatgatgatggaaatccctgctgcggttttaattgctgataagttagctaaatatgcagacttcttcagtattggaactaatgatttgattcaatattcatttgcggctgatcgtggtaacgaacatgtgtcatacttgtatcaaccatacaacccatcactgctacgtttaattaaacaagtgattgattgtgcccacgcagaaggcaaatgggccggtatgtgtggtgaaatggctggtgaccagattgcggtaccaattttacttggcatggggttagatgagttctcgatgagtgcaacgtcaatcctgcagacaagatcattgattaagcgattagacacgtcgaagttacaaccactagttgatgctgccctagatgcagaatcaaatgaggcggttatcgaacttgttaaccagcttgatattaaagattaaaacttaatttaagggcgttcctacggggatgtccttttttatatgcagaagtaatagtcggataaaagatctttaaataaatgataaaatttattaatttccgctattataattgattattaatcccattaaggtacaatgaattgcgttgcaacttgtgtagttaattgatattcagagacggttttagtacaataaatattgattattaatgttgaagaactaaatgaaactggttgtttttaaaccagtaaaacagggccaaaggagaattattgtgaacatcggtttatttacagatacatatttcccacaggtcagtggtgtcgctacttctattaaaacattgcgtgatgaattagaggcacaggggcataatgtttatatctttaccacaaccgatcctaaggtttctaaagatcaagtcgagcctggtatttaccggtttgcgagtgtacctttcgtttcattcactgatcgtcgaattgcggttcggggattatttaaggcttatcgattagcgaaggaattaaacttagatatcgtccataaccaaactgagttttcattggggtggatgggaaaagtcattgctaaagccctccatattccatgcattcatacttatcacacaatgtatcaagattacctgcactacattgccaatggtcgcattgttaaaccaaagaacgtgaagcaaatggcaacactgtatttggcacacatgaccggagtgattgcacctagtgatcgcgttttaaacgtattagaaggatacggtgtgaaggcgccaattcgggtcatcccaactggaattaacttggggcggtatcaggacaatgatagtccactggttagccagcagttacgcaaggagctgggatacacagaagagacgccagtaattttatcgcttagtcgccttgcatttgagaagaatattcatgaggtgatcgaggccctacctgagatactaaagcagttaccgacggctcagttgttgattgtgggggatggccccgccaaggagaccctcgaaaatcaagttcacgagatgaaattggacagtcatgtgacgtttaccggcgaaatcagtaatgatgcggttcatcactactatcacctggccgatgtattggtatctgcatcggattcagaatctcaagggctgacttatattgaggccctagcgtcaggactgccgattgtcgtcatgcgtagtccgtacacggatgagctgattgacgatgaggcaattgggagtagcttccagaagaaatcggaattggtggagaagacggttcagtacctgacgacaccgatgtcaaaagaagatgctaatgagcggactcggaagttaaaagaaatttcggcggaaacctttgttcaacgtgtggtgaaatactatcacgattgccaaatctcgttagcagagtcagagcatgaaccgattaatttatttcggggaccaagaggttaattgatgttaaaaattacaatgttttctgctgctgataaggttaaaggccagggagtcggcagtgcatatattgaattgatcaatctattaaaagatcgatttagcgatgaatttgaaattaagattaataagtatggtcggagtcagatcagccattatcatacgattaattttccgttttttctttcgacttttatgccagggcgtggtcgtaaaattggatacgtccattttttgcctgagacgcttgagggaagtgttaaaattccacagccgtttcgggctattttttattggtatgtgatcaaattttataaacgaatggatcatattgtggtggttaacccatcttttatccgcaaactggaaaaggttgggattgatcgaagtaagatcacgtacattccgaattttgtggatgacgatcattttcacgaattacctgcggcacaaaaacaagcgttacgagataagtatggatatgatcgcaaccggtttatgatcttaggaacgggccaaattcaggaacgtaaaggggtcaacgattttattaagttggcgcaacagaatcccgatattcagtttgtatgggctggtggattttcctttggccggattaccgatggctatgctgaattaaagaaggttgttgataatccgccggctaaccttagctttccaggcatcgtggatcgccatttaattggggaatactataacatggccgacctattcctattgccctcttataatgaactctttccaatgtccgtattggaggcttttagttgcgggacgccggttatgcttcgcgatctagatctctatcagtcgattattgacggatactatgaaccggcgcaagacgtggatgagatgcaagaaaaaataacggcactgagacaaaatccagcggggctaacatttttgcatgataagtcgttaattgcgacccagcgctattcaaagaatcatttggccgaaatttggcaccggttttacttacagcaagctgaagagaggtagccaatgtcaagacgtaatcggtttgtccttattctaatgttactggtgggactcggtattttcgggtactcacttcggaatgtgaaactgtcatcgttgctgcgtgacttggctaatctgcggtggcaatggtttattatcgcacttgtctgcatctgtatgtacctgattcttgaatcgctagtagtgaaaacgtttatggccgatcgattgtcgtcatttacgtttaaagatgcggtccgcgtccccttgatcgaacagctattcaacggaattacaccgttctcgacgggcgggcagcctgctcaattgattgcgatgttgcaatcgggggtcgatgcgggccaagcaagctcggttttactgatgaagttcgtcgtttaccaggccatgattgtagttagttttatcattagtctcttgatcggctttcactatattgcggaaaagctgcaggcattatcactgctcgtgatctttggcttcctagtgcactttaccgtcattgttggcttgttgatgattatgtattggcacagctttaccaaaaaggtcgtaaatctatgtattgcaccaggaaaatggtttatgtccgccgatcgtttcgtcaaaatgaaattaaacttggatacgaagatcgatagcttttatcaagaaagcctcaagattaagtccgaaggcgtcaagatgctccgagtatgcttattaacaatttgtcagctggcgttttattacttaattccgtactttatcatgcgctcgttgggagtcacaggccttaatttagtgatggtaactagtttgcatattttgatcgtcatgatcatttcgctatttccaattcctggcggtgctggtggggcggaatatagtttctcggtactcttttcgagctttattggtacgaacagtaaattagtactggcgatgattctctggcggttattaacgtactatttcggaatgtttgcgggaatgtttgcattgatgatcaaaccagacaaaaaaatatgaggaactcactgttgatgagttcctcatattttttgttttagtgaatgatgttagtaggtgtttcaatataggcacgaagccgtttcattgcttcttgtaacttggtcatatcagatgcgtagctgagtcggacgtatccttcaccttcatcaccaaaggcatgaccagggataagggcgagatggttcttttgggcaagatccttgcaaaaggccattgaatcttggttaaatggtgctggaattttgccgaagatgtagaaagcaccatctggtcgggcaatttcgaagcccatgtcgctcatttcgcgatagacataatcacgacgtttcaaatattcacgagccatttcacggccatcatcaataccgctagttagtgcttcaacggctgctttttggacaatcgaggttgctgcggtgaccatatactgatgaaccttcttaatctcttcgatcatgtctacatctgcgaagatgaaaccaattcgccaaccagtcatggcatgtgatttggataagccagaaatgagaacggtctgttctggaatcatactagcaatggaggtatgggtcgtaccataggttagttcagagtagatttcatcactgagaacccataaattgtactttttaaagacggtgactagtgcttctaactcttctttacgataagtcacgccagtagggttacttgggtagttgagtacgattgctttgaattggatatcgggatggtcctgaatggcctgttcgatcatctctggtgttaaaacaaaattattagggcgtgtgttaacgcggacctcaacaccatggtaaaaattaattagtggtgtgtaagctgaataaattggagcgggaacaatgacgccatcgccaggattaaggacggttcccaatgcagcagcgatagcttcggatgcgccaactgtagtgatcacgttatcagcattgtagtgaagaccatacttcttattttgaaaatctgctgccgcttgacgaacttcggggatgccagcattgctagtatagtgggagaagttatcatcaatggcctgctttgcggctaattgaacgtgctcaggaatgttgaagtctggttcaccaagggtgagctttaaaatatctgggatggaactagtggcttcgtcgaattggcgaatttctgaaacttcaatctgattaagctgtgcatttagatctgttctgaaaagactcaatacaattaccccaatttcttctataagattatagattaattaaaattattctagcatatctgtgatatagttaaacaaccaatctttgtcagtgaacatttttaggagataatatgatgaatgaatcagaattatttaaaattattagtcggttgcatgccatgcaaattgatgtaaccagccaaattcaacgacgaagatttgaaaaatttggtgttgaagtatgtcgagtagagtaggatcatcgaacgaaactgttcaaaatgattggttaccgaccttattatgaggcgcaattcgacaatttagatttggttgctattgaaatttatgattgtttagcacacttggaatatgttttttagtgatataagaaggacgaaaagcgctttctagagttactatagtcctaaaataccaataaaatggattgatttgaaaaaatagcttgacggtgattcgatcagttggtatgatatctaatgtcgtcaagcagaggacagcgtttccatcatttggcaaacgtattttaattaagaaattagttaaaaacatgcttgacgaactcaaatcaaaatggtaacattgttttcgttgctgttaacaagctgttcattattaattaaaaatagttgttgacatcatctttaaaaactgttattatttaaaacgttgctcaattaaaaagagcaacatggtagacctttgaaaactgaacaaagtttcgacaaatcaaatgtgtagggtcctttagcccgtagggttaaaggcaaaacatttgcgaagtcaattcgcttaaagtaacaaatcaaaaagagcaaacaagcttcttatttatatgagagtttgatccgggctcaggatgaacgctggcggtgtgcctaatcacatgcaagtcgtacgcattcccgtttttgattgaaggtgcttgacctgattgtataaacagctcggatggtggcgacggtgagtaacacgtggtaacctgcccagaagggggataacatttgaaacagatgctaataccgcataataaattgaacccatggttctatttgaaagatggccttgtgctatcacttctggatggacccgcggtgtattagctagttggtaaggtaacggctctaccaaggctgttacatgccgactgagaggtgatcggccacatggactgagacacggcccatactcctacggaggcagcagtagggaatcttccaatgggcgcaagcctgatgagcaacaccgcgtgattgaagagggtttcggctcgtaaactctgtggttaaagaagaacgttctaagagaactgcttagtcagtgacggtatttaaccagaaagccacggctaactacgtgccgacagcgccggtaatacgtagggtggcaagcgttatccggatttattgggcgaaagcgagcgcagcggttttttaagtctgatgtgaaagcttggcttaaccaagaagtcatcgaaactgtgaaacttgagtgcagaagaggacagtggaactccatgtgtagcggtgaaatgcgtagattatggaagaacaccatggcgaaggcggtgtctggtctgaactgacgctgagctcgaagcatgggtagcgaacaattagaatcccctggtagtccatgccgtaaacgatgatgctattgttggagggtttccgcccttcagtgcgcgctaacgcattaagcattccgcctggggagtacgaccgcaaggttgaaactcaaaggaattgacgggggcccgcacagcggtggagcatgtgtttaattcgaagcaacgcgaagaaccttaccaggtcttgacatctgcgccaacctcagagatgagcgttccttcgggacgcaagacaggtggtgcatggtgtcgtcagctcgtgtcgtgagatgttgggttaggtcccgcaacgagcgcaacccttttatcagttgccagcattagttgggcactctggtggagactgccggtacaaaccggaggaggtggggacgacgtcaaatcatcatgccccttatgacctgggctacacacgtgctacaatggacgtacaacgagtgcgaactcgcgagggaagctaatctcttaaaccgtttcagttcggactgaggctgcaactcgcctacacgaagtcgagaatcgctagtaatcgcggatcagcatgccgcggtgaatacgttcccgggccttgtacacaccgccgtcacaccatgagtttgaacacccaaagtcggtggggtaacccttcggggagccgccctaagggtggcagatgattagggtgaagtcgtaacaaggtagccgtaggagaacctgcgctggtcacccccgttctaaggaataaaacggaaccttgcacgtttgacttgtcacatgaaactttgtttagttttgagaggtttactctcaacttaattatagaatgcttatttgggcctatagctcagctggttagagcgcacgcctgataagcgtgaggtcgatggttcgagtccatttaggcccatatatggggaattagctcagatgggagagcacctgctttgcaagcagggggtcaacggttcgatcccgttattctccattaccaaccgacaggttggtaagacttgcactttgaaaactaaataatatcgaaatatttttttaaaacaaccgagaacaccgcgttatttgagttttttaatgaattacattacatcgcgtaatactcaattaatctgtggcgaccacgacgtggtcaaagcaaggttaagttataaagggcgcatggtgaatgccttggtactaggagccgatgaaggacgggactaacaccgatatgcttcggggagtggtaagtacactttgatccggagatttccgaatggggaaacccaactaacttagtcgttagttactacttagtgaatacatagctaagtagaggtagacgcagtgaactgaaacatctaagtagctgcaggaagagaaagaaaaatcgattccctgagtagcggcgagcgaaacgggaaaagcccaaaccaacgagcttgcttgttggggttgtaggactgaacatttgagttaccaaagtgagacgtagtcgaaatagctgggaagctatatcagagagggtgataatcccgtagacgaaacggcttactctcagttcaggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaatagttcctgaaaccatgtgcctacaaacagtgggagcccgttaatgggtgaccgcgtgcctattgtagaatgaaccggcgagttacgattgcatgccaggttaaggtggaaaaaccggagccgtagcgaaagcgagtctgaaatgggcgtatgaagtatgttgttgtagacccgaaaccaggtgacctacccatgtccaggttgaaggtgcggtaaaacgcactggaggaccgaacccgtgtcagttgaaaatggctgggatgaggtgtgggtagcggtgaaattccaaacgaacttggagatagctggttctctccgaaatagctttagggctagcctcggaataagaatcatggaggtagagcactgtttggactaggggcccgtcttgggttactgaattcagataaactccgaatgccattgatttatgtccgggagtcagacggtgagtgataagatccatcgtcaaaaggggaacagcccagatcaccagttaaggtcccaaaatatatgctaagtggaaaaggatgtggagttgcttagacaactaggatgttggctcagaagcagccatcatttaaagagtgcgtaatagctcactagtcgagtgatcctgcgccgaaaatgtaccggggctaagcatattaccgaaactgtggatgcatccgtaaggatgcgtgataggagagcgttctaagggcaatgaagtcagaccgtgaggactggtggagcgcttagaagtgagaatgccggtatgagtagcgaaagacaagtgagaatcttgtccaccgaatgactaaggtttcctggggaaggctcgtcctcccagggtaagtcgggacctaagttgaggccgaaaggcgtagacgatggataacaggttgatattcctgtaccagttaactgtgtttgaacgatggagggacgcaggaggctaagcaaaccagactgttggatatgtctggccaagcagcaagtcttgattagagtgaaatgctttaatctatacggacaagttgtgatggggagcgaaatttaagtagcgaagttgccgatgtcacactgccgagaaaagcttctagtgaatagttaactgcccgtaccgcaaaccgacacaggtagtcgaggagagaatcctaaggtgagcgagtgaactctcgttaaggaactcggcaaaatgaccccgtaacttcgggagaaggggtgctgcacgtcagtgcagccgcagtgaataggcccaggcgactgtttatcaaaaacacaggtttctgcaaaatcgtaagatgaagtataggggctgacgcctgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcactgtctcaacgagagactcggtgaaattgatatacctgtgaagaagcaggttacccgcgacaggacggaaagaccccatggagctttactgtagcttgatattgagtgtttgtaccgcttgtacagaataggtaggagccgtagaggccgggacgctagtttcggcggaggcattagtgggatactaccctcgctgtatgaccactctaacccgcaccactcatcgtggtgggagacagtgtcaggtaggcagtttgactggggcggtcgcctcctaaaaagtaacggaggcgcccaaaggttccctcagaatggttggaaatcattcgcagagtgtaaaggcacaagggagcttgactgcgagacagacaggtcgagcagggacgaaagtcgggcttagtgatccggtggtaccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacataccgctggtgtaccagttgttccgccaggagcatagctgggtagctacgtatggatgagataaacgctgaaagcatctaagtgtgaaactcgcctcgagatgagatttcccatcttccttcgggaagagtaagacccctcagagatgatgaggtagataggttggaagtggaagtgcagtgatgcatggagcggaccaatactaatcggtcgaggacttaaccaagcagcggtgaaggctgttaagaaaaagagtagatattatttagttttgagagcgcaagttctcagcacgtaagtgctagtgtggtgatgatggctagaaggatatacctgttcccatgccgaacacagaagtcaagcttctaagcgccgagagtagttgggggatcgctccctgcgagggtaggacgtcgccatgcacgatggaggattagctcagttgggagagcgtctgccttacaagcagagggtcacaggttcgagccctgtatcctccattgagccgttagctcagttggtagagcatctgacttttaatcagagggtcgacagttcgagactgtcacggctcattgtcgatgaaaattgacaggcatttgaaaatgccgacttagctcagttggcagagcatctgtcttgtaaacagggggtcgaaggttcgaatcctttagtcggcatcaaaatgcggaagtagttcagtggtagaacatcaccttgccatggtgggggtcgcgggttcgaatcccgtcttccgctttgccaattcaattatgccggggtggcggaattggcagacgcacaggacttaaaatcctgcggtcagtgatgaccgtaccggttcgatcccggtcctcggcattttaatacgcacccatagcgcaattggatagagtgtctgactacgaatcagaaggttgtaggttcgactcctactgggtgcattgttcgggaagtagctcagcttggtagagcacctggtttgggaccagggggtcgcaggttcgaatcctgtcttcccgataaataatcatagtgtgtgattattggaacaacgaagttgttcacactcgcggtgtagctcagctggctagagcgtccggttcatacccgggaggtcgagggttcgatcccccccgccgcgataggccggaattatgaaagctggacctttagctcagttggttagagcagacggctcataaccgtccggtcgtaggttcgagtcctacaaggtccattgagagatggacgaagagtggcaaaagtttatggaggattacccaagtctggctgaagggaacggtcttgaaaaccgtcaggtgggtcaaaccacgcgagagttcgaatctctcatcctcctttttaattatcgcgggatggagcagtctggtagctcgtcgggctcataacccgaaggtcgtaggttcaaatcctgctcccgcaattggtccgttggtctagctggttaggacgcctgcctgtcacgcaggagatcacgagttcgagtctcgtacggaccgttatggctcggtagctcagttggtagagcaacggattgaagctccgtgtgtcggcggttcgattccgtcccgcgccattagcaataaccattaatatgcgggtgtagttcagtggtaaaaccacagccttccaagctgttgtcgcgagttcgattctcgtcacccgctttaatgggcctatagctcagctggttagagcgcacgcctgataagcgtgaggtcgatggttcgagtccatttaggcccatagtggagaagtactcaagtggctgaagaggcgcccctgctaagggtgtaggtcgcgcaagcggcgcgagagttcgaatctctccttctccgtaaatgacccgttggtcaagtggttaagacaccgccctttcacggcggtaacatgggttcaaatcccgtacgggtcatccacaggcaacgcaagttgtcggacacaacataatattatcgcgggatggagcagtctggtagctcgtcgggctcataacccgaaggtcgtaggttcaaatcctgctcccgcaattggtccgttggtctagctggttaggacgcctgcctgtcacgcaggagatcacgagttcgagtctcgtacggaccgtaacaaacaacaaaagaggaagttatgatagtgcttttatcataacttcctctttttattagaattaataacttgtgtacaaacttaagcaagctggctggtaagttgtccgctgggtaataccgcggttacggtcttgactgctttaagcttttctaagaactgtagaatcaggtccatgcttccaatcattaaagtctttaatgtcggccacaattgttaaaataactagttcgttagattatcaaatttattttctaaaagatagccgcaattaagttttttgggtggtatttatttaaaaactgttgttaaaatgtgacgcagcatttttttgacatcttaataaagtttaaaaactcccacccccccacccccttcaacatggctcgttttgaattctatagcttcttctgcacattcagttactaccacaatgtccaaaggcgaccaacgtatcaaacaaagaagacgaaaaattgttggtttatcagataggttctaacaattgacagttgttgttggagttagaagttagaattggatgcaacagttttttaacgtctttcagg
